United States Patent 11,098,302 (IDENTIFICATION OF POLYNUCLEOTIDES ASSOCIATED WITH A SAMPLE) - sequence listing, part 14

SEQ ID NO: 45156 - DNA, 479 bp, Homo sapiens
  misc_feature: GYAE6OF01CKHWC.35.61.F06.1.454.CMB.1.raw
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
  modified_base (474)..(479): a, c, t, g, unknown or other
  misc_feature (474)..(479): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtcccagacagattcagcgccagtgggtcaggcactgacttcacactgaacatcagtagggtgaggctgaggatattgggatttattactgcatgcagggtacacactggccgttcacttttggcctagggaccaagctggagatacaaacgactgtggctgcacatctgtcttcactcttcccgcatctgaacgatctgtactgagcggcnggnaggcncatgnnnnnn

SEQ ID NO: 45157 - DNA, 548 bp, Homo sapiens
  misc_feature: GYAE6OF01C6R3P.35.61.F06.1.454.CMB.1.raw
  modified_base (274)..(274): a, c, t, g, unknown or other
  misc_feature (274)..(274): n is a, c, g, or t
  modified_base (537)..(538): a, c, t, g, unknown or other
  misc_feature (537)..(538): n is a, c, g, or t
  modified_base (540)..(548): a, c, t, g, unknown or other
  misc_feature (540)..(548): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacacctacttgatttggcttcagcagaggccaggccaatctccaaggcgcctaaattaataaagtttctaaccgggactctggggtcccagacagattcagcgccagnggtcaggcactgattcacactgaacatcagtaggtgaggctgaggatatgggatttattactgcatgcgagggtacacactggcgttcacttttcggctacggggacctaaggcctggagattacgaaacgaaccgtgtaggctaggcaccgaattctgttcttttaactcctttcccggcctaattccgtagaaccgtacttctaggttaaccttggaggtccgggtcgttgggaccgtaaagggccgtacgaagttacggnntnnnnnnnnn

SEQ ID NO: 45158 - DNA, 487 bp, Homo sapiens
  misc_feature: GYAE6OF01AY94L.35.61.F06.1.454.CMB.1.raw
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(487): a, c, t, g, unknown or other
  misc_feature (481)..(487): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtcccagacagattcagcgccagtgggtcaggcactgacttcacactgaacatcagtagggtggaggctgaggatattgggattttattactgcatgcagggtacacactggccgttcacttttggccaggggaccagctggagatcaaacgaactgtggctgcacatctgtcttcatcttcccgcatctgaacgtatctgtactgagcgggctggcaggcganatgnantnnnnnnn

SEQ ID NO: 45159 - DNA, 585 bp, Homo sapiens
  misc_feature: GYAE6OF01C2LAW.35.61.F06.1.454.CMB.1.raw
  modified_base (576)..(585): a, c, t, g, unknown or other
  misc_feature (576)..(585): n is a, c, g, or t
tcagtacagatcgtcacgaccggtgctcgatttagctacgctctaagggaaagggaggagtggagactgagtcatgacaacatctccactctccctgcccgtcacccttggacagcccggcctccatcctcctgcaggtctagtcaaagcctcgtttccagtgatggaaacacctactgatttggcttcagcagaggccaggccaatctccaaggcgcctaattaataaagtttctaaccgggactctggggtcccagacagattcagcgccagtgggtcaggcaactgacttcacactgaacatcagtagggtggaggctgaggatagttagggtactttattactgctatgcaagggtacacacgtggaccgttctacgttttggccgaggggtaccaaggtccgtaggaagtattacgaaacgtaaccgtaggtcggacgttggaccaccgaacttccgttacgtctttacctaactttcccgttccccgccgtactcgttacgtaacgtactccgttagtaacgttgaacgggtccgggcgttacgggacgaacgggcgtaccgaattaggnnnnnnnnnn

SEQ ID NO: 45160 - DNA, 580 bp, Homo sapiens
  misc_feature: GYAE6OF01CIJC3.35.61.F06.1.454.CMB.1.raw
  modified_base (349)..(349): a, c, t, g, unknown or other
  misc_feature (349)..(349): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaacacctacttgattggcttcagcagaggccaggccaatctcaaggcgacctaaattaataaagtttctaaccgggactcgtgggtcccagacagattcagcgccagtgggtcaggcacgtgacttcacactagaacatcgagtagggtgaggctggaggatagtgggtatttattactgcatgngagggtacacacgtggcttcgtacttttggccgtaacggggaccaagtctggagagtacgaaacgaactagtggcgtcgctacattctcgttcttcctacttccttccccgtactacgttcctgaaaccgtacttaccgttcgttaccgtaggaacggtccgggtaccgtacgggaccgttaaacgggccggtacggttaaacgttacggagctacggcgagagcngngng

SEQ ID NO: 45161 - DNA, 491 bp, Homo sapiens
  misc_feature: GYAE6OF01AWDPR.35.61.F06.1.454.CMB.1.raw
  modified_base (398)..(398): a, c, t, g, unknown or other
  misc_feature (398)..(398): n is a, c, g, or t
  modified_base (444)..(444): a, c, t, g, unknown or other
  misc_feature (444)..(444): n is a, c, g, or t
  modified_base (477)..(477): a, c, t, g, unknown or other
  misc_feature (477)..(477): n is a, c, g, or t
  modified_base (482)..(491): a, c, t, g, unknown or other
  misc_feature (482)..(491): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtcccagacagattcagcgccagtgggtcaggcactgacttcacactgaacatcagtaggtggaggctgaggatagttgggatttattactgcatgcagggtacacgactggccgttcactttttggccgaggggtaccaaggctgganatcaaacgaactgtggctgcaccatctgtcttcatctcccgcatcngacgatctgtactgagcgggctggcaagggcgnatggnnnnnnnnnn

SEQ ID NO: 45162 - DNA, 632 bp, Homo sapiens
  misc_feature: GYAE6OF01DWC06.35.61.F06.1.454.CMB.1.raw
  modified_base (623)..(624): a, c, t, g, unknown or other
  misc_feature (623)..(624): n is a, c, g, or t
  modified_base (626)..(626): a, c, t, g, unknown or other
  misc_feature (626)..(626): n is a, c, g, or t
  modified_base (628)..(630): a, c, t, g, unknown or other
  misc_feature (628)..(630): n is a, c, g, or t
  modified_base (632)..(632): a, c, t, g, unknown or other
  misc_feature (632)..(632): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacacctacttgatttggcttcagcagaggccaggccaatctccaaggcgcctaaattaataaagtttctaaccgggactctggggtcccagacagattcagcgccagtgggtcaggcactgacttcacactgaacatcagtagggtggaggctgaggatattgggatttatactgactatgcgtaggtacactacgtcggtccgttacttacgtttcggaccggacgggacaagtcgtaggaagtacgtaacgaaacgtaacgttggtacggtacgtagaccctaactacgttcgttacgttaccttacgtacctttcccgttaccccgtactaaccgtttccgttaaacggtaaacccgttcgtttaccgttacggttaaccgttacgggaacgggtccggggttaccggttcgggaaccggtaaccgggccggtaaccgtaaggtacggagacannanannngn

SEQ ID NO: 45163 - DNA, 494 bp, Homo sapiens
  misc_feature: GYAE6OF01E047J.35.61.F06.1.454.CMB.1.raw
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (484)..(494): a, c, t, g, unknown or other
  misc_feature (484)..(494): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctgggtcccagacagattcagcgccagtgggtcaggcactgacttcacactgaacatcagtagggtggaggctgaggatagttgggatttattactgcagtgcagggtacacactggccgttctacgttttggccgaggggaccaaggctgggagaatcgaaacgactgtaggctgcacatctgtctcatccttcccgctatcctgaacgtntctntactgngnggctggcaggcgcatnnnnnnnnnnn

SEQ ID NO: 45164 - DNA, 638 bp, Homo sapiens
  misc_feature: GYAE6OF01BI2Z2.35.61.F06.1.454.CMB.1.raw
  modified_base (622)..(622): a, c, t, g, unknown or other
  misc_feature (622)..(622): n is a, c, g, or t
  modified_base (634)..(634): a, c, t, g, unknown or other
  misc_feature (634)..(634): n is a, c, g, or t
  modified_base (636)..(637): a, c, t, g, unknown or other
  misc_feature (636)..(637): n is a, c, g, or t
tcagtacagatcgtcacgaccggtgctcgatttagctacgctctaagggaaagggagagtggagactgagtcatgactcagtctccactctccctgcccgtcacccttggacacgccggcctccatctcctgcaggtctagtcaagcctcgttccagtgatggaaacaccttacttgatttggcttcagcagaggccaggccaatcctaccgaaggccgtaccttaaattaaacttaaaagtttccgtaaccgggtactcgtcggggtacccagacagtacttcagcgcctaggtcggtcgaggcactgacttcgactacgtcaacagtacagggtagggtaggaggacgttggaaggtagttagttagggttaatttaattaacgtgacagtagacgaggtacacgtagtcgtcgttacgttacgtttacggacgtaacgggacaaggtcgtagggaactaacgtaacaaacggtacgttaggacgtactacggaacaccttagttcgtcgtacttctacgttccctaccgcttatccctaaggacgtacttacgttacgtacgtaggtacgggtcggtaccgttgggaaccggaacgggcctaagtacgtaggactacgnggtacacgagangnng

SEQ ID NO: 45165 - DNA, 582 bp, Homo sapiens
  misc_feature: GYAE6OF01C7HYC.35.61.F06.1.454.CMB.1.raw
  modified_base (355)..(355): a, c, t, g, unknown or other
  misc_feature (355)..(355): n is a, c, g, or t
  modified_base (573)..(582): a, c, t, g, unknown or other
  misc_feature (573)..(582): n is a, c, g, or t
tcagtacagatcgtcacgaccggtgctcgatttagctacgctctaagggaaagggagagtggagactgagtcatgacaacatctccactctccctgcccgtccacccttggacagccggcctccatctcctgcaggtctagtcaaagcctcgtttccagtgatggaaacacctacttgtatttggcttcagcagaggccaggccaatctccaaggcgacctaaatttaaataaacgtttctaaaccgggactcgtcggggtcccagacagattcagcgccaggtgggtcaggcactgtacttcacactgaaccatcaggtagggtggaggctggagtatagttggtattattacngtcatgcgaagggtacacgtacgtcggtccgtttacgtacgttttggacccggaaggggtaacccaaggtcgtagggagtacgtaacaaacgtaacgtggtggacttcggacaccgtattcgttcgtctttacgtctttccgttccccgcttactacgtacgaacgtacttacgtgtacgtcgacggtcggcgtcggtacgaacggtcgacgactggnnnnnnnnnn

SEQ ID NO: 45166 - DNA, 550 bp, Homo sapiens
  misc_feature: GYAE6OF01E15B8.35.61.F06.1.454.CMB.1.raw
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (525)..(550): a, c, t, g, unknown or other
  misc_feature (525)..(550): n is a, c, g, or t
tcagtacagatcgtcacgaccggtgctcgatttagctacgctctaagggaagggcctagaatacattgggtacatctacaacagtgggaacaccgagtacaacccgtccctcacgcgtcgagtgaccatgtcagtagacttgtcgaagaatctgttctccctgaaattgaactctgtgacggccgcggacacggccttatattactgtgcgagagacgcccccctgccctactttgatagtagtggttatcaggtctgggggccgagggacaatggtcatcgtctcttcacgcctccaccaacgggccccagtcccggtccctttcccccgtggcccacccctccctaccaagcgcctaccctcggtcgggggccaccgacggcccggtcccgtcgggcctcgcccgttcgggtacaaacgggtacccttacccgtttccccgaacggtacttccgttagttaaccgtgggaaccgggtccgggcggttcgggaccgtaacggggccgccgtaaagtagngcngnnnnnnnnnnnnnnnnnnnnnnnnnn

SEQ ID NO: 45167 - DNA, 568 bp, Homo sapiens
  misc_feature: GYAE6OF01BRVTP.35.61.F06.1.454.CMB.1.raw
  modified_base (362)..(362): a, c, t, g, unknown or other
  misc_feature (362)..(362): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (564)..(568): a, c, t, g, unknown or other
  misc_feature (564)..(568): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacacctacttgatttggcttcagcagaggccaggccaatctccaaggcgtacctaattttatttggtttctaaaacgggtctcgtggggtcccagacagattcagcggcagcgggtcaggcactgatttcacactagaaaactcagcgagggtggaggctggaggagtggtcggggtttactacgtgcatgacaanatagagacgtggcctcgtactacgtttcggccgagggaccaaggctgggaagagtaacgaaacgtaacgtggtacggctacggacctaccgtatccgtcgttaccttctaacttcccttcccgcctacttccgtacgtaacgtacttactgtaccgtgacggtcgggtctagggcgaacggcgacgtagtcgnacgtnacgnnnnn

SEQ ID NO: 45168 - DNA, 601 bp, Homo sapiens
  misc_feature: GYAE6OF01C2326.35.61.F06.1.454.CMB.1.raw
  modified_base (535)..(535): a, c, t, g, unknown or other
  misc_feature (535)..(535): n is a, c, g, or t
  modified_base (593)..(595): a, c, t, g, unknown or other
  misc_feature (593)..(595): n is a, c, g, or t
  modified_base (597)..(601): a, c, t, g, unknown or other
  misc_feature (597)..(601): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaaccacctacttgatttggcttcagcagagccaggccaatctaccaaggcgacctaattaataaagtttactaaccggactcgtgggtacccagacagacttcagccgccaggtggtcgaggcacgtgacttcacacgtgaactatcgaggtagggtggaggcgtaggaggattagttagggtactttaagttactgactagttgactagggtaccacgacgtcggccgttactcgttttgggccgtaaggggaccaaggtcgtaggaagacgtaacgaaaacggtaaccgtggtacgtcgcggtaccaaccgtattcccttagtcctttactacttccttccccgacttacgtccgtaagtaaaccgtnttacgttacgtaccgtaggacggcggtacgtcgggacctaagggcgagtagagtcgannnannnnn

SEQ ID NO: 45169 - DNA, 664 bp, Homo sapiens
  misc_feature: GYAE6OF01EVQG6.35.61.F06.1.454.CMB.1.raw
  modified_base (660)..(660): a, c, t, g, unknown or other
  misc_feature (660)..(660): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctgggtcccagacagattcagcgccagtggtcaggcactgacttcacactgaacatcagtaggtgaggctgaggtatagttgggatttatactgcatgcaggtacacactggccgttctacgttttggcccgtaggggaccctaaggcgtagggacgtacgtaccgaaacggtaacgtacgtagggtctaggtacccaaccgtaacttccgttcgtttacccttaccgtaacttccccgtttacccccgtacctaaccgttccgttaacggtaacccgtaacttcccggtttacgttaacccgttgggtaacccgggtcgggggtacccgtttacggggacccggtaaaacggggttcccgggaaccgtaacgggtttaaaccgggcgtaccgtacggtacgtagtagtacgtcgngtcg

SEQ ID NO: 45170 - DNA, 721 bp, Homo sapiens
  misc_feature: GYAE6OF01B97EW.35.61.F06.1.454.CMB.1.raw
  modified_base (713)..(713): a, c, t, g, unknown or other
  misc_feature (713)..(713): n is a, c, g, or t
  modified_base (715)..(717): a, c, t, g, unknown or other
  misc_feature (715)..(717): n is a, c, g, or t
  modified_base (719)..(721): a, c, t, g, unknown or other
  misc_feature (719)..(721): n is a, c, g, or t
tcagtacagatcgtcacgaccggtgctcgatttagctacgctctaagggaaagggagagtggagactgagtcatgactcagtctccactctccctgcccgtcacccttggacagcccggcctccatcctcctgcaggtctagtcaaagcctcgtttccagtgatggaacactacttgtatttggcttcagacagacggccaggccaatcctaccgaacggccgtaccttaaagtttaaacttaaacggttttaccgtaaaccggggtaccttccggttacgggggttaccccaggaaccgtaagtaacgttcgaacggccgacccggtaggttcggggtacgaggaccgacgtacgtaccttccgacacgttacgaacgtactacggtaggtaacggggttaggacggtagtagggtacgggtaagttagggttagggttattttacgtttaagtgtacgtagtacgcggtaacggtacctaacgtcgttacggtacccgtttaccgtacgttttaccggccggtaacgggaccgaaggtcgtaggacgtactaacgtaacgtaactggtacgtcgcgtaccgactactacgttcgtacttacgttcccgttccgttccccgtaccgtactttacgaaccgtacgtacgttccgttacgtaccgtacgggacggtcgggacgtcggacggacgtaccggatacgtagacgtgncnnncnnn

SEQ ID NO: 45171 - DNA, 695 bp, Homo sapiens
  misc_feature: GYAE6OF01EK2VK.35.61.F06.1.454.CMB.1.raw
  modified_base (327)..(327): a, c, t, g, unknown or other
  misc_feature (327)..(327): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
  modified_base (694)..(694): a, c, t, g, unknown or other
  misc_feature (694)..(694): n is a, c, g, or t
tcagtacagatcgtcacgaccggtgctcgatttagctacgctctaagggaaagggagagtggagactgagtcatgacaacatctccactctccctgcccgtcacccttggacagcccggcctccatctcctgcaggtctagtcaaagcctcgtttccagtgatggaaacacctacttgaattggtttcagcagaggccaggccaatcgtccgaggccgaccttaattttattttggtttactaaacgggtactcgtcggggtcccagacagattcagcggcaggcgggtcaggcactgactttacacactagaaaatcagcgagggnggagcgtggaggtgttcgggtcgggtttacacgtggactagtgacaacgtatacggaacgaccgtcggtcccttaccggttaacttacggttttcgggacccggtaaggggaacctaaggtccgtaaggtacgtaacttaaccggaaaacgtaacgttggtacggacttacggacctaacctacgtttacccttgtttaccctttaccgtacctttaccccgttccccgtaccttacttacccgtaacggtaaccgttcgttaccgttgttaacccggtggtacccgggtccggggttacggtaccgggaacggtaaccgggggtcctaaccggttaaggacgggaccttagcgtgacgagngntgng

SEQ ID NO: 45172 - DNA, 981 bp, Homo sapiens
  misc_feature: GYAE6OF01DEH2B.35.61.F06.1.454.CMB.1.raw
  modified_base (972)..(972): a, c, t, g, unknown or other
  misc_feature (972)..(972): n is a, c, g, or t
tcagtacagatcgtcacgaccggtgctcgatttagctacgctctaagggaaagggagagtggagactgagtcatgacaacatctccactctccctcgcccgtcacccgttggacagccggcctccatctcctgcaggtctagtcaaagtcctcgtttccagtgataggaaacctacctacttgtacgtttggacttcagcaggacggccgaggaccaactctaccgaagccgtaccttaaattaaagttaaacgtttacgtaaccgggtactcggtcgggtacccaagaccgtagtacttcgacggtccgaccgtaagggtcgggtaccgaacgggtacctaaccgttacggtaacccctttaccgaacccgtaaccgttaacggtaaacccgtaacggttaccggtaaaggggtttaacggggggttacggggtaacggggtaccggtttaacgggtaaacggggtttaaagttttaaccggggttttaacgggggttttaaatttttttaaaaccggttttaaccggttaacgggttaccgtaacgggtttaacgggaaccggtttaaaacggggggttaaccccttaacccggttaaccgggtttacccgggttacccggtttttaacccggtttacccggttttttaacccggggaacccggggtaaaaccgggggtaaaccgtaaaccgggttacccggtaaacggggtaaccggtaaaaccttaaaccgggaaaaaccggttacgggttacgggtaccggtaccgttaccgggtaacctaacccggtttacgtttaccgttaccggtttacccttaccggttacccgtttaccccgtttaccccggaaccctttaccgtaaccgttaacgggtaaccttaccgtttacgtaacggttaccggtagggtacccgggtccggtacgtacggggacgtaaccggcgttaacgagtagctaggactcggnagactgcga

SEQ ID NO: 45173 - DNA, 748 bp, Homo sapiens
  misc_feature: GYAE6OF01EKBUT.35.61.F06.1.454.CMB.1.raw
  modified_base (741)..(741): a, c, t, g, unknown or other
  misc_feature (741)..(741): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgacctaattaataaagtttctaaaccgggactcgtgggtcccagacagattcagcgccagtgggtcaggcactgacttcacactgaacatcaggtaggggtggaggctggaggtatagttgggattttagttactgctagtgacgagggtaccacgacgtcggtccgttactacgttttcgggaccgacgggggtaaccaaggtcgtagggaacgtaacgttaaccgaaaaccggtaaacggtttcggtaacggggtccgttaccggacccgtaacccgtaacgtttcccgttacggtttaccgttttaccgtaaacccgttttccccgtttaccccccggtaccccgttaactttaccccggttaaccgggtaaaaccgttaccgtttacccgttaccggtttaaacccgttacgggtaaaccggggtcccgggggtaacccttcgggggggtaaccctaaaaccggggggtcccgtaccggtaaaccggttaagggccgttaacggcgtacgtaacctaggtcgngtgtacg

SEQ ID NO: 45174 - DNA, 707 bp, Homo sapiens
  misc_feature: GYAE6OF01B8ZFV.35.61.F06.1.454.CMB.1.raw
  modified_base (688)..(688): a, c, t, g, unknown or other
  misc_feature (688)..(688): n is a, c, g, or t
  modified_base (697)..(697): a, c, t, g, unknown or other
  misc_feature (697)..(697): n is a, c, g, or t
  modified_base (704)..(705): a, c, t, g, unknown or other
  misc_feature (704)..(705): n is a, c, g, or t
  modified_base (707)..(707): a, c, t, g, unknown or other
  misc_feature (707)..(707): n is a, c, g, or t
tcagtacagatcgtcacgaccggtgctcgatttagctacgctctaagggaaagggagagtggagactgagtcatgactcagtctccactctcctcgcccgtcacccttggacacgccggcctccatctcctgcaggtctagtcaaagcctcgtttccagtgatacggaaactacctacttgtatttcggcttcgagcaggacggccacggaccaaatcctaccgaaggtccgtaaccttaaattaaagttaaacgtttaccgtaaaacccggggtacctaccggtacggggtaccccaaggaaccagtacttacgacgccgaccgaggtcggtacgacggacacgtacggacttccaacctataacggaacctaacgtacgtagggttaaggggtcggacgggtcttagggaaggtaagtttaaggttagggttaattttacgtaacgtcgactagttacgaggtaacggttacacgtacgttacggtaccgtttacgttaccggtttacgggaccggtaacgggtaaccgtaggtaccggttaagggaactacgtaaccgtaaacgtacgtaggtacgtacgtaacgactactcgtactacttcacttcccgtccctactatcgtacgaactacttacgtacgtagtacggcggtaccggacggtgtaccgagtacgactaggcganctagactanacatcgnngn

SEQ ID NO: 45175 - DNA, 588 bp, Homo sapiens
  misc_feature: GYAE6OF01ET9JJ.35.61.F06.1.454.CMB.1.raw
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
  modified_base (581)..(582): a, c, t, g, unknown or other
  misc_feature (581)..(582): n is a, c, g, or t
  modified_base (584)..(588): a, c, t, g, unknown or other
  misc_feature (584)..(588): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacactacttgattttggcttcagcagaggccaggccaatctccaaggcgacctaattaaataaagtttcctaaaccgggactcgtgggtccagacagattcagcgccaggtggtcaggcactgacttcacacttgaacatcgagtaggggtggaggctggaggatagttgggtaatttattactgctaagtgacgagggttacacgacttcggtccgttctacgttttggacccggtaggggaccaagccgttaggacgtaataccgaaagtaaccgtggtacgggcttggacctacccgaattcgtagttccttacgtcttcccgttcccgacctactaccgtacgaacggtacttccgttaagtcccgttagagggcggtctgggaccgtaaggccgacgttaagngtnacgnncnnnnn

SEQ ID NO: 45176 - DNA, 528 bp, Homo sapiens
  misc_feature: GYAE6OF01A56K4.35.61.F06.1.454.CMB.1.raw
  modified_base (193)..(193): a, c, t, g, unknown or other
  misc_feature (193)..(193): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (428)..(428): a, c, t, g, unknown or other
  misc_feature (428)..(428): n is a, c, g, or t
  modified_base (477)..(477): a, c, t, g, unknown or other
  misc_feature (477)..(477): n is a, c, g, or t
  modified_base (519)..(520): a, c, t, g, unknown or other
  misc_feature (519)..(520): n is a, c, g, or t
  modified_base (522)..(528): a, c, t, g, unknown or other
  misc_feature (522)..(528): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagngccaggccaatcctcaaggcgcctaattaataaagtttctaaaccgggactcgtgggtcccagacagattcagcgccagtggtnaggnactgacttcacactgaacatacagtagggtggagctgaggatagttgggtatttattactgcatgagaggtacacacgtgtccgttctacgtttggccgaaggggtaacaaggacgtggaatactaacgtaaacgtaacttaggtgntagaccactatctgtcttacacgtccttccgaccatcgtagaactattntagtaactgaggtccgggctggacgaacgggcggacagtgannannnnnnn

SEQ ID NO: 45177 - DNA, 848 bp, Homo sapiens
  misc_feature: GYAE6OF01ATQOZ.35.61.F06.1.454.CMB.1.raw
  modified_base (80)..(80): a, c, t, g, unknown or other
  misc_feature (80)..(80): n is a, c, g, or t
  modified_base (820)..(820): a, c, t, g, unknown or other
  misc_feature (820)..(820): n is a, c, g, or t
  modified_base (840)..(840): a, c, t, g, unknown or other
  misc_feature (840)..(840): n is a, c, g, or t
  modified_base (845)..(845): a, c, t, g, unknown or other
  misc_feature (845)..(845): n is a, c, g, or t
tcagtacagatcgtcacgaccggtgctcgatttagctacgctctaagggaaagggagagtggagactgagtcatgacaanatctccactctccctgcccgtcacccttggacagccggcctccatctcctgcaggtctagtacaaacgcctcgtttccagtgataggaacactacttgtatttggcttcgagcagacggccgaggaccaatccgtaccgaacggccgtaccttaaatttaaacgttaaacgtttaccgtaaccggggtacttcggtcggggtaccctacggacagtattcgacggacgcccgtagggtcgggtacgagggcaacgttcggtacttaccaccgtaactagaaccgtagtacgtagggttaagggtgggacggtcgtagggtaagggaatttaagggtttaggggttaattttttaacgttacgtttacgacgttaaacggttcggtaaccggaacggggttaaccctacgttaaccgggttccgggttacccgtttttaacccgttaaccggttttttccgggggacccggtaaaccggggtaacccgtaaacgggtcggggtaacgggtaacgtaaacggtaacccgtaaaacggttacggttaacgggtacgggttacctacggtaaccctaacccggttacttacccgttacggttaccctttaccgtaccgttttaccccgtcccgttaaccctctttaacccggaacgtttaacccgggttaactcgttaccgttaacgttcgggtacccgtcggggtaaccgtacgggaccggttaaccggagtacggaacgtanccggtatccgaatagtaccngtcgngcg

SEQ ID NO: 45178 - DNA, 690 bp, Homo sapiens
  misc_feature: GYAE6OF01ATASH.35.61.F06.1.454.CMB.1.raw
  modified_base (306)..(306): a, c, t, g, unknown or other
  misc_feature (306)..(306): n is a, c, g, or t
  modified_base (680)..(680): a, c, t, g, unknown or other
  misc_feature (680)..(680): n is a, c, g, or t
  modified_base (686)..(686): a, c, t, g, unknown or other
  misc_feature (686)..(686): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgacctaattaataaagtttcgtaaccgggactcgtcggggtcccagacagattcagccgccaggtggtcaggcactgacttcacactgaacnctcaggtagggtggaggctggaggatagttgggtattttacttactggctagtggacgtacggtacacgtacgtggtcccgtttacgtaccgttttacggccgtaacggggaccctaggacgtcgggtaagaactaacgaaaccgtaacgttcggtacggtaccgtacgaccgtaccctaagttccgttacgtttcccgtttaccgtacttttacccccgttacccgtacccgttacgttacccggtacggtaaaccgttactttaccgttacggtttaccgtacggtaaccggggtcgggtacccggttagggaacccggttaacgggacccggtaacggttaacgtaaccgggcttaaccggcgtcgtacgnacgtgngtcg

SEQ ID NO: 45179 - DNA, 513 bp, Homo sapiens
  misc_feature: GYAE6OF02ILM12.35.61.F06.1.454.CMB.1.raw
  modified_base (506)..(513): a, c, t, g, unknown or other
  misc_feature (506)..(513): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagttctaaaccgggactctggggtcccagacagattcagcgcagtgggtcaggcactgacttcacactgaacatcagtagggtggaggctgaggatagttggatttatactgcatgcagggtacacactggccttctacttttggccaggggaccaagctaggagatacaaacgaactgtgcgtgcaccatctagtcttcacttccttcccgctactctacgaacgacttcgtagttacgtgacggcgggtctgggacaacgggtcgactagtagcagnnnnnnnn

SEQ ID NO: 45180 - DNA, 486 bp, Homo sapiens
  misc_feature: GYAE6OF02HJ4FH.35.61.F06.1.454.CMB.1.raw
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (479)..(486): a, c, t, g, unknown or other
  misc_feature (479)..(486): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtcccagacagattcagcgccagtgggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccncatctcgaacgatctntactgagcggntggcaggcgnatagnannnnnnnn

SEQ ID NO: 45181 - DNA, 493 bp, Homo sapiens
  misc_feature: GYAE6OF02FOCK8.35.61.F06.1.454.CMB.1.raw
  modified_base (483)..(484): a, c, t, g, unknown or other
  misc_feature (483)..(484): n is a, c, g, or t
  modified_base (487)..(493): a, c, t, g, unknown or other
  misc_feature (487)..(493): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaaatctccaaaggcgcctaattaataaaagtttctaaccgggactctggggtcccagacagattcagcgccagtgggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaacgatctgtactgacgcgggctggcaaggcgcatagnngcnnnnnnn

SEQ ID NO: 45182 - DNA, 597 bp, Homo sapiens
  misc_feature: GYAE6OF02J0405.35.61.F06.1.454.CMB.1.raw
  modified_base (168)..(168): a, c, t, g, unknown or other
  misc_feature (168)..(168): n is a, c, g, or t
  modified_base (211)..(211): a, c, t, g, unknown or other
  misc_feature (211)..(211): n is a, c, g, or t
  modified_base (295)..(295): a, c, t, g, unknown or other
  misc_feature (295)..(295): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (588)..(588): a, c, t, g, unknown or other
  misc_feature (588)..(588): n is a, c, g, or t
  modified_base (592)..(592): a, c, t, g, unknown or other
  misc_feature (592)..(592): n is a, c, g, or t
tcagtacagatcgtcacgaccggtgctcgatttagctacgctctaaggaagggagagtggagactgagtcatgacaacatctccactctccctgcccgtcacccttcggacacgccggcctccactctcctgcaggtctagtcaaagcctcgttccagtgatggaacncctacttgattggcttcagcagagccaggccaatctcaaggcncctaattataaagtttctaaccggactacgtgggtcccaggtacagacttcagcgtccagtcggtcaggcacgtgacttcgacnctcgaacatcagtaggtggaggctaggaggtacttagttgggattttagtaacgtgtacagttgacgaggttacaacgtacgtcgggtaccgttctaacgttttcggaccgtagggggtacctaggccgttgggacgtacttacgaaaccgtagtcgtaggtctagcgtaccaagttcgtacgtctttacgacttaccgtcccgtactcgttacgtcgtaaccgtattccgtacgttagcgtaaggtccggtacgtcggacgtaacggcgtaccaagttccggancgtancgngtcnctgca

SEQ ID NO: 45183 - DNA, 487 bp, Homo sapiens
  misc_feature: GYAE6OF02FJFW8.35.61.F06.1.454.CMB.1.raw
  modified_base (479)..(487): a, c, t, g, unknown or other
  misc_feature (479)..(487): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtcccagacagattcagcgccagtgggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatccttcccgccatctgaacgatctgtactgagcggctggcaaggcgcatagnnnnnnnnn

SEQ ID NO: 45184 - DNA, 625 bp, Homo sapiens
  misc_feature: GYAE6OF02JR5YN.35.61.F06.1.454.CMB.1.raw
  modified_base (370)..(370): a, c, t, g, unknown or other
  misc_feature (370)..(370): n is a, c, g, or t
  modified_base (405)..(405): a, c, t, g, unknown or other
  misc_feature (405)..(405): n is a, c, g, or t
  modified_base (620)..(620): a, c, t, g, unknown or other
  misc_feature (620)..(620): n is a, c, g, or t
  modified_base (623)..(624): a, c, t, g, unknown or other
  misc_feature (623)..(624): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggctcctaaattaataaagtttcaaaccgggactctgggtcccagacagattcagcgccagtggtcaggcactgacgttcacactgaacatcacgtaggtggaggcgtgaggatatgggatttatacgtgtcagtgcagggtacacgatggtccggttntacgttttggaccgagggtaccgaagccgttaggngaatacgaaaacgtacgtagtacggtcgtagaccgacctaaggttcctacgggtttacttccgtaacgttccgttttacccccggtacctaacggtttccttaaccggtaaccgggtaacctttaccgttagtttaacccgttacggtaaccggtggggttacccgttcgggtaaccgaacgggttaccggacgaacgtttagaacgtgcgcgcnagnnc

SEQ ID NO: 45185 - DNA, 737 bp, Homo sapiens
  misc_feature: GYAE6OF02IGWR3.35.61.F06.1.454.CMB.1.raw
  modified_base (113)..(113): a, c, t, g, unknown or other
  misc_feature (113)..(113): n is a, c, g, or t
  modified_base (213)..(213): a, c, t, g, unknown or other
  misc_feature (213)..(213): n is a, c, g, or t
  modified_base (713)..(713): a, c, t, g, unknown or other
  misc_feature (713)..(713): n is a, c, g, or t
  modified_base (732)..(732): a, c, t, g, unknown or other
  misc_feature (732)..(732): n is a, c, g, or t
tcagtacagatcgtcacgaccggtgctcgatttagctacgctctaagggaagggagagtggagactgagtcatgactcagtctccactctccctgcccgtcacccttggacanccggcctccatctcctgccaggtctagtcaaagcctcgttccagtgatggaaacactacttgatttggcttcagcagaggccaggccaatctccaaggcncctaagttataaagtttcctaaccggactcgtgggtcccagaccagacttcagcgtccagtggtctaggctacctggaccttagaccacgtcgaaacacgtacgagtacggggtggtaacggccttaggaacgggtataacgtttcggggtaatttttaacgttaacgtggtaccgtaaggttacgaccgtaaggggttacctaacgtaacggtttcgggtacccgttttacgtaacgtttttaccgggacccggtaaacggggggtaaccctaaagggaccctttacggggtaacgtaaccgttaaccgaaaaccggttaaaccgttcggtaacgggtactacgtacccgacctacggttactacggttacctttacgtacgtttaccctttccccggtactagttaaccgtggaaacccttagttccttacgttaaccttcggacgttcgggtaccttcgggaccgaaacggggtccgtaacgacgttaggactacgnggtacctcggatcgacgtntacgg

SEQ ID NO: 45186 - DNA, 567 bp, Homo sapiens
  misc_feature: GYAE6OF02F9QNI.35.61.F06.1.454.CMB.1.raw
  modified_base (554)..(555): a, c, t, g, unknown or other
  misc_feature (554)..(555): n is a, c, g, or t
  modified_base (561)..(567): a, c, t, g, unknown or other
  misc_feature (561)..(567): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactcgtggggtcccagacagattcagcgccagtgggtcaggcactgacttcacactgaacatcagtagggtggaggctgaggatattgggatttattactgcatgcgagggtacacactggccgttcacgtttttcggccgagggggtacccaagtccgtgggaacgataccgaaaacggaacgttgtagggtcgttaggccaccattcgtcgttccttcctattccctttccccgccctacttccgtacgaaccgtacttcgttgttaccgtcgaggtccgggcgttggacgaacgggcgacgtagtacggnngtacgnnnnnnn

SEQ ID NO: 45187 - DNA, 486 bp, Homo sapiens
  misc_feature: GYAE6OF02GARA1.35.61.F06.1.454.CMB.1.raw
  modified_base (475)..(477): a, c, t, g, unknown or other
  misc_feature (475)..(477): n is a, c, g, or t
  modified_base (479)..(480): a, c, t, g, unknown or other
  misc_feature (479)..(480): n is a, c, g, or t
  modified_base (482)..(486): a, c, t, g, unknown or other
  misc_feature (482)..(486): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtcccagacagattcagcgccagtgggtcaggcactgacttcacactgaacatcagtagggtggaggctgaggatattgggatttattactgcatgcagggtacacactggccgttcacttttggccaggggaccaagctggagatcaaacgactgtggctgcaccatctgtcttcatcttccgcatctgaacgatctgtactgagcggctggcaggcgcagtagnnngnngnnnnn

SEQ ID NO: 45188 - DNA, 509 bp, Homo sapiens
  misc_feature: GYAE6OF02GU25S.35.61.F06.1.454.CMB.1.raw
  modified_base (449)..(449): a, c, t, g, unknown or other
  misc_feature (449)..(449): n is a, c, g, or t
  modified_base (466)..(466): a, c, t, g, unknown or other
  misc_feature (466)..(466): n is a, c, g, or t
  modified_base (497)..(497): a, c, t, g, unknown or other
  misc_feature (497)..(497): n is a, c, g, or t
  modified_base (507)..(509): a, c, t, g, unknown or other
  misc_feature (507)..(509): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtcccagacagattcagcgccagtgggtcaggcactgacttcacactgaacatcagtaggtggaggctgaggatattgggatttatactgcatgcagggtacacactggccgttcacttttggccaggggaccaagctggagatcgaaacgaactgtggctgcaccatctgtcttcattcctcccgcactctagaacctntctgtactgagtcgggnttcggacgaaggtccggccgtaagtacggtngctagcagcnnn

SEQ ID NO: 45189 - DNA, 485 bp, Homo sapiens
  misc_feature: GYAE6OF02IIMRB.35.61.F06.1.454.CMB.1.raw
  modified_base (464)..(464): a, c, t, g, unknown or other
  misc_feature (464)..(464): n is a, c, g, or t
  modified_base (479)..(485): a, c, t, g, unknown or other
  misc_feature (479)..(485): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtccccagacagattcagcgccagtgggtcaggcactgacttcacactgaacatcagtagggtggagggctgaggatattgggatttatactgcatgcagggtacacactggccgttctacttttggccaggggaccaagctggagatacaaacgaactgtggctgcacatctgtcttcatcctcccgctatctgaacgatctgtactgagcggntggcaggcacatagnnnnnnn

SEQ ID NO: 45190 - DNA, 489 bp, Homo sapiens
  misc_feature: GYAE6OF02IZRG3.35.61.F06.1.454.CMB.1.raw
  modified_base (481)..(489): a, c, t, g, unknown or other
  misc_feature (481)..(489): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacacctacttgatttggcttcagcagaggccaggccaatctccaaggcgcctaaattaataaagtttctaaccgggactctggggtcccagacagattcagcgccagtgggtcaggcactgacttcacactgaacatcagtagggtggaggctgaggatattgggatttattactgcatgcagggtacacactggcgttcacttttggccaggggaccaagctggagatcaaacgaactgtggctgcaccatctgtcttcattcttcccgcactctgaacgatctgtactgagcgggctggcaaggcgcagtagnnnnnnnnn

SEQ ID NO: 45191 - DNA, 558 bp, Homo sapiens
  misc_feature: GYAE6OF02JAITV.35.61.F06.1.454.CMB.1.raw
  modified_base (295)..(295): a, c, t, g, unknown or other
  misc_feature (295)..(295): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (557)..(558): a, c, t, g, unknown or other
  misc_feature (557)..(558): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgacctaattaataaagtttctaaccgggactctggggtcccagacagattcagcgccaggtggtcaggcactgacttcacnctagacatcagtagggtggaggctgaggatagttggtatttattactgcagtgcgtagggtacacgtacgtcggtccgttacgtacgttttcggccgtaaggggacccaaggcgtaggaagtactacgaaacgaacgtgtcggtctcgaccacctattcgtgttcttctactccttcctcgtctactcgttacgaacgtctacgttagtaccgtgacggcgggtactcgggacgtacggccacgtatagtcancnagctagnn

SEQ ID NO: 45192 - DNA, 487 bp, Homo sapiens
  misc_feature: GYAE6OF02FWOZM.35.61.F06.1.454.CMB.1.raw
  modified_base (478)..(480): a, c, t, g, unknown or other
  misc_feature (478)..(480): n is a, c, g, or t
  modified_base (482)..(487): a, c, t, g, unknown or other
  misc_feature (482)..(487): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtcccagacagattcagcgccagtgggtcaggcactgacttcacactgaacatcagtagggtggaggctgaggatattggggatttattactgcatgcagggtacacactggccgttcacttttggccaggggccaagctcggagatacaaacgaactgtggctgcaccatctgtctcatctcccgccatctgacatctgtactgagcgggctggcacggcgacactgnnncnnnnnn

SEQ ID NO: 45193 - DNA, 576 bp, Homo sapiens
  misc_feature: GYAE6OF02GUFQ6.35.61.F06.1.454.CMB.1.raw
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (575)..(576): a, c, t, g, unknown or other
  misc_feature (575)..(576): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaaattaataaagtttctaaccgggactctcgggggtcccaggacagattcagcgccaggtgggtcaggcactgacttcacactgaacatcagtagggtggaggcgtgaggatagttgggtatttattactgcatgcagggtacactactggtccgttactacgttttcggccgtaggggacctaagcgtagggagatcgaaacgaacgtgtaggcgtgacaccgatctcgtacttcgtacttccctttacccgacctacttccgtacggtaacgtacttacgttacgttactacggaaggtccgggaccgttgggtaccgaacgggtcggaacgtacgtaaggctgacgntngatcnn

SEQ ID NO: 45194 - DNA, 503 bp, Homo sapiens
  misc_feature: GYAE6OF02FK2HO.35.61.F06.1.454.CMB.1.raw
  modified_base (369)..(369): a, c, t, g, unknown or other
  misc_feature (369)..(369): n is a, c, g, or t
  modified_base (490)..(490): a, c, t, g, unknown or other
  misc_feature (490)..(490): n is a, c, g, or t
  modified_base (493)..(495): a, c, t, g, unknown or other
  misc_feature (493)..(495): n is a, c, g, or t
  modified_base (497)..(503): a, c, t, g, unknown or other
  misc_feature (497)..(503): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaaccgggactctggggtcccagacagattcagcgcccagtgggtcaggcactgacttcacactgaacatcagtagggtggaggctgaggatattgggatttattactggcatgcagggtacacactggccgttnaccttttggcctaggggaccaagcctggagatcaaacgaactgtaggctggcaccatctagttcgttcattcttcccgccactctgaacgtatctgtctgagcggctggcgaggcgacganagnnngnnnnnnn

SEQ ID NO: 45195 - DNA, 558 bp, Homo sapiens
  misc_feature: GYAE6OF02JHZ80.35.61.F06.1.454.CMB.1.raw
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (518)..(519): a, c, t, g, unknown or other
  misc_feature (518)..(519): n is a, c, g, or t
  modified_base (521)..(525): a, c, t, g, unknown or other
  misc_feature (521)..(525): n is a, c, g, or t
  modified_base (527)..(527): a, c, t, g, unknown or other
  misc_feature (527)..(527): n is a, c, g, or t
  modified_base (529)..(533): a, c, t, g, unknown or other
  misc_feature (529)..(533): n is a, c, g, or t
  modified_base (535)..(543): a, c, t, g, unknown or other
  misc_feature (535)..(543): n is a, c, g, or t
  modified_base (546)..(558): a, c, t, g, unknown or other
  misc_feature (546)..(558): n is a, c, g, or t
tcagtacagatcgtcacgaccggtgctcgattttagctacgctctaagggaagggcctagaatacattgggtacatctacaacagtgggaacaccgagtacaacccgtccctcacgcgtcgagtgaccatgtcagtagacttggtcgaagaatctgttctccctgaaattgaacttctgtgacggccgcggacacggccttatatttacgtgtgcgaggagaacgcccccctgcccctacggttttcgatagtagtggttatcgaggtctggggccgagggacaatggtctatcgtctctttcgagcctcccaccaaggggccccatccggtcccttacccccgtgggcctaccccgtcctaccaagacgcctacctctggggggcctaaccgaggccgggtcccgtagggacctcggacccttgggtacaaacggtacctactttcccgaacggactacgttgtaaccttggacggccgggcgtcgggacaacggccggactaagagtcncntacanngnnnnngngnnnnngnnnnnnnnngcnnnnnnnnnnnnn

SEQ ID NO: 45196 - DNA, 550 bp, Homo sapiens
  misc_feature: GYAE6OF02FGR3V.35.61.F06.1.454.CMB.1.raw
  modified_base (280)..(280): a, c, t, g, unknown or other
  misc_feature (280)..(280): n is a, c, g, or t
  modified_base (451)..(451): a, c, t, g, unknown or other
  misc_feature (451)..(451): n is a, c, g, or t
  modified_base (513)..(513): a, c, t, g, unknown or other
  misc_feature (513)..(513): n is a, c, g, or t
  modified_base (540)..(541): a, c, t, g, unknown or other
  misc_feature (540)..(541): n is a, c, g, or t
  modified_base (543)..(550): a, c, t, g, unknown or other
  misc_feature (543)..(550): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacacctacttgatttggcttcagcagaggccaggccaatctcaaggcgcctaattaataaagtttctaaaccggggactcgtggggtcccagacagattcagcgccagtgggtnaggcactgacttcacactgaacatcagtagggtgagctgaggatagttggatttattactgctatgcagggtacacgacgtggtccgttctaaccgttttgggccgtacgggggaccaaaggccgtaggaagatacgaaaacgaacgtggtaggctacggcaccattcgtnttcttccatcccttcccgactactcgtacgtaacgtacttctagtacctggacggtccgggngttcggaccgacgggcgtacagtacgnngnnnnnnnn

SEQ ID NO: 45197 - DNA, 608 bp, Homo sapiens
  misc_feature: GYAE6OF02GO2SS.35.61.F06.1.454.CMB.1.raw
  modified_base (602)..(603): a, c, t, g, unknown or other
  misc_feature (602)..(603): n is a, c, g, or t
  modified_base (605)..(608): a, c, t, g, unknown or other
  misc_feature (605)..(608): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactcgtcggggtcccagacagattcagcgccagtgggtcaggcactgacttcacactgaacatcagtagggtggaggctgaggatagttgggatttatactgcatgcagggtacacacgtggccgttacgtacgttttgggcccgaagggggaccctaaggcgtagggaacgtacttaaccgaaacgtaacgtggtacggcgtcggaccaacctagttccgttcgtttccttactacgttcccgtttaccccgaccttacgtacgttaccgaaacgttacttaccgttacggttacctagggtacggtccgggtccgtacgggaccgaaccgggccgtaccgtaagtacgagactgacgtnntnnnn

SEQ ID NO: 45198 - DNA, 621 bp, Homo sapiens
  misc_feature: GYAE6OF02IRR1E.35.61.F06.1.454.CMB.1.raw
  modified_base (285)..(285): a, c, t, g, unknown or other
  misc_feature (285)..(285): n is a, c, g, or t
  modified_base (602)..(602): a, c, t, g, unknown or other
  misc_feature (602)..(602): n is a, c, g, or t
  modified_base (612)..(612): a, c, t, g, unknown or other
  misc_feature (612)..(612): n is a, c, g, or t
  modified_base (619)..(620): a, c, t, g, unknown or other
  misc_feature (619)..(620): n is a, c, g, or t
tcagtacagatcgtcacgaccggtgctcgatttagctacgctctaagggaaagggagaggtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctaccaaggcgcctaaattaataaagttctaaccggactctgggtcccagtacagattcagcgcgagtggtcaggcacngacttcacactgaacatcagtagggtggaggctgagatagttggtatttatactgctatgcgaggtacacacgtggtccgttacgtacgttttcgggaccgtaacgggggacctaaaggccgtaggacgtaacttaaccgaaaacgtaacgtggttacgggtccgttggacccaaccggtattccgttagttccctttactacgtttcccgttaccccgtaccttagttccttacggtaaacgtacctttaccgttacgttaacgttcggtacgggtaccgggtcttacggacgtaaacgggctaccgaagtagcgntacgagtacngagtacnnc

SEQ ID NO: 45199 - DNA, 778 bp, Homo sapiens
  misc_feature: GYAE6OF02GTOT2.35.61.F06.1.454.CMB.1.raw
  modified_base (361)..(361): a, c, t, g, unknown or other
  misc_feature (361)..(361): n is a, c, g, or t
  modified_base (766)..(766): a, c, t, g, unknown or other
  misc_feature (766)..(766): n is a, c, g, or t
  modified_base (776)..(776): a, c, t, g, unknown or other
  misc_feature (776)..(776): n is a, c, g, or t
tcagtacagatcgtcacgaccggtgctcgatttagctacgctctaagggaaagggagagtggagactgagtcatgacaacatctccactctccctgccgtcacccttggacagccggcctccatctcctgctaggtctagtacgaaagccttcgtttccagtgataggaacctaccttacttgtatttcggcttacgagcaggacggtccgaggaccaatccgtacgaacggcctaccgttaaattaaagttaaacgtttccgtaaccggtactcggtcgggtacccagactagtacttcgacgccgtaccgtaggtcgggtacacggactactggttacctactaccgaacgtacgaacncgtaacgtacgggtaaggggtggacggtcggtaggaacggtacgtttaggttacggttaagtttaacgtacgttcgacgtacgtacggacggtaacgggacctaacgttaccggttacgtacccggttttacgttccgggtttacggacccggtaacgggggtaacctaggccggttaaggaacgtaacgtaaaccggtaaacggtacggttaggtaccggtacgtaccggaaccgtaccgttacgttaccgtttacgttaccgttacgtaccgtttccccgtacctacccgttgtaaccgttacgggtaaccttacgttaaccgtcggtttaccgtacgggtaccgtacggggtacctacgggtaggtacccggtggtaacggtaacgcgtatacgcgttgacnctagtcgtancg

SEQ ID NO: 45200 - DNA, 844 bp, Homo sapiens
  misc_feature: GYAE6OF02FPDZ0.35.61.F06.1.454.CMB.1.raw
  modified_base (824)..(824): a, c, t, g, unknown or other
  misc_feature (824)..(824): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagagccaggccaatctaccgaaggcgacctaaattaataaacgtttactaaccgggactcgtacggggtcccagacgagtacttcgacgcgtaccgtaaggtcgggttaccgacggtacgaccgtagtaaccttacgaacctaacgtacgaaactacgtaccgtaacgggtaacgggggttacggaagggtacctagggtaacggtaagtttaacggttttaggggttaacttttttaacggtttaccgttaaggtaccgtaacgtttacggaaccgggtaacgggggttaacctaacccgtaacgggttaccgggttacccgtttaccttaccgtttttacgggacccggtaaacggggacccgtaaggtccgttagggaacgtaacgtaaccggtaaaaccggtaacgttacgggttaccggtaccggttacgacgtaaacccgtactttaccggttaccgttacgtttaccggttaactttccccgtttaccccggaccgtttaaccttcggtaaccgttaacggttacctttacgttaacgtttaccgtacggtaaccgggtccgggttacgtaccggggtaacgtaaccggggaccgtaccggtaaggtaacgtgacttagaccgttanacggtactacgtagaacccg

SEQ ID NO: 45201 - DNA, 799 bp, Homo sapiens
  misc_feature: GYAE6OF02ILYGX.35.61.F06.1.454.CMB.1.raw
  modified_base (768)..(768): a, c, t, g, unknown or other
  misc_feature (768)..(768): n is a, c, g, or t
  modified_base (776)..(776): a, c, t, g, unknown or other
  misc_feature (776)..(776): n is a, c, g, or t
  modified_base (786)..(786): a, c, t, g, unknown or other
  misc_feature (786)..(786): n is a, c, g, or t
tcagtacagatcgtcacgaccggtgctcgattttagctacgctctaagggaaagggagagtggagactgagtcatgacaacatctccactctccctgcccgtcacccttggacagccgcctccatcacctgcaggtctagtacaaagtcctacgtttaccagttgataggaaacctaccttacgttagtagtttacggtctttacgagtcgaggacggtacccgacggtaccgaacttaccgtaccgaagggtaccgtaccttaaactttaaacgttaaacggttttaccgtaaacccgggtacgttccggttacggggtaccccaaggtacgtacgtacttccgacgtcgacctaggtacgggtacacggcacgtagtaccttaccacactagactatacgaggtaggcggagtacgtagaacggtattacggtttaggttaacttttacgtacgtacgtacgtacgtcggtaaccggttaacgggaacctaccgttaacggttcggtttacccgtttacgtttaaccggtttaccgggaaccgggttaacggtaaaccggtacgtacggttacgggtaactaaccgttaacggaaacccgttacggtagggtaccgtaccctggtaaccctaaccgttagttacccttccggttaccttaccgtccgttacccgtacccgtacgtacctacgtacgtaacgtccgttaacgttcgtaaccgtaggaccggttaccggtacgcgggtaaacgccggtaacttaacgngtacccgntacgcgtacnccgtgaggcagcg

SEQ ID NO: 45202 - DNA, 558 bp, Homo sapiens
  misc_feature: GYAE6OF01EANZ5.27.57.F02.1.454.CMB.1.raw
  modified_base (174)..(174): a, c, t, g, unknown or other
  misc_feature (174)..(174): n is a, c, g, or t
  modified_base (176)..(178): a, c, t, g, unknown or other
  misc_feature (176)..(178): n is a, c, g, or t
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (202)..(203): a, c, t, g, unknown or other
  misc_feature (202)..(203): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcggcgttgctaaggcgctataggncnnnagncatgngatntgngngngtgcnncngagancngagcncnctgncngctctgntctacttagtagttatgtagtgagcgtcggtccgccgacgacgtaccgagggacgggcgtggtaggttcggtcggaccgaacaacgtaaaccgaacgaagtaggaaggtaaagtaaaacgtaagtagtaggtacgtacgtagtaggaacggacgtacgtacgtacctactactacgacgacgaacgaacgaccgaacgaacgtactactacgtagtactacgacaactaacgaacgacgacgtacgagacgacggacggacgacgacgtacgtacgtacgtacgtgtcgagagagacgtacgtacgtactactacgtcttgtgtcg

SEQ ID NO: 45203 - DNA, 522 bp, Homo sapiens
  misc_feature: GYAE6OF01BVYCO.27.57.F02.1.454.CMB.1.raw
  modified_base (339)..(339): a, c, t, g, unknown or other
  misc_feature (339)..(339): n is a, c, g, or t
  modified_base (489)..(489): a, c, t, g, unknown or other
  misc_feature (489)..(489): n is a, c, g, or t
  modified_base (514)..(514): a, c, t, g, unknown or other
  misc_feature (514)..(514): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtaggctatttagaaggtgtcagtgtgaggtgcaatggtggattctggaggaggtgtggtccagcctggagaatccctgagactctcctgtgcagcctctggattcacctttagtagttattggatgagctggggtccgccagactccgaggggaaggggctggagttcgtggccaanactaaaccaagatggaaggtaaaagaaaactatgtggactctgtgaagggccgattcacatctcagagacaacgccaagaagtcactgtatctgacaaatgaacagcctagacgagaccgaggaccacggcttagtatactactggtcgngagagatccgtagtcattcccgttntttgctcg

SEQ ID NO: 45204 - DNA, 513 bp, Homo sapiens
  misc_feature: GYAE6OF01A45ZE.27.57.F02.1.454.CMB.1.raw
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (510)..(510): a, c, t, g, unknown or other
  misc_feature (510)..(510): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctgggagttcgtggccaacataaaccaagatggaggtaaagaaaactatgtggactctgtgaagggccgattcaccatctccagagacaacgaccaagaagtcactgtatctgcaaatgaacagcctagagagccgaggacacggctgtatactactgtgngagngatcctagtcattccgcttttgntcg

SEQ ID NO: 45205 - DNA, 570 bp, Homo sapiens
  misc_feature: GYAE6OF01CKCN9.27.57.F02.1.454.CMB.1.raw
  modified_base (338)..(338): a, c, t, g, unknown or other
  misc_feature (338)..(338): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgttagctatttagaaggtgtcagtgtgaggtgcaactggtggattctggaggaggtgtggtccagcctggagaatccctgagactctcctgtgcagcctctggattcacctttagtagttattggatgagctgggtccgcagactccagggaaggggctggagttcgtggccaaaanaataaacaaagataggaaggtaaaagaaaaactaatagtaggactctgtaggaagggaccgacttacaaccactactccacgaagaacaacgaaccaaagaaagtacactagtatactacgacaaataagaacaacgaccgtacgaagacggaccggaacggaacgacggacgtagtaataactacgtagtgtagaggagactactacgtactacttaccgttctttgtgtc

SEQ ID NO: 45206 - DNA, 523 bp, Homo sapiens
  misc_feature: GYAE6OF01ACLTO.27.57.F02.1.454.CMB.1.raw
  modified_base (490)..(490): a, c, t, g, unknown or other
  misc_feature (490)..(490): n is a, c, g, or t
  modified_base (518)..(518): a, c, t, g, unknown or other
  misc_feature (518)..(518): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaaggggctgggagttcgtggccaacataaaccaagatagggaaggtaaagaaaactatgtggactctgtgaagggccattcaccatctcagacgacaacgccaagaagtcactgtatctgacaatgaacagcctgagagccgaggacacggctgtatactacgtgtgagagngactccgtagtctagttccgtcttttgnttccg

SEQ ID NO: 45207 - DNA, 549 bp, Homo sapiens
  misc_feature: GYAE6OF01B4U69.27.57.F02.1.454.CMB.1.raw
  modified_base (299)..(299): a, c, t, g, unknown or other
  misc_feature (299)..(299): n is a, c, g, or t
  modified_base (333)..(333): a, c, t, g, unknown or other
  misc_feature (333)..(333): n is a, c, g, or t
  modified_base (399)..(399): a, c, t, g, unknown or other
  misc_feature (399)..(399): n is a, c, g, or t
  modified_base (489)..(489): a, c, t, g, unknown or other
  misc_feature (489)..(489): n is a, c, g, or t
  modified_base (538)..(538): a, c, t, g, unknown or other
  misc_feature (538)..(538): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaaggtgtcagtgtgaggtgcaactggtggattctggaggaggtgtggtccagcctggagaatccctgagactctcctgtgcagcctctggattctactttagtagttattggatgagctgggtccncagctccgagggagggctggagttcgtgaccaanataaaccagagtaggaagtaaaagaaactagtgtggtaactcgtagtggaacgggccattcacctntacctccaagacgacaacgccaaagacgtacaactgtaactgtagaacaaagtacgaacacgcctaggagacgaccggaagacgacggtntagtatactacgtgtcggagaggactactaccgtagtctactttcccgnttttgacttcg

SEQ ID NO: 45208 - DNA, 513 bp, Homo sapiens
  misc_feature: GYAE6OF01C98HF.27.57.F02.1.454.CMB.1.raw
  modified_base (443)..(443): a, c, t, g, unknown or other
  misc_feature (443)..(443): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccaggggaagggctgggagttcgtggccaacataaaccaagatggaaggtaaagaaaactatgtggactctgtgaagggccgattcaccatctccagagacaacgccaagagtcactgtatctgcaatgaacngcctgagagcccgaggacacggctgtatactactgtgcgaggngatcctagtcattccgcttttgnttcg

SEQ ID NO: 45209 - DNA, 628 bp, Homo sapiens
  misc_feature: GYAE6OF01A1R6L.27.57.F02.1.454.CMB.1.raw
  modified_base (154)..(154): a, c, t, g, unknown or other
  misc_feature (154)..(154): n is a, c, g, or t
  modified_base (161)..(161): a, c, t, g, unknown or other
  misc_feature (161)..(161): n is a, c, g, or t
  modified_base (168)..(168): a, c, t, g, unknown or other
  misc_feature (168)..(168): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (179)..(180): a, c, t, g, unknown or other
  misc_feature (179)..(180): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (223)..(223): a, c, t, g, unknown or other
  misc_feature (223)..(223): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaaccaccatggaactggggctgagcggngttcgtntaggcgnttagagncngnngagngcangtgatcngngngtntggcagcctgagatccctganctctctgtcgcacgcctcgtaggtacttctaccgtttagtagttagttggatggacgtcggtcgggtcccgaccgacgtaccgtacggaaggggaacggggtcggtaggtacggttacggtcggaccgaaacgaaacgtaaaaccgaaacgaagtaaggtaaaggtaaaacgtaaaacgtaagtaggtaggtacgtacgtaggtacggtaacggtacgtacgtactacctactacctaccgacgaacgaacgaaccgaacgaaacgtaacgtacgtacgtagtactacgtacgtacgtaataacgaacgacgtacgtacgacgacgacgacggacgacgacgtacgtacgtacgtacgtgtcgagagacgtacgtacgtacgtactacttacgttcttgtcgtcg

SEQ ID NO: 45210 - DNA, 539 bp, Homo sapiens
  misc_feature: GYAE6OF01BEMYW.27.57.F02.1.454.CMB.1.raw
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (535)..(535): a, c, t, g, unknown or other
  misc_feature (535)..(535): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctgggaggaggtgtggtccagcctggagaatccctgagactctcctgtgcagcctctggattcacctttagtagttattggatgagctggggtccgccagactccgaggggaaggggctgggagttcgtggccaacataaaccaagatagggaaggtaaaagaaaactagtgtggactcgtgtgaacgggccgattcaccatctccagacgacaacgccaaagaacgtcactgtatctgacaaatgaaacagacctagaagagccgaaggaccacggcctagtactactactgtcgngaggnactcctagtcattccgtcttttgntccg

SEQ ID NO: 45211 - DNA, 605 bp, Homo sapiens
  misc_feature: GYAE6OF01DQQR1.27.57.F02.1.454.CMB.1.raw
  modified_base (154)..(154): a, c, t, g, unknown or other
  misc_feature (154)..(154): n is a, c, g, or t
  modified_base (172)..(172): a, c, t, g, unknown or other
  misc_feature (172)..(172): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (180)..(181): a, c, t, g, unknown or other
  misc_feature (180)..(181): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcggngttcgtctaggcgcttanaggncngnnagtncangngatgngagngtgngcngcnganactcnganctcncngncngctctgatctacttagtagttagtgatgagcgtcggtccgcacgacgacgacgggagggcgtggtagtcgtcgacgaacaactaaacgaagagtaggaaaggtaaaagtaaaactaagtagtagtacgtcgtagtaggacggacgtacgtacacctactactacgacgaacgaacgaacgaacgaaacgaacgtacgtaacgtacgtactacgtacgtaactaaacgtaacgaacgaacgtaccgtacggagacggacggaacggaacgacgtacgtacgtaacgtacgttacgtacggtacggacggtaacggtaacgtaacgttaccgttaacgttaccgttacgttaccgtttccgtttacgttcgttaccg

SEQ ID NO: 45212 - DNA, 610 bp, Homo sapiens
  misc_feature: GYAE6OF01DNFY1.27.57.F02.1.454.CMB.1.raw
  modified_base (496)..(496): a, c, t, g, unknown or other
  misc_feature (496)..(496): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaactggtggattcgtgggaggaggtgtggtccagcctggagaatccctgagactctcctgtgcagcctctggattctacctttagtagttattggatgagcgtggtccgcagacctccgaggggaagggctggagttcgtggaccaacaataaaaccaagagtagggaaaggtaaaagaaaactagtaggtaggtacttacgtggtaggaacggggtccgtattccaacctactcctaccaagaacgaaccaacgaccaaagaacgtcaactagtactctagaacaaagtcgaaacngacctaggaacgtacggaccggaaggaccgacggtactagtaactaacgttaagtcggtacgacgaaggtacgacttacccgtagttctacgttaccgttcttttgacgtttcg

SEQ ID NO: 45213 - DNA, 506 bp, Homo sapiens
  misc_feature: GYAE6OF01ENM3S.27.57.F02.1.454.CMB.1.raw
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (400)..(400): a, c, t, g, unknown or other
  misc_feature (400)..(400): n is a, c, g, or t
  modified_base (482)..(482): a, c, t, g, unknown or other
  misc_feature (482)..(482): n is a, c, g, or t
  modified_base (503)..(503): a, c, t, g, unknown or other
  misc_feature (503)..(503): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccnccagactccaggggaaggggctggagttcgtggccaanataaaccaagatggaggtaaagaaactatgtggactctgtgaagggccattcacatcncagagacaacgcaagaagtcactgtatctgacaaatgaacagcctgagagccgaggacacggctgtatactactgtgcgagngatccagtcattccgctttgntcg

SEQ ID NO: 45214 - DNA, 543 bp, Homo sapiens
  misc_feature: GYAE6OF01BX0XJ.27.57.F02.1.454.CMB.1.raw
  modified_base (179)..(179): a, c, t, g, unknown or other
  misc_feature (179)..(179): n is a, c, g, or t
  modified_base (326)..(326): a, c, t, g, unknown or other
  misc_feature (326)..(326): n is a, c, g, or t
  modified_base (444)..(444): a, c, t, g, unknown or other
  misc_feature (444)..(444): n is a, c, g, or t
tcagagcgtcgtctcacgaccggtgctcgatttagctcgatatagttgggtttgaggtctcagagaggagccttagccctggactccaaggcctttccacttggtgatcagcacggagcacagagggcccaccatggaactggggctgagcggcgtttcgtgtaggcgtattagaaggngtcagtgtgaggtgcaactggtggattctggaggaggtgtggtccaggcctggagaatccctgagctctcctgtgcagcccttctggatctaccttatagttattggatgagctgggtccgccacgacgtccgaggaagggcgtggngtcgtggcacataaacaaagagtagaggtaaagaaactaatagtggaatcgtgtgaaggaccggattacacactctaccagagacgaacgaccaagaagtacactagtatctgacaanagacacgacgtagagacgacgacgacgacgacgtacgtactactagtcgtcgtagacggagacgtacgtacgtactacgttaccgttcgtttgtcgtcg

SEQ ID NO: 45215 - DNA, 514 bp, Homo sapiens
  misc_feature: GYAE6OF01EAKPT.27.57.F02.1.454.CMB.1.raw
  modified_base (343)..(343): a, c, t, g, unknown or other
  misc_feature (343)..(343): n is a, c, g, or t
  modified_base (489)..(489): a, c, t, g, unknown or other
  misc_feature (489)..(489): n is a, c, g, or t
  modified_base (511)..(511): a, c, t, g, unknown or other
  misc_feature (511)..(511): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaaggggctgggagttcgtggccaanataaaccaagatggaggtaaagaaaactatgtggactctgtgaagggccattcaccatctccagacgacaacgaccaagaacgtcactgtatctgcaaatgaacagcctgagagccgagacacggctgtatactactgtgacgagngatctagtcacttccgctttgntcg

SEQ ID NO: 45216 - DNA, 521 bp, Homo sapiens
  misc_feature: GYAE6OF01DYPBH.27.57.F02.1.454.CMB.1.raw
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccagggagggctggagttcgtggccaacataaaccaagataggaagtaaagaaactatgtaggactctgtgaagggccgattcaccatcctccagagaacaacgaccaagaacgtcactgtatctgacaaatgaacagacctgagagaccgagacgacggctagtatactagtgtgagagagctacctagtctattccgtnttttgnttccg

SEQ ID NO: 45217 - DNA, 572 bp, Homo sapiens
  misc_feature: GYAE6OF01DAAQ9.27.57.F02.1.454.CMB.1.raw
  modified_base (354)..(354): a, c, t, g, unknown or other
  misc_feature (354)..(354): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcggtcggtttcgtgtaggcgtatttaagtaaggtgtcagtgtgaggtgcaacgtggtggattcgtgggaggaggtgtgggtccaggcctggagaactccctgagactctcctgtgcagccctgtggtattcctaccttttagtagtttattggaatggagcgtgggtccgccagacctccgaggggacgggcttggagttcggngaccaacaataaaccaaagagtagggaaagtaaaagaaaatagtggtaggactgtaggtaggaacgggacctattaccactactctaccgaagacgaacaacgcaaagaacgtcaactgtaatcgagacaaatagaacagactacgagacgacgacgacgacgacgtagtatactacgtgtgagagagactactacgtactacttcttcttgtgtacg

SEQ ID NO: 45218 - DNA, 762 bp, Homo sapiens
  misc_feature: GYAE6OF01BH6L6.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaggtgtccagtgtgaggtgcaactggtggattctgggaggaggtgtggtccagcctggagaatccctgagactctcctgtgcagcctctggattctacctttagtagttattggatgagcgtgggtccnccagactccgaggggaagggctgggagttcggtggaccaacaataaaccaagagtagggaaaggtaaaagaaaacttagtaggtaggtaacctcgtaggtaggaaacggggcccgtaatttacccgaacctagttccctacccgaaggaacgaaacccaaaccggacccgtaaaaggaaacgttacccgaacgttacggttaaacgttccgttaaggaaaccctaaaaagttacggaaaaccctacggtaccccgttaagggaaacgggaaccggaccccgggaaagggaacccgtaacccggggtaccgttaagggttaaaccttaaaccccggttaacgttcgggttacgggacccgggtaaggtaaacggttaaccgtttaccccgttaaacgggttacccttaaccggttttaccccgggtttacctttttttagggaacccgttttcccgggg

SEQ ID NO: 45219 - DNA, 533 bp, Homo sapiens
  misc_feature: GYAE6OF01BXZLJ.27.57.F02.1.454.CMB.1.raw
  modified_base (505)..(505): a, c, t, g, unknown or other
  misc_feature (505)..(505): n is a, c, g, or t
  modified_base (522)..(522): a, c, t, g, unknown or other
  misc_feature (522)..(522): n is a, c, g, or t
  modified_base (528)..(528): a, c, t, g, unknown or other
  misc_feature (528)..(528): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaagggctggagttcgtggaccaacataaaccaagatagggaaggtaaaagaaaactatgtaggactctgtggaagggccagttcaccatctccagagacaacgaccaaagaagtcaactgtaactctagacaaatagaacagacctaggaacgagaccgaggacacggctagtatactactgtgcgagnatcctagtctattccgnttttgnttccg

SEQ ID NO: 45220 - DNA, 549 bp, Homo sapiens
  misc_feature: GYAE6OF01CAV53.27.57.F02.1.454.CMB.1.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
  modified_base (491)..(491): a, c, t, g, unknown or other
  misc_feature (491)..(491): n is a, c, g, or t
  modified_base (541)..(541): a, c, t, g, unknown or other
  misc_feature (541)..(541): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattctacctttagtagttattggatgagctgggtccncagactccagtgaaggggctggagttcgnggaccaaacataaaaccaagaagtaggaaggtaaaagaaaactatggtaggtactcgtaggtagaagggaccgtattcaaccatcctacagagaacaacgaccaagaagtcatgtatctagacaaatgaacagcctagacgagccgaaggacacggntagtactactacgtggtgacgagacgtatcccgtaatcctaattcccgtnttttggac

SEQ ID NO: 45221 - DNA, 527 bp, Homo sapiens
  misc_feature: GYAE6OF01D50TO.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtcagtgtgaggtgcaactggtggattctgggaggaggtgtggtccagcctggagaatccctgagactctcctgtgcagcctctggattcactttagtagttattggatgagctgggtccgccagactccgaggggagggctggagttcgtggccaacataaaccagataggaaggtaaagaaactatgtggactcgtgtggaagggccattcacatctacagagacaacgaccaaagaacgtcactgtaatctgacaaatgaacagcctagagagaccgaggacacggctaggtaatactacgtagtcgagagacgactcctagtctacttccgtctttgcttcg

SEQ ID NO: 45222 - DNA, 546 bp, Homo sapiens
  misc_feature: GYAE6OF01CWVSH.27.57.F02.1.454.CMB.1.raw
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagcgtgggtccnccagactccgaggggaagggctggagttcgnggccaacataaaccagatagggaagtaaagaaactatgtaggactcgtgtaggaagggccgattcacctatcctaccagacgacaacgacaaagagtacactagtatctgacaaatgaacacgcctaggacgtacgaccggaggaccgacggctagtactactacgtggtcgagaggacgactcctagtcctattcccgtcttttgacttcgg

SEQ ID NO: 45223 - DNA, 526 bp, Homo sapiens
  misc_feature: GYAE6OF01DXUXW.27.57.F02.1.454.CMB.1.raw
  modified_base (471)..(471): a, c, t, g, unknown or other
  misc_feature (471)..(471): n is a, c, g, or t
  modified_base (522)..(522): a, c, t, g, unknown or other
  misc_feature (522)..(522): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactacgaggggaagggctgggagttcggtggaccaacataaaccaagataggaagtaaagaaactatgtggactcgtgtgaaggccattcacatctccagagacaacgaccaagaagtcactgtatctgacaaatgaacagcctaggagagccgaggacacggntgtatactacgtgtgacgagagactcctaagtcctaattcccgtcttttgnttcg

SEQ ID NO: 45224 - DNA, 546 bp, Homo sapiens
  misc_feature: GYAE6OF01DU24O.27.57.F02.1.454.CMB.1.raw
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (460)..(460): a, c, t, g, unknown or other
  misc_feature (460)..(460): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaatccctgagactctcctgtgcagcctctggattcacctttagtagttattggatggagctgggtccnccagactccgaggggagggctggagttcgnggaccaanataaaccaagatagggaagtaaaagaaaactatgtaggactctgtaggaagggccattcaccatctaccagacgacaaacgccaaagaactcaactgtatctagacaaatcgaaacngacctagagacgccgaaggaccacggctgtatacctacgtggacgacgaagacgatcctagtctacttcccgtcttttgattccgg

SEQ ID NO: 45225 - DNA, 560 bp, Homo sapiens
  misc_feature: GYAE6OF01EPT5Y.27.57.F02.1.454.CMB.1.raw
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (555)..(555): a, c, t, g, unknown or other
  misc_feature (555)..(555): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttctgtgctatttagagtgtccagtgtgaggtgcaactggtggattcgtggaggaggtgtggtccagcctggagaatccctgagactctcctgtgcagcctctggattcacctttagtagttattggatgagcgtgggtccncagacctcgagggagggctggagttcgnggccaanactaaaccaagatagggaagtaaaagaaactatggtaggactcgtggtaggaacgggccgtattccaacctagtcctaccaagaacgaaccaaacgaccgaaagaacgtacactagtactctagactaaatcgaactagcctagacgacgaccggaggacacggctagtatactacgtggtcgaggagagacttaccgtagtcctacgtttccgtcttttgnttccg

SEQ ID NO: 45226 - DNA, 791 bp, Homo sapiens
  misc_feature: GYAE6OF01B1BAS.27.57.F02.1.454.CMB.1.raw
  modified_base (177)..(177): a, c, t, g, unknown or other
  misc_feature (177)..(177): n is a, c, g, or t
  modified_base (179)..(179): a, c, t, g, unknown or other
  misc_feature (179)..(179): n is a, c, g, or t
  modified_base (187)..(187): a, c, t, g, unknown or other
  misc_feature (187)..(187): n is a, c, g, or t
  modified_base (234)..(234): a, c, t, g, unknown or other
  misc_feature (234)..(234): n is a, c, g, or t
tcagagcgtcgtctcacgaccggtgctcgatttagctcgatatagttgggtttgaggtctcagagaggagccttagccctggactccaaggcctttccacttggtgatcagcatggagcacagacggacccaccatggaacgtggggctgagcggtgttcgtgtagctattagagtncngtgtgcgngcagtggtgatgtggagtggtggtgtccagctggagactccgtaganactctctgtggacacgtcttcgaggtacttacctaccgttttacggtaatttacgttggaattggacgtcgggttaccgggcccgaccgacggtacccgtaccgggaacgggggaacggggtcgttacgggttaacgttttccgggtaccgggaacccaaaccctaaacgttaaaacccggtaagggaaccgttaaggggaaaaggtaaaaaaccaaaacgtttcggtaggtaacggttacccttaggttaggggaaccgggaaacggggtccctaacggttaccaaccgtacggttacccgtaacgaacggtaacgaacccgtaaccggaccgaaacgggtaactccggtaaatacggttaaactccgttaagtaaccgtaaagttcgggaaaccgtcggaccgtagggtaacggaccggaaccggaacgggaccgtaaccggtgtttaaccggtaacgttaacccgttacggttcggtaccgggaggtaaccggtacgttaacccgttcccgttaaccgtcgttaaaccgtttccgtttacgtttcgtaccccgg

SEQ ID NO: 45227 - DNA, 532 bp, Homo sapiens
  misc_feature: GYAE6OF01BBPL8.27.57.F02.1.454.CMB.1.raw
  modified_base (304)..(304): a, c, t, g, unknown or other
  misc_feature (304)..(304): n is a, c, g, or t
  modified_base (501)..(501): a, c, t, g, unknown or other
  misc_feature (501)..(501): n is a, c, g, or t
  modified_base (527)..(527): a, c, t, g, unknown or other
  misc_feature (527)..(527): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagctgggtccnccagactccgaggggaaggggctggagttcgtggccaacataaaccaagatagggaaggtaaagaaaactatgtaggactctgtagaagggccgattcaccatctccagacgacaacgccaaagaagtacactgtatctgacaaatgaacagcctagagagaccgaggacacggctgtatactactggtgacgaganactcctagtctacttccgtcttttgnttccg

SEQ ID NO: 45228 - DNA, 525 bp, Homo sapiens
  misc_feature: GYAE6OF01EZKFA.27.57.F02.1.454.CMB.1.raw
  modified_base (495)..(495): a, c, t, g, unknown or other
  misc_feature (495)..(495): n is a, c, g, or t
  modified_base (521)..(521): a, c, t, g, unknown or other
  misc_feature (521)..(521): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaaggggctggagttcgtggccaacataaaccaagatagggaaggtaaaagaaaactatgtaggactcgtgtagaagggccgattccaccatctccagagacaacgccaaagaacgtcactgtatctgacaaatgaacagacctgagagaccgagacacggctgtatactacgtgtcgngagagatcctagtcattcgtctttgnttcg

SEQ ID NO: 45229 - DNA, 671 bp, Homo sapiens
  misc_feature: GYAE6OF01ATUIH.27.57.F02.1.454.CMB.1.raw
  modified_base (306)..(306): a, c, t, g, unknown or other
  misc_feature (306)..(306): n is a, c, g, or t
  modified_base (554)..(554): a, c, t, g, unknown or other
  misc_feature (554)..(554): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttattttagaggtgtccagtgtgaggtgcaactggtggattctggaggaggtgtggtccagcctggagaactccctgagactctcctgtgcagcctctggattcacctttagtagttattggatgagcgttgggtccnccagacctccgaggggaacggggtctgggtacgtttcggtcgggacccaaaacgaacttaaaaccgaaaggaagtaggggaaaagggttaaaaaagaaaaaccgttagttaggtacgggtaacttcgttagggtaggaaacggggcccgtattaccaaccgtattcccgtaccgaaggaacgaacccgaaaccgacctaaaaggaacgttaccaacgttgtaacttcctaggaacaaaagtcgaaacncgacctaggaagacggacccgaaggacccgacgggtaccttaggtaacttacgtaacgttggtacgagaaggtagacttacccgtagtacctactttcccggttcttttgcttccgg

SEQ ID NO: 45230 - DNA, 527 bp, Homo sapiens
  misc_feature: GYAE6OF01B659F.27.57.F02.1.454.CMB.1.raw
  modified_base (492)..(492): a, c, t, g, unknown or other
  misc_feature (492)..(492): n is a, c, g, or t
  modified_base (522)..(522): a, c, t, g, unknown or other
  misc_feature (522)..(522): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagatagggaaggtaaagaaaactatagtaggactctagtgaagggccgattcaccatctccagagacaacgaccaagaagtcactgtatctgacaaatgaacagcctagagagccgaggacgacggctagtatactactgtcgngagagacgtcctagtctattccgcttttgnttccg

SEQ ID NO: 45231 - DNA, 628 bp, Homo sapiens
  misc_feature: GYAE6OF01B8JAQ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaacgtggtggattctgggaggaggtgtggtccagcctggagaatccctgacgactctcctgtgcagcctctggattctacctttagtagtttattggatggagtcgtgggtcccgccagacctccggaggggaagggctagggtagttcggtcggaccaaacaataaaaccgaagagtagggaaagggtaaaagaaaactagtaggtaggacttcgtggtaggaaacgggtcctaattaccgaaccctattaccgtacccgaaggaacgaaaccgaaaccgacccaaaaggtacgtaccaacttagtactactaggaacctaaagtacgaaacacgtacccgtaggaacggacggacccggaagggaccacgggcttagtaactacctagtgtcgacgaggacgatccgtatctacttccgtctttgcttcg

SEQ ID NO: 45232 - DNA, 551 bp, Homo sapiens
  misc_feature: GYAE6OF01DLJ0B.27.57.F02.1.454.CMB.1.raw
  modified_base (496)..(496): a, c, t, g, unknown or other
  misc_feature (496)..(496): n is a, c, g, or t
  modified_base (546)..(546): a, c, t, g, unknown or other
  misc_feature (546)..(546): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttctgtgctatttagaaggtgtccagtgtgaggtgcaactggtggattctggaggaggtgtgggtccaggcctggagaatccctgagactctcctgtgcagcctctggattcacctttagtagttattggatgagctgggtccgccagacctccgaggggaagggctgggagttcggtggccaacaataaaccaagagtagggaaaggtaaaagaaaactagtggtaggacttcgtggtaggaagggcccgatttccaaccatcctaccaaggaacgacaacgaccaaagagtcactgtactctagacaatgaacacgctagagacgccgagacgacggntagtatacctacgtgtgacgagagacttctagtcctagttccgtctttgnttccg

SEQ ID NO: 45233 - DNA, 632 bp, Homo sapiens
  misc_feature: GYAE6OF01BZTCQ.27.57.F02.1.454.CMB.1.raw
  modified_base (305)..(305): a, c, t, g, unknown or other
  misc_feature (305)..(305): n is a, c, g, or t
  modified_base (485)..(485): a, c, t, g, unknown or other
  misc_feature (485)..(485): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattctacctttagtagttattggatgagcgtgggtccncagactccgaggggagggctggagttcggtgaccaacaactaaaccgaagatagggaaggtaaaagaaaactagtggtaggactcgtagtaggaacgggtccgtattccacctatcctaccgaagacgaacaaccgaccaaagaacgtccaacgttgtaatcgtagactaaatcgaaacncgacctaggaacggtacgccggaagggaccgaccgggtcttagtaacttaccgtaacgttggtacggaccggaaggtaacggtaccttaccccgttaaggttccttaaccgttttccccggttactttttagggaacctttcccggg

SEQ ID NO: 45234 - DNA, 809 bp, Homo sapiens
  misc_feature: GYAE6OF01AGM9W.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttccttgttgctatttagagtgtcagtgtgaggtgcaacgtggtggtattcgtgggagggtaggtggtcggtccaggccgtagggaagtaactcccgtggacgtaccttcctccgtgtcgcacgtccttcgtggtactttcctaccgttttagttagtttagttgggtatggacgtcggttcggggtcccgccgacgaccgtaccggaagggggaacgggtcgtagggtacggttcggtacggaccaaactaacgtaaaaccgaaggtaacgtaaggggaaaacggtaaaacggtaaaacttagtagggtacggtaacttcggtaggtaacggtaaccgggtccgtaacttacccgaacctacttacccgtaccgaaacggtaaccggaaacccgtaaacccggaacccgtaaaagggtaaacccgttaccgtaaccgtttaggttaaccttccgttaacggaaactaaacgttacgaaaccgtacggtaccgtagggaacgaccgggtaacccggtaaacgggacccgacgggttaccttaaggttaaccttaaacccgttagtgggtaccgggacggtaaggtaacgttaccgttaccgttacggttacccttaacgtttcccggtttaacgttttcggaacgtttcccggg

SEQ ID NO: 45235 - DNA, 638 bp, Homo sapiens
  misc_feature: GYAE6OF01C9UVK.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaacgtggtggattcgtggaggaggtgtggtccagcctggagaactccctgacgactctcctgtgcagcctctggtattctacctttagtagttattggatgagtcgtgggtccgccagactccgaggggaacgggctggtagttcgtcggaccaaacaactaaaccaagaagtagggaaagtaaaagaaaaactagtaggtaggactcgtaggtaggaacggggcctattccgaacctatcctaccgaaggaacgaaccaaaccgaccaaaggtaacgtcctaacgttgtaactctagacaaaatcgaaacgacgccgtaggaaggtcgaccggaaggaccgacggtactagtaactaccgttaacgtggtacgacgtaaggacgtacttcccgttaagtacccgttaacgtttccccgttatttttcgacgtttaccgg

SEQ ID NO: 45236 - DNA, 567 bp, Homo sapiens
  misc_feature: GYAE6OF01DTFNI.27.57.F02.1.454.CMB.1.raw
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (503)..(503): a, c, t, g, unknown or other
  misc_feature (503)..(503): n is a, c, g, or t
  modified_base (557)..(557): a, c, t, g, unknown or other
  misc_feature (557)..(557): n is a, c, g, or t
tcagagcgtcgtctcacgaccggtgctcgatttagctcgatatagttgggtttgaggtctcagagaggagccttagccctggactccaaggcctttccacttggtgatcagcacggagcacagatgacccaccatggaactggggctgagcttgggttttccttgttgctatttttagaaggtgtccagtgtgaggtgcaactggtggattcgtggaggaggtgtggtccagcctggagaatccctgagactctcctgtgcagcctctggatttcaccttttagtagtttattggatggagcgtggggtccnccagacctccgaggggaagggctgggagttcgnggaccaanataaaccaagatagggaaggtaaaagaaaactagtggtaggacttcgtggtgaaaggggccattcaccatcctcagagacaacgaccaaagaacgtcactgtaatctagacaaatgaacacgcctagacgacggccgaaggacaaccggntaggtactacgtacgtgtagacggagagtactccgtaagtcctaatttcccgtnttttggtacg

SEQ ID NO: 45237 - DNA, 524 bp, Homo sapiens
  misc_feature: GYAE6OF01BKL8H.27.57.F02.1.454.CMB.1.raw
  modified_base (491)..(491): a, c, t, g, unknown or other
  misc_feature (491)..(491): n is a, c, g, or t
  modified_base (520)..(520): a, c, t, g, unknown or other
  misc_feature (520)..(520): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctgggagttcgtggccaacataaaccaagatagggaaggtaaaagaaaactatagtggactctgtgaagggtcgattcaccatctccagagacaacgccaaagaagtcactgtatctgacaaatgaacagcctaggagagccgaaggacacggctgtatactactgtgngagagatcctagtctacttccgcttttgnttcg

SEQ ID NO: 45238 - DNA, 524 bp, Homo sapiens
  misc_feature: GYAE6OF01DC2OU.27.57.F02.1.454.CMB.1.raw
  modified_base (331)..(331): a, c, t, g, unknown or other
  misc_feature (331)..(331): n is a, c, g, or t
  modified_base (520)..(520): a, c, t, g, unknown or other
  misc_feature (520)..(520): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagctccagggaagggctgggagttcgnggccaagataaaccaaggatgggaaggtaaagaaaactatggtaggacttcgtgtaggaaagggccgattcaccatcctccagagacaacgccaagaagtcactgtatctgacaaatgaacagcctagagagccgaggacacggctgtactactactgtgcgagagatcctagtcacttccgcttttgnttcg

SEQ ID NO: 45239 - DNA, 563 bp, Homo sapiens
  misc_feature: GYAE6OF01EEM6N.27.57.F02.1.454.CMB.1.raw
  modified_base (299)..(299): a, c, t, g, unknown or other
  misc_feature (299)..(299): n is a, c, g, or t
  modified_base (559)..(559): a, c, t, g, unknown or other
  misc_feature (559)..(559): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaggtgtcagtgtgaggtgcaactggtggattctgggaggaggtgtggtccagcctggagaatccctgagactctcctgtgcagcctctggattcactttagtagttattggatgagctggggtccnccagactccgaggggagggctggagttcgtggaccaaacaataaaccaagatagggaaaggtaaaagaaaattatggtaggaactcgtggtaggaaacgggtccgtattaccaacctattcctaccaagacgaaccaaacgaccaaagaacgtcaactgtactctagactaaatgaacagcctagagacgaccggaagacgacggtctagtaactactacgtgtcgacgagacgactccgtagtctacttccgtctttgnttcg

SEQ ID NO: 45240 - DNA, 599 bp, Homo sapiens
  misc_feature: GYAE6OF01CADXM.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagctgggtccncagactccgaggggagggctggagttcgtggaccaaacaataaaccaagatagggaaggtaaaagaaaactatggtaggaactcgtagtaggaacgggccgtattaccaacctatcctaccgaaggaacgaaccgaaaccgaccaaagtaacgtcaacttagtaactcgtagacaaatcgaaacaggaccctaggaacgtacggacccggaaggaaccgacggctagtactacctaacgtggtacgacgaagacgacgttacctaggtctacgtttccgtctttttggacttccgg

SEQ ID NO: 45241 - DNA, 542 bp, Homo sapiens
  misc_feature: GYAE6OF01C3JF2.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagacctccgaggggaagggctggagttcgtggccaaacataaaaccaagatagggaaggtaaaagaaaactatggtaggactcgtggtaggaaagggcccgattccaccatctccagacgacaacgacaaagaagtcactgtatctgacaaatgaacagcctagagagccgaggaccacggctagtatacgtactggtcgagagagactcctagtcctattcccgtcttttgacttcg

SEQ ID NO: 45242 - DNA, 652 bp, Homo sapiens
  misc_feature: GYAE6OF01CMHXI.27.57.F02.1.454.CMB.1.raw
  modified_base (304)..(304): a, c, t, g, unknown or other
  misc_feature (304)..(304): n is a, c, g, or t
  modified_base (465)..(465): a, c, t, g, unknown or other
  misc_feature (465)..(465): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctgggaggaggtgtggtccagcctggagaatccctgagactctcctgtgcagcctctggattctacctttagtagtttatggatgagctgggtccnccagactccgaaggggtaacgggctgggacgttcggtcggtaccaaactaataaaccaagataggggaaggtaaaagaaaactatacggtaggtactctaggtaggaacggggccgtattccacctatcctaccagacgacaaccgacaaagagtcacgtntatctagacaaatcgaacacgacctaggaacggtacggacccggaagggaccgaccgggtacttacgggttaaacttaaccgttacgttacgggtacgggaccggtaaaggtaacggaaccgtttaccccggttaaggtttaccctaacgtttttcccccggttagtttttcggtactttacccggg

SEQ ID NO: 45243 - DNA, 525 bp, Homo sapiens
  misc_feature: GYAE6OF01A3KJN.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctggaggaggtgtgggtccagcctggagaatccctgagactctcctgtgcagcctctggattcacctttagtagttattggatgagctgggccgttttccagactccagggaaggggctggagttcgtggccaacataaaccaagataggaggtaaagaaaactaatagtggactctgtgaaggccgattcaccatctccagagacaacgaccaagaagtacactgtatctgacaaatagaacagacctagagagaccgaggacacggctgtatactactgtgcgagagatcctagtcattccgtctttgtattccg

SEQ ID NO: 45244 - DNA, 707 bp, Homo sapiens
  misc_feature: GYAE6OF01CGFVW.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctctgtgcacgcctcgtggtacttcctaccgtttagttagttagttggatggagtcgtgggtcccgcagtacctccgaaggggaacgggcgtagggtacgttcgggtcggacccaaaactaacttaaaaacccgaagtaagtaggggtaaaacgggtaaaaaacgtaaaaactaagtaggtacggtaacttcgtaggttaaggaaacggggacccgtatttacccgaaccctaactccgttacccgaaggacgaaaccgaaaccgacccgaaaacggtaacgtacctaccgttagtaacttcgtacgtaacaaagtacgtaaacacgtaccgtaggaacgacggaccggacggtaacgaccggtccgtagttacgtaacctagtcggtcggacggaaggtacgtaacgtcccgttaaggtaccctaacgtttccccgttactttttaggctttaccggg

SEQ ID NO: 45245 - DNA, 563 bp, Homo sapiens
  misc_feature: GYAE6OF01BXGON.27.57.F02.1.454.CMB.1.raw
  modified_base (309)..(309): a, c, t, g, unknown or other
  misc_feature (309)..(309): n is a, c, g, or t
  modified_base (467)..(467): a, c, t, g, unknown or other
  misc_feature (467)..(467): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgtggtttcgtgtagctatttagaaggtgtcagtgtgaggtgcaagtggtggattcgtgggaggaggtgtcgggtccaggcctaggagaactccctgagactctcctggtgcacgcctgtggtattctacctttagtagttattggatgagtcgtgggccnccagactcgagggaggctggtagttcgacggaccaagaataaaccgaagagtagggaaagtaaaagaaaactgtggaggacttcgagttaggaacggccgtaattcaccatccgtacagacgaacgaacgcgaaagtagcacgtgtatcagaactaanagaacgagacgacgagacgacgacggacgacgacgtagtatactacgtcgtgacgagagacgtacgtacgtactacttacgttctttgttgttacg

SEQ ID NO: 45246 - DNA, 660 bp, Homo sapiens
  misc_feature: GYAE6OF01C84PB.27.57.F02.1.454.CMB.1.raw
  modified_base (265)..(265): a, c, t, g, unknown or other
  misc_feature (265)..(265): n is a, c, g, or t
  modified_base (333)..(333): a, c, t, g, unknown or other
  misc_feature (333)..(333): n is a, c, g, or t
  modified_base (385)..(385): a, c, t, g, unknown or other
  misc_feature (385)..(385): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggcttagctgggttttccttgttgctatttagaaggtgtccagtgtgaggtgcaactggtggattctgggaggaggtgtggtccagcctggagaatccctgagactctcctgtgcacgcctntggattcacctttagagttatggatgagctgggtccgccagactccgagggaagggctgggagttcgnggaccaagaataaaccgaagataggaaagtaaagaaaactagtgtaggactntagtaggaacgggtccaattcaacctatccaccaagacgaacaacgaccaaaagacgtacaacgtggtaactcgtacgaacctaaaatacggaaacctagacccgtaaggacgggaacgtaccccgggaaaggaccgaacgggaccttaaggttaacgtaccttaaacggtgtacgggtaaccggaaggtaacggtaacgttacccgtaggttttaccctacgtttttaccccgggttattttttacgggaactttcccggtttaaacccggggg

SEQ ID NO: 45247 - DNA, 562 bp, Homo sapiens
  misc_feature: GYAE6OF01CNMCJ.27.57.F02.1.454.CMB.1.raw
  modified_base (305)..(305): a, c, t, g, unknown or other
  misc_feature (305)..(305): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (478)..(478): a, c, t, g, unknown or other
  misc_feature (478)..(478): n is a, c, g, or t
  modified_base (511)..(511): a, c, t, g, unknown or other
  misc_feature (511)..(511): n is a, c, g, or t
  modified_base (527)..(527): a, c, t, g, unknown or other
  misc_feature (527)..(527): n is a, c, g, or t
  modified_base (551)..(551): a, c, t, g, unknown or other
  misc_feature (551)..(551): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagcgtgggtccncagacctccgaggggagggctggagttcgtggccaaacataaaccaagataggaaggtaaaanaaaactntaggtggaacttcgtggtaggaaagggcccgaattcaacctatctaccaagacgaacaaacgacccaaaggaaatcaactgtactctagtacaaatggaaacngacctagacgacgaccgaggacacggctagtanactactgtcgagaagngacgtcctacgtctacttcccgtnttttgattccg

SEQ ID NO: 45248 - DNA, 743 bp, Homo sapiens
  misc_feature: GYAE6OF01BKMAB.27.57.F02.1.454.CMB.1.raw
tcagagcgtcgtctcacgaccggtgctcgatttagctcgatatagttgggtttggaggtctcagagaggagccttagccctggactccaaggcctttccacttggtgatcagcacgggagcacagaggacccaccatggaactggggctgagctgggttttcttgttgctattttagaaggtgtccagtgtgaggtgcaactggtggattctggaggaggtgtggtccagcctggagaatccctgagactctcctgtgcagcctctggattcacctttagtagttattggatgagtcgtggggtccgccagactccgaagggggtaacggggtctaggggacgtttcggtgggacccaaacgaataaaaccgaagtagtagggaaaggtaaaagaaaacgttagtaggtacgggaacttcgttaggttaggaaacggggtcccgtaatttccgaaccctaattcccgtaccgaagggtaacggtaaacccgaaaccggaccgaaaagggtaacggttacctaacgtttaggttaacttccgtagaacctaaaagttcggaaaaccacggtaccccgttaggaacggtacgggacccggtaacgggaaccgtaccgggtacgttaggttaaacgttaaccgttaaccggttgggtacggaaccggtaagggtaaacgtaaaccgtttcccgttaaggttccctaaccgttttcccggtactttttttacggaacctttcccggg

SEQ ID NO: 45249 - DNA, 597 bp, Homo sapiens
  misc_feature: GYAE6OF01BOB84.27.57.F02.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcggtggtttcgtgtaggctatttagaaggtgtcagtgtgaggtgnaactggtggattntggaggaggtgtggtccagcctggagaatccctgagactctcctgtgcagcctgtggattccactttagtagtttattggatggagcgttcggggtccacccagaccgtccgaggggaaggggtctgggagtttcggtggaccaacaanaaaccaaggatacggaaggtaaaagaaactataggtgactntaggtgaagggccaattcaccattccaccagagacagaccaaagagtcaacttgaacctnaganaanananacgacgacgacgacgacggacggacgacgacgtacgtacgtacgtacgttacgtacgtacgaacggtaacgtacgtaccgttaccgttaccgttaccgttaccgtttacgtttacgttacgttaccgg

SEQ ID NO: 45250 - DNA, 669 bp, Homo sapiens
  misc_feature: GYAE6OF01B8C2C.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagtcgtgggtccgcagactccgagggagggctggagttcgtggaccaacataaaccaagatagggaaggtaaaagaaaactataggtaggactcgtaggtaggaacgggccgtattccaacccgtaactccttaccgaagaacgaaccgaaaccggacccaaaaggaacgtaccaacgttagtaactccgttaggaacctaaaagttacggaaacacggtaccccgttaggaacggaaccggacccgggaaagggaacccgacgggtaccttaggttaactaaccgttaacgttggtacggaccggtaaggacgtaacgttacccttaaggttcctaaacgtttccccgttacgtttttacggacttttacccggg

SEQ ID NO: 45251 - DNA, 558 bp, Homo sapiens
  misc_feature: GYAE6OF01ESQIN.27.57.F02.1.454.CMB.1.raw
  modified_base (474)..(474): a, c, t, g, unknown or other
  misc_feature (474)..(474): n is a, c, g, or t
  modified_base (519)..(519): a, c, t, g, unknown or other
  misc_feature (519)..(519): n is a, c, g, or t
  modified_base (553)..(553): a, c, t, g, unknown or other
  misc_feature (553)..(553): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatggagcgtggggtcccgccagactccgaggggaacggggctgggagttcgtggaccaacataaaccgaagactagggaaggtaaaagaaactatggtaggactcgtggtaggaacgggcctaattcacctatcctaccagacgaacaacgccaaagaacgtcactgtatctagacaatgaacngacctagacgagccgaggacacggctagtactactacgtgtacgngagagactcctagtcctacgttaccgtcttttgnttccg

SEQ ID NO: 45252 - DNA, 649 bp, Homo sapiens
  misc_feature: GYAE6OF01CI68E.27.57.F02.1.454.CMB.1.raw
  modified_base (307)..(307): a, c, t, g, unknown or other
  misc_feature (307)..(307): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctgggaggaggtgtgggtccagcctggagaatccctgagactctcctgtgcagcctctggattcacctttagtagttattggatgagtcgtgggtcccnccagactccgaggggaagggctgggagttcggtggccaaacgataaaacccgaagagtagggaaaggtaaaaagaaaacttagtggtaggaacttcgtaggtaggaaaggggcctaattccaacctatccctaccgaaggaacgaaccgaaacgacccgaaaaggaaacgtccaacttggtaacttccgtaggaacctaaaagtcggaaaacgcgtacccgtaggaacgacggaccggaacggaccgacgggtcttaggtaactacgtaccgtggtcgacggaaggtcgaacttcccgtaagttacccttactttacccgttctttttagacgtttccccgg

SEQ ID NO: 45253 - DNA, 591 bp, Homo sapiens
  misc_feature: GYAE6OF01A7EM7.27.57.F02.1.454.CMB.1.raw
  modified_base (496)..(496): a, c, t, g, unknown or other
  misc_feature (496)..(496): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagactccgagggagggctgggagttcgtggaccaacaactaaaccaagatagggaaaggtaaaagaaaactatggtacggactcgtaggtaggaaacggggcctaattccaacctattccgtacccgaaggaacgaacccaaaccggaccgaaaagaacgtcctaacgtgtaactctagacaaatgaacncgacctgagagaccgaggacacggctggtaactaccgtactggtcgacgaaggacgacttccgtaagtctacttcccggttcttttagagttccg

SEQ ID NO: 45254 - DNA, 676 bp, Homo sapiens
  misc_feature: GYAE6OF01CRC4N.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagtcgtcgggtcccgccaggacctccgaagggggaaggggctgggtacggttcgtggacccaaacaataaaaccgaagaagtagggaaaggtaaaaagaaaactagtaggtaggaaccttcgtaggtaggaaacggggtcccgtaagtttaccaacccgtattcccgtacccgaaggaaccgaaacccgaaaccggtcccaaaaaggtaacggttacccaacgttggtaacttccgtaggaaacctaaagttacgaaacaacgcccgtaaggacggacggaccggaaggaacccgacggtcttaagtactaaccgttagtggtacggacggtaagaacgttaccttaccgtaagtcttacgtttcccgttattttgacttccgg

SEQ ID NO: 45255 - DNA, 749 bp, Homo sapiens
  misc_feature: GYAE6OF01BZ6IP.27.57.F02.1.454.CMB.1.raw
  modified_base (318)..(318): a, c, t, g, unknown or other
  misc_feature (318)..(318): n is a, c, g, or t
  modified_base (608)..(608): a, c, t, g, unknown or other
  misc_feature (608)..(608): n is a, c, g, or t
tcagagcgtcgtctcacgaccggtgctcgatttagctcgatatagttgggtttgaggtatcagagaggagccttagccctggactccaaggcctttccacttggtgatcagcacggagcacagaggacccacatggaactgggctgagcttgggttttccttgtgctatttagaaggtgtccagtgtgaggtgcaacgtggtggtattcgtgggaggaggtgtggtccaggcctggagactcctgacgactctctgtcgcacgtcctgtggtacttcctaccgttttagtagttagttggatggagtcgtgggtcccncagacctcggaaggggaacgggtcgtagggtacgttcggacggacccaaaacgaacgttaaaaccgaaggtacggtaaggggtaaaacggtaaaaaacgtaaaaaccgttggtacggtaacggtaaccctttaggtacgggtaacgggtaaaccggggtaccgttaacgtttaccccaacccgtattccccgtaacccgaaggtaaccgaaaccccgtaaaccggaccgtaaaaggtaacgttacctaaccgttagttaccgttaccgtaggaacctaaagtacgaaacncgtaaccgtaggaacggtacgacccggaaagggaccctaccgggtattacgggtaaacttacgtaccgttgggaccgacggtaagtacgtacccttaccgtacgttaccgttacgtttacccgtgttttgaacgttccggg

SEQ ID NO: 45256 - DNA, 520 bp, Homo sapiens
  misc_feature: GYAE6OF01B1N0O.27.57.F02.1.454.CMB.1.raw
  modified_base (304)..(304): a, c, t, g, unknown or other
  misc_feature (304)..(304): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (381)..(381): a, c, t, g, unknown or other
  misc_feature (381)..(381): n is a, c, g, or t
  modified_base (516)..(516): a, c, t, g, unknown or other
  misc_feature (516)..(516): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctcgtggattcacctttagtagttattggatgagctgggtccnccagactcgaggggagggctgggagttcgnggaccaanataaaccaagataggaagtaaagaaactatgtgactcgngtgaagggccattcacatctccagagacaacgccaaagacgtcactgtatctgacaaatgaacagacctgagacgccgaggacacggctagtatactactgtgacgagagactacctagtcacttccgtctttgngtcg

SEQ ID NO: 45257 - DNA, 571 bp, Homo sapiens
  misc_feature: GYAE6OF01DCWAB.27.57.F02.1.454.CMB.1.raw
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (566)..(566): a, c, t, g, unknown or other
  misc_feature (566)..(566): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgttagctatttagaaggtgtcagtgtgaggtgcaactggtggattctggaggaggtgtggtccagcctggagaatccctgagactctcctgtgcagcctctggattctacctttagtagttatggatgagcgtgggtccgccaggacctccgaggggaaggggctgggagttcggtggaccaacaataaaaccaagatagggaaagtaaaagaaaactagtggtggaactcgtggtaggaaacgggcctagttccaacctatcctaccaagaacgaaccaaccgacctaaagaacgtacactgtactcgtagacaaagtagaacagcctaggagacgaccgagaacgacggctagtaactacgtactggtcgngagganactcgtagtctacttccgtcttttgnttcgg

SEQ ID NO: 45258 - DNA, 514 bp, Homo sapiens
  misc_feature: GYAE6OF01BGBL5.27.57.F02.1.454.CMB.1.raw
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (483)..(483): a, c, t, g, unknown or other
  misc_feature (483)..(483): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccagggaagggctggagttcgnggccaacataaaccaagataggaggtaaagaaaactatgtggactctgtggaagggccgattcaccatctccagagacaacgccaaagaagtcactgtatctgacaaatgaacagcctggagagccgaggacacggctgtatactatgtgngagagactcctagtcattccgctttgattcg

SEQ ID NO: 45259 - DNA, 531 bp, Homo sapiens
  misc_feature: GYAE6OF01B0VBC.27.57.F02.1.454.CMB.1.raw
  modified_base (303)..(303): a, c, t, g, unknown or other
  misc_feature (303)..(303): n is a, c, g, or t
  modified_base (526)..(526): a, c, t, g, unknown or other
  misc_feature (526)..(526): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgagggagggctggagttcgtggccaacataaaccaagatgggaagtaaagaaactagtgtaggactcgtgtagaagggccattcaccatctccagagacaacgccaaagacgtcactgtatctgacaaatcgaacagcctaggacgacgaccggaggacacggctagtaatactacgtggtgcgagacgatcctagtctacttccgtcttttgnttccg

SEQ ID NO: 45260 - DNA, 552 bp, Homo sapiens
  misc_feature: GYAE6OF01C7MCD.27.57.F02.1.454.CMB.1.raw
  modified_base (336)..(336): a, c, t, g, unknown or other
  misc_feature (336)..(336): n is a, c, g, or t
  modified_base (460)..(460): a, c, t, g, unknown or other
  misc_feature (460)..(460): n is a, c, g, or t
  modified_base (487)..(487): a, c, t, g, unknown or other
  misc_feature (487)..(487): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagactccgaggggaaggggctggagttcgnggccaacataaaccagatgggaagtaaaagaaaactatgtaggactcgtagtaggaaggccgattcacctatcctaccagacgacaacgccaaagacgtcactgtactctagacaaatgaaacngcctaggacgagaccgaaggacacggnttaggtaatacctagtggtcgagaagagacttcccgtagtcctatttcccggtntttgnttccgg

SEQ ID NO: 45261 - DNA, 507 bp, Homo sapiens
  misc_feature: GYAE6OF01BTXO5.27.57.F02.1.454.CMB.1.raw
  modified_base (480)..(480): a, c, t, g, unknown or other
  misc_feature (480)..(480): n is a, c, g, or t
  modified_base (503)..(503): a, c, t, g, unknown or other
  misc_feature (503)..(503): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccagggaagggctggagttcgtggccaacataaaccaagatggaggtaaagaaaactatgtggactctgtgaagggccgattcaccatctcagagacaacgccaagaagtcactgtatctgcaaatgaacagcctgagagccgaggacacggctgtatactatgtgcgagngatcctagtcattccgcttttgnttcg

SEQ ID NO: 45262 - DNA, 681 bp, Homo sapiens
  misc_feature: GYAE6OF01AG50X.27.57.F02.1.454.CMB.1.raw
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgtgctatttagaggtgtcagtgtgaggtgcaactggtggattcgtgggaggaggtgtggtccaggcctggagaactcccgtgagacctctcctgtcgcagccctctggtacttctacctttagtagtttatggatgagtcgtcggggtcccnccgaggtacctccggaaggggaacggggctagggagttcggtacggaccaaacgaactaaaccaaggagtagggaaggtaaaagaaacttagtggtaggactcgtggtaggaacgggcctatccacctatctaccgagacgaacgtaaccgaccaaagtaacgccaacttgtacgtcacgtaacaaagtacgaaaccgtacgacccgttaggaacggtaaccggacccggaagggaacccgtaacgggtacttaacggtacttaaccgtaacggttcggtacggaggtaacggtaacgtaacccgttcccgttaaaggttcccgttacggtttaccccgtttcggtttttacgaccgttttcccgggg

SEQ ID NO: 45263 - DNA, 546 bp, Homo sapiens
  misc_feature: GYAE6OF01CLJAS.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccgccagacctccgaggggaagggctgggagttcgtggcctaacataaaccaagatagggaaggtaaagaaaactatgtaggactctgtagaagggccgattcaccatctccagagacaacgcaagaagtcaactgtatctgacaaatgaacagacctagacgagaccgaggaccaggctgtactactacgtggtgcggaagacggtactccgtaagtctacttcccggttcttttgactttacccgg

SEQ ID NO: 45264 - DNA, 670 bp, Homo sapiens
  misc_feature: GYAE6OF01DG7D9.27.57.F02.1.454.CMB.1.raw
  modified_base (312)..(312): a, c, t, g, unknown or other
  misc_feature (312)..(312): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcttgggttttccttgttgcttattttagaaggtgtccagtgtgaggtgcaactggtggattcgtgggaggaggtgtggtccagcctaggagaatccctgacgactctcctgtgcacgtcctctggattctacctttagtagttattggatgagctggtccncagactccgaggggagggctggagttcgtggaccaaacgaataaaccgaagagtagggaaaggtaaaaagaaaactagtagtaggaacttcgtaggtaggaaacgggccgtattaccaacctactcctaccaaggacgaaaccaaaccggaccaaaagtaacgtaccaacgttaggttaactaccgttagaactaaaagttacgaaaaccgtcggaccctagggaacgtaacgggaccccgggaaacggtaaccgaccggggtaccttaacgggtaacttaaaccgtaccgttaggtacgacgaaggacgtacttaccgttacgtactaacgtttcccgttatttttacgattcccgg

SEQ ID NO: 45265 - DNA, 550 bp, Homo sapiens
  misc_feature: GYAE6OF01AFHQ1.27.57.F02.1.454.CMB.1.raw
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (501)..(501): a, c, t, g, unknown or other
  misc_feature (501)..(501): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctcgtggattcacctttagtagttatggatgagtcgtgggtccncagactcgaggggagggctggagttcgngaccaanataaaccagagtaggaagtaaagaaactgtgtagactgtggtagagggcctattaccgactatcctaccaaggacgaaccaacgccaaagtactcacttgtatctgaacaatcgaacacgcctaggagcgaccgaagaccacggtctagtactactagtgngacgagacgtacttcccgtaagtcctaacttcccgtcttttgacgttcg

SEQ ID NO: 45266 - DNA, 617 bp, Homo sapiens
  misc_feature: GYAE6OF01DDQX2.27.57.F02.1.454.CMB.1.raw
  modified_base (336)..(336): a, c, t, g, unknown or other
  misc_feature (336)..(336): n is a, c, g, or t
  modified_base (611)..(611): a, c, t, g, unknown or other
  misc_feature (611)..(611): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaggtgtccagtgtgaggtgcaactggtggattctggaggaggtgtggtccagcctggagaatccctgagactctcctgtgcagcctctggattctacctttagtagttattggatgagcgtgggtccgccagacctccgaggggaagggctgggagttcgnggaccaacataaaaccaagagtagggaaaggtaaaagaaaactagtggtaggactcgtaggtaggaaaggggtccgtaattccaacctaacttcctacccgaagaacgaacccaaaccggacccaaaaggacgtccaacgttggtaactccgttaggaactaaagtcgaaacgaacgcccttagggaacgacggaccggaaggaccgacgggtcttagtaactaccttacgtggtacgacgagacgtacttcctagtctacgttccgtactttgnttccgg

SEQ ID NO: 45267 - DNA, 564 bp, Homo sapiens
  misc_feature: GYAE6OF01BGBFF.27.57.F02.1.454.CMB.1.raw
  modified_base (483)..(483): a, c, t, g, unknown or other
  misc_feature (483)..(483): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagtttatggatgagctgggtccgccagactccgaggggaaggggctgggagttcggtggaccaaacataaaccgaagatagggaaggtaaaagaaaactagtagtggaactcgtgtaggaagggccgattccgaaccattcctccgaagacgaaccaaacggaccaaagaacgtccaacttgtactctagacaaatcgaaacngcctagacgagccgagacgacggctgtatactactggtacgcgagagatcccgtagtccagtttcccgtcttttgattccg

SEQ ID NO: 45268 - DNA, 632 bp, Homo sapiens
  misc_feature: GYAE6OF01DDH8B.27.57.F02.1.454.CMB.1.raw
  modified_base (182)..(182): a, c, t, g, unknown or other
  misc_feature (182)..(182): n is a, c, g, or t
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
  modified_base (338)..(338): a, c, t, g, unknown or other
  misc_feature (338)..(338): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcggtcgtttcgtcgtaggcgtacttagaggtncagtgtgagtgcatggtgattgnggaggaggtgtggtccagccgtggagaatccctagagctctcctgncagccttcagnttcacgtttagagttatggatggngcgtcggccacgagaccgtacggagggagggtcgtgtacgttcgcgaccaanaactaaacgaagagtaagggtaaagtaaagaaacttgtcgtaacgtacgtagtaggaggacggtaccacttaccgaactactccgtaccgacgaacgaaccgaaccgaacgaacgtaacgtacgtactacgtacgtacgtacgtaactaacgtaacgaacgacgtaccgtacgtacggaccggaccggacgaccggacggtacgtacgttacgtacgttacgttacggtcggtaggacggtacgtacgttacgtacgttacgttacgttaccgtttacgtttacgttcgtacgg

SEQ ID NO: 45269 - DNA, 577 bp, Homo sapiens
  misc_feature: GYAE6OF01B5IHO.27.57.F02.1.454.CMB.1.raw
  modified_base (549)..(549): a, c, t, g, unknown or other
  misc_feature (549)..(549): n is a, c, g, or t
tcagagcgtcgtctcacgaccggtgctcgatttagctcgatatagttgggtttggaggtctcagagaggagccgttagccctaggactccaaggcctttccacttggtgaatcagcacggagcgaccagaggaccccaccactcggaactggggctgagcttgggttttccttgttgctagttttagaaggtcgtccagtgtgaggtgcaactggtcggacttctggaggaggtggtcggtccgagcctgggacgaactccctgacgactctcctggtgcagcctctggattcgacctttagtagttattggatgagtcgtcgggtccgccaacgtacctccgaaggggaacgggctcgggacgtttccgtcggccaaacgataaaaccagatcgggaacgtaaagaaacgtatgtacggacttcgtgtggaacggccgattccacgatcctcagacgacaacgccaagacgtcactgtactcgtgacaaagtgaacgagcctagagtacgaccgaggacacggctgtatacctagtgtcgcgaggagntcctagtctattccgtctttggacttcg

SEQ ID NO: 45270 - DNA, 659 bp, Homo sapiens
  misc_feature: GYAE6OF01DSG8Q.27.57.F02.1.454.CMB.1.raw
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcggtggtttcgtcgtaggcgtattagaaggtgtcagtgtgaggtgcaactggtggacttcgtaggaggagtgtggtccagcctggacaatccctgagctctcctggtnacncgcctcgtgtacttacttacttagttagttagttgtagtgtagtcgtcggtccgtacgacgacgtacggagggtacgggtacggtggtacggtcgtcgacgaacgtaacgtaaacgaagtagtaggtaaggtaaagtaaagtaagtaggtagtacgtacgtaggtacggtacggtacgtacgtactactacgtactacgacgaacgaacgaacgaacgaacgtaacgtacgtacgtacgtacgtactacgtaacgtaacgtaacgacgaacgacgtacggaacgacggacgacggtaacgtacgtacgtacgtacgttacgtacgtacggtacggtaggtaacggtacgtacgtacgtacgttacgttacgttaccgtttacgtttcgttacgtaccgg

SEQ ID NO: 45271 - DNA, 701 bp, Homo sapiens
  misc_feature: GYAE6OF01C5SYQ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgtgctattttagaaggtgtccagtgtgaggtgcaacgtggtggattcgtgggaggaggtgtgggtccagcctggagaatcccgtgagactctcctgtgcagcctcgtggtattctaccttttagtagtttattggatggagtcgtcggtcccgccagaccgtccgaaggggaacgggctagggtacgttcggtcggaccaaactaactaaaccgaaggtagtagggaaagtaaaagaaaactagtaggtaggactcgtaggtaggaacgggccgtaattaccgacctacgttccgtaccgaaggaacgaaccgaaaccgaaccgaaaaggtaaacgtacctaacgttacgtaactactacggaaacctaaagttacgaaacgaccgtaccgtacggaaacgggacggaacccggaagggaacccgaccggtacttacggtaactaaccgttacgtggtacgacggaaggtacgtaaccgttacccgttaacggttacccttaacgtttcccggtttacgtttttggacgtttacccggg

SEQ ID NO: 45272 - DNA, 518 bp, Homo sapiens
  misc_feature: GYAE6OF01AGHPN.27.57.F02.1.454.CMB.1.raw
  modified_base (514)..(514): a, c, t, g, unknown or other
  misc_feature (514)..(514): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcaccttttagtagttattggatgagctgggtccgccagactccgaggggaaggggctgggagttcgtggccaacataaaccaagatgggagtaaagaaaactatgtggactctgtgaagggccgattcacatctccagagacaacgccaagaacgtcactgtatctgacaatgaacagcctgagacgcgaggacacggctgtatactactgtgacgagcgatcctagtctacttccgcttttgnttcg

SEQ ID NO: 45273 - DNA, 643 bp, Homo sapiens
  misc_feature: GYAE6OF01BZBEN.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaactggtggattctgggaggaggtgtggtccagcctggagaatccctgagactctcctgtgcagcctctggattctacctttagtagttatggatgagcgtgggtccnccagactccggaaggggaagggctgggacgttcggtaggaccaaacgaataaaaccaaggagtagggaaaggtaaaaagaaaactagtaggtaggaacttcgtaggtaggaaacgggtaccgtaagttccaacctagttcctacccgaaggaacaaacccgaaaccggacccaaaaggtaacgtccaacgttagttactacgtacgaactaaaagtcggaaacacggtacctagggaacgacggacccgggaaggaaccgacgggcttagtaacttactacgttgtaggacgaggaacacttaccgtagtcctaacgtttccgttacttttgacttccg

SEQ ID NO: 45274 - DNA, 540 bp, Homo sapiens
  misc_feature: GYAE6OF01AI7S2.27.57.F02.1.454.CMB.1.raw
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (376)..(376): a, c, t, g, unknown or other
  misc_feature (376)..(376): n is a, c, g, or t
  modified_base (450)..(450): a, c, t, g, unknown or other
  misc_feature (450)..(450): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccnccagactccgaggggagggctgggagttcggtggccaanataaaccaagataggaagtaaagaaaactatgnggactctgtagaagggccattcaccatctccagacgacaacgcaaagaagtcactgtactctgacaatcgaacngcctagagacgacgaggacacggctagtactacgtactggtcgacgaggagactccgttagtcctaacgttccgttcttttgacttccgg

SEQ ID NO: 45275 - DNA, 616 bp, Homo sapiens
  misc_feature: GYAE6OF01CNJN6.27.57.F02.1.454.CMB.1.raw
  modified_base (214)..(214): a, c, t, g, unknown or other
  misc_feature (214)..(214): n is a, c, g, or t
  modified_base (301)..(301): a, c, t, g, unknown or other
  misc_feature (301)..(301): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcgtggtttcctgtagctattttagaaggtgtccagtgtgaggtgcaactggtggattctggaggnggtgtggtccagcctggagaatccctgagactctcctgtgcagcctcgtggattcacctttagtagttattggatgagcgtggtccnccagactccgaggggaagggctgggtagttcgtcggaccaacataaaccgaagagtagggaaggtaaaagaaaactagtcggtagacttcgtaggtaggaacgggcctagttccgaacctattccaccgaagacgaaccaacgaccaaagacgtcaacgtgtaactcgtagacctaaaagtccggaacacgtaccgtaggaacgtcggaacccggaagcgtaaccggtcttaggtaacttaccgtacgtaggtacggagtaagacgtacttcccgttaagtcccttaacgttcccggttatttggacttcccggg

SEQ ID NO: 45276 - DNA, 663 bp, Homo sapiens
  misc_feature: GYAE6OF01A59E3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtcccgccagactccgaggggaaggggctgggagttcggtggaccaacaataaaccaagagtagggaaaggtaaaagaaaactagtagtaggacttcgtaggtaggaaacggggcccgtaatttaccgaaccctattcccgtacccgaaggaacgtaacccaaaccggacccgaaaaggaaacggttccaaccgttagttaactcgtagacctaaaatcggaaacgacgacccgttaggaacggtacggacccggaagggaaccgacgggtcttaggttaacttaccgttaacgtcggtaggaccggaaggaacgtacgttaccgtaacgttctacgtttcccggtctttttggaactttcccgg

SEQ ID NO: 45277 - DNA, 549 bp, Homo sapiens
  misc_feature: GYAE6OF01DG3A9.27.57.F02.1.454.CMB.1.raw
  modified_base (420)..(420): a, c, t, g, unknown or other
  misc_feature (420)..(420): n is a, c, g, or t
  modified_base (538)..(538): a, c, t, g, unknown or other
  misc_feature (538)..(538): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattccacctttagtagttattggatgagctgggtccgccagacctccaggggaagggctgggagttcggtggaccaacataaaaccaagagtagggaaggtaaaagaaaactatggtggactctgtagaagggccgattcaccatctccaganacaacgaccaaagacgtcactgtatctagacaaatgaacagacctaggagtacgaccgaggacgacggtctagtaatacgtatggtcgacgagaagtactctacgttcaacttccgtntttgtattccg

SEQ ID NO: 45278 - DNA, 532 bp, Homo sapiens
  misc_feature: GYAE6OF01BODK2.27.57.F02.1.454.CMB.1.raw
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaagggctggagttcgtggaccaacataaaccaagataggaaggtaaagaaaactatggtaggactcgtgtaggaagggcctattccaaccatcctccaagacgaacaacgccaaagacgtcactgtatctagacaaatgaacagctagagagccgagacacgctgtatactatgngacgagngactcctagtctacgttccgcttttgacttccg

SEQ ID NO: 45279 - DNA, 688 bp, Homo sapiens
  misc_feature: GYAE6OF01EA26P.27.57.F02.1.454.CMB.1.raw
  modified_base (589)..(589): a, c, t, g, unknown or other
  misc_feature (589)..(589): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaaggtgtcagtgtgaggtgcaactggtggattcgtggaggaggtgtggtccagcctggagaactccctgagactctcctgtgcagcctcgtggacttcctacctttagttagttattggatggagtcgtcggggtcccgcctacggaccgtccggaagggggaacggggtcttagggacgtttcggacggaacccaacaaactaaaaccaaggagtagggtaaaggtaaaaagaaaacttagtaggtacggtaacttcgtaggtaggaacgggacccgtattaccgaacctactccgtaccgaaggaaccggaaccaaaccggccaaaaggtaaccgttccacgtttagtactcgtacgaactaaagtacgaaaccgcgtacccgtaggaaacgtaccggaccggaacggtaaccncgggtacttaggttaactacggtaacttgggacgacggaagtacgtaccgttacctaggttcccttaacgtttccccgttattttgggacttcccgggg

SEQ ID NO: 45280 - DNA, 548 bp, Homo sapiens
  misc_feature: GYAE6OF01DJPXH.27.57.F02.1.454.CMB.1.raw
  modified_base (498)..(498): a, c, t, g, unknown or other
  misc_feature (498)..(498): n is a, c, g, or t
  modified_base (543)..(543): a, c, t, g, unknown or other
  misc_feature (543)..(543): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactgggtggattctgggaggagggtgtggtccagccctggagaatccctgagactctcctgtgcagcctctggattctacctttagtagttattggatgagctgggtccgcagactccgaggggaggggctgggagttcggtcggccaacataaaccaagaatagggaaggtaaaagaaaactatagtggactcgtgtaggaagggccgattcacctatctccagagaacaacgaccaaagacgtcactagtatctagacaaatgaacagcctagagacgccggaggaccacggctagtanacttactggtgacgagagtactccgtagtctattccgtcttttgnttccg

SEQ ID NO: 45281 - DNA, 609 bp, Homo sapiens
  misc_feature: GYAE6OF01BTD1R.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggtttctgtgctatttagaggtgtcagtgtgaggtgcaactggtggattctggaggaggtgtggtccagcctggagaatcccctgagactctcctgtgcagcctctggattctacctttagtagttattggatgagctgggtccgccagactccgaggggaaggggctgggagttcgtggaccaagactaaaaccaagatagggaaggtaaaagaaaactatggtaggaacttcgtgtaggaagggccgtaattccaaccatcctaccgagacgaacaacgccaaagaacgtacacttcgtaatcctagaacctaaatagaacacgacctaggaagacggacccggaggaaccgtacgggccttaggtaacttaaccgtaccgttagtcggtacggaggagaacgttcccgttaacggttcttaacggtttcccgtccgttttttaggcttacccgg

SEQ ID NO: 45282 - DNA, 518 bp, Homo sapiens
  misc_feature: GYAE6OF01A4ZAX.27.57.F02.1.454.CMB.1.raw
  modified_base (304)..(304): a, c, t, g, unknown or other
  misc_feature (304)..(304): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (432)..(432): a, c, t, g, unknown or other
  misc_feature (432)..(432): n is a, c, g, or t
  modified_base (486)..(486): a, c, t, g, unknown or other
  misc_feature (486)..(486): n is a, c, g, or t
  modified_base (513)..(513): a, c, t, g, unknown or other
  misc_feature (513)..(513): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatcccctgagactctcctgtgcagcctctggattcacctttagtagttattggatgagctgggtccnccagactccgaggggagggctggagttcgnggccaanataaaccaagatgggaaggtaaaagaaactatgtaggactctggtgaagggccattcacatctcagagacaacgcaaagatcactgtatcngacaatgaacagcctgagcgaccgagacacggctgtatactacgtgtgacgagngactcctagtcctattccgtcttttgnttccg

SEQ ID NO: 45283 - DNA, 548 bp, Homo sapiens
  misc_feature: GYAE6OF01D4RDY.27.57.F02.1.454.CMB.1.raw
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
tcagagcgtcgtctcacgaccggtgctcgatttagctcgatatagttgggtttgagttctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttatggatgagctgggtccgcagacctccgaggggagggctggagttcgnggccaanataaaccaagataggaagtaaagaaactagtgtaggactcgtagtggaagggcccgtattcacctatcctaccagacgaacgaacgaccaaagaacgtcacttgtactctagacaaatgaacgagcctaggagacggaccggaggacacggctagtactactacgtggtgacgagagactctagtcctacgttcctcttttgattccgg

SEQ ID NO: 45284 - DNA, 559 bp, Homo sapiens
  misc_feature: GYAE6OF01DH5X2.27.57.F02.1.454.CMB.1.raw
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (469)..(469): a, c, t, g, unknown or other
  misc_feature (469)..(469): n is a, c, g, or t
  modified_base (551)..(551): a, c, t, g, unknown or other
  misc_feature (551)..(551): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgagactctcctgtgcagcctctggattctacctttagtagttattggatgagctgggtccncagactccgaggggaagggctgggagttcgnggaccaacataaaccaagatagggaagtaaaagaaaactagtaggtggactcgtgtaggaacgggccgtattccaccatcctaccagaagacaagtcgaccaaagaacgtcaacttgtatctgacaaatgaaacngacctagagacgaccgaggaccacggcttagtactacgttacgtgtggcgaagagtacttaccgttagtctactttcccgtnttttgacg

SEQ ID NO: 45285 - DNA, 583 bp, Homo sapiens
  misc_feature: GYAE6OF01BHEKG.27.57.F02.1.454.CMB.1.raw
  modified_base (347)..(347): a, c, t, g, unknown or other
  misc_feature (347)..(347): n is a, c, g, or t
  modified_base (424)..(424): a, c, t, g, unknown or other
  misc_feature (424)..(424): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccaggcctggagaatccctgagactctcctgtgcagcctctggattcaccttttagtagttattggatgagctgggtcccgccagactccgaaggggaagggctggagttcgtggaccaanaataaaccaagatagggaagtaaaagaaaactagtgtaggacttctgtaggaacgggctattcacctatctacaganacaacgaccaaagagtacacgtatatactgacaaatacgaacacgactacgagaacgaccggaggaccgacggactaggtaactacgttaacgtggtacggacgaggacgacttaccgtacgttacctaacgtttcccgttacgtttttgatttcccgg

SEQ ID NO: 45286 - DNA, 609 bp, Homo sapiens
  misc_feature: GYAE6OF01BC2XC.27.57.F02.1.454.CMB.1.raw
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaaggtgtccagtgtgaggtgcaactggtggattctggaggaggtgtggtccagcctggagaatccctgagactctcctgtgcagcctntggattcacctttagtagttattggatgagcgtgggtccnccagactccgaggggagggctgggagttcgtggaccaanataaaccagagtaggaagtaaaagaaactgtgtaggactcgtgtaggaagggccattccaaccatcctaccgagacgacaacggccaaagtaactcaactgtactccgtagactaaatacgaacacggacctagggaacgacgggaccggtaaggacccgacgggtaccttaggtacttaaccgtaaccgttggacggacggaaggtacgtaacgttccccgttaaaggtccttaacgtttcccgttcgtttttaggaccgtttccggg

SEQ ID NO: 45287 - DNA, 555 bp, Homo sapiens
  misc_feature: GYAE6OF01DU0Z8.27.57.F02.1.454.CMB.1.raw
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
  modified_base (478)..(478): a, c, t, g, unknown or other
  misc_feature (478)..(478): n is a, c, g, or t
  modified_base (527)..(527): a, c, t, g, unknown or other
  misc_feature (527)..(527): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgaggggaagggctggagttcgtggccaaanataaaaccaagatagggaaggtaaaagaaaactagtagtggaactcgtggtaggaaagggccgaagtttccacctatcctccaagacgaacaaacgaccaaagaacgtacaaccttgtaatctagacaaatgaacngacctagacgagccggaggaccacggctagtatacctactgtcgagagngatcctagtcattccgtcttttgcttcg

SEQ ID NO: 45288 - DNA, 523 bp, Homo sapiens
  misc_feature: GYAE6OF01EFLCO.27.57.F02.1.454.CMB.1.raw
  modified_base (497)..(497): a, c, t, g, unknown or other
  misc_feature (497)..(497): n is a, c, g, or t
  modified_base (519)..(519): a, c, t, g, unknown or other
  misc_feature (519)..(519): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccgcagactccgagggagggctggagttcgtggccaacataaaccaagataggaaggtaaagaaaactatagtggactcgtgtagaacgggcctattcaccatcctaccagagacaacgccaagaagtacactagtatctagacaaatgaacagacctagagagccgaggacacggctgtatactactgtgcgagngatctagtcattccgtctttgnttcg

SEQ ID NO: 45289 - DNA, 549 bp, Homo sapiens
  misc_feature: GYAE6OF01BMTAF.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatcccctgagactctcctgtgcagcctctggattcacctttagtagttattggatgagctggggtccgccagactccgaggggaagggctggagttcgtggccaacataaaccaagataggaaggtaaaagaaaactagtggtagactcgtgtggaagggccattccaccatctccagagacaacgaccaagaacgtcactgtactctagactaaatgaacagcctaggacgacggaccgaggaccgacggactagtactacgtacgtggtcgagaggagactcctagtctacttccgtcttttgcttccgg

SEQ ID NO: 45290 - DNA, 648 bp, Homo sapiens
  misc_feature: GYAE6OF01BIRMA.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtgggtccagccgtggagaatccctgagactctcctgtgcagcctctggtattctacctttagtagttattggatgacgtcgtcgggtccgccagacctaccgaggggaacgggctagggtacgttcggtggacccaaacaactaaaaccgaagagtagggaaaggtaaaagaaaacgttagtaggtaggtactcgtaggtaggaacgggccgtattccaacctaatccctaccgaaggaacgaaccaaaccggaccaaaaggaacgtccaacttgtaactcgtagaacctaaatcgaaacacgacctaggaagacggaccggaacggaccacggtcgttacgtaacttaccgtaacgttggtcggacggtaaggaagtacttcccgttaagtccttacgtttcccgttctttttaggactttcccgg

SEQ ID NO: 45291 - DNA, 669 bp, Homo sapiens
  misc_feature: GYAE6OF01D7NAS.27.57.F02.1.454.CMB.1.raw
  modified_base (528)..(528): a, c, t, g, unknown or other
  misc_feature (528)..(528): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtgggaggaggtgtggtccagcctggagaatccctgagactctcctgtgcagcctctggattctacctttagtagttattggatggagcgtgggtccgcagactccgaggggaagggctgggacgttcggtcggaccaacaactaaaccgaaagacgtagggaaaggtaaaaagaaaactagtaggtacggaacttcgtgttacggaacggggtccgtaagttaccgaaccattcccgtaccaaggtaacgaacctaaaccggacccgaaaaggaaccgtactaacgtcgttaactcgtagaacctaaagtcgaaacncggtacctaggaacgtaacggaccggaaggaacccgacgggtcttacgtaactaccttaacgtgggtcgacggaaggttacgaacgtttcccgtaaggttaccttactttaccccggtttcttttacggactttacccggg

SEQ ID NO: 45292 - DNA, 526 bp, Homo sapiens
  misc_feature: GYAE6OF01CBYN4.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaaatcccctgagactctcctgtgcagcctctggattcacctttagtagttattggatgagctgggtccgccagactccgagggaaggggctgggagttcgtggccaacataaaccaagataggaaggtaaaagaaaactatgtaggactctgtgaagggccattcacatctccagagacaacgaccaaagaagtcactgtatctgacaaatgaacagcctgagagccgagacgagctagtatactatgtgagagagactcctagtcctaattcccgtacttttggcttcg

SEQ ID NO: 45293 - DNA, 614 bp, Homo sapiens
  misc_feature: GYAE6OF01EIMOM.27.57.F02.1.454.CMB.1.raw
  modified_base (323)..(323): a, c, t, g, unknown or other
  misc_feature (323)..(323): n is a, c, g, or t
  modified_base (575)..(575): a, c, t, g, unknown or other
  misc_feature (575)..(575): n is a, c, g, or t
  modified_base (604)..(604): a, c, t, g, unknown or other
  misc_feature (604)..(604): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaactggtggattcgtgggaggaggtgtggtccagcctggagaactccctgagactctcctgtgcacgcctcgtggtatttcctaccgttttagtagtttagttggatggagtcgtcggggtcccnccgagaccgtccgaaggggaggggctgggagttcggtacggaccaaacaactaaaccgaagagtagggaaaggtaaaagaaaactgtaggtacggacttcgtaggtaggaacgggcctagttaccaactataccctaccgaagacgaacgaaccgaccaaagaacgtcacttgtacttacgtacgaactaaatacgaacacgaccgtaggacgaacggccgaaggaccgacggtctagtactactacgtggngagagatacttctacgtctacttccgttntttgcgtccg

SEQ ID NO: 45294 - DNA, 778 bp, Homo sapiens
  misc_feature: GYAE6OF01DK20Z.27.57.F02.1.454.CMB.1.raw
  modified_base (320)..(320): a, c, t, g, unknown or other
  misc_feature (320)..(320): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgtgctatttagagtgtccagtgtgaggtgcaacgtgggtggattcgtgggaggaggtgtgggtccagccgtgggagaactccctaggagaccttctcctggtgcagtcctcgtggtacttctaaccgtttagtagttatggatggacgcgtcgggtccncgagactccggaaggggacgggcgtagggtacgttcggtacggaccaaacaactaaaccgaaggagtaagggaaaggtaaaagaaaactgtaggtacggaacttacgtaggtacggaacgggtaccgtacttaccacctacgtacctaccgaaggtacggaaacccaaaccggaaccgtaaaaggtaacgtacctaacggttacgttaacttaccgtacggtaaacctaaagttaccggaaaaccgtccgtaacccggttaagggaaaccgggtaccgggaacccgggaaagggaacccggtacgggttaaccgtttaacggtaacctttaaaccgttaaccggttagggtaaccggtaaccgggaaggtaaccgggttaccttaaccccggtttaacggtaaccctttaacggttttcccccggtttaacttttttacggcccggttttaacccggg

SEQ ID NO: 45295 - DNA, 721 bp, Homo sapiens
  misc_feature: GYAE6OF01C2JWY.27.57.F02.1.454.CMB.1.raw
  modified_base (595)..(595): a, c, t, g, unknown or other
  misc_feature (595)..(595): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactgggctgagtcgttgggttttccttgttgcttatttagaaggtgtcagtgtgaggtgcaacgtggtggtattcgtgggaggaggtgtggtccagccgtggagaactccctagacgactctctgtcgcacgcctgtggtacttctactttagtagttagttggatggacgtcgtcgggtcccaccgagtaccgtaccgggaaggggaacgggtcgtagggtacggttccgggtacggaaccaaaacgaaactaaaaccggaaaggtaaggtaaggggaaaaggtaaaaagtaaaacgttagtagggtacggtaaccttacgtagggtaacggaaacgggtaccctaacgtttacccgaaccctagttcccgtaaccgaagaaccgaaacccgaaaccgaaccgaaaaggtacgtaccaacgtttagtactacgtagaactaaaggtaccgaaacncgtaccgtagggaacgaccgaccggaaggtaaccgacggtcttaaggtactaacccgttagtaggtacgagaacgtacgtaccttcccggtagttacctacgtttcccgtagttttgacttccggg

SEQ ID NO: 45296 - DNA, 553 bp, Homo sapiens
  misc_feature: GYAE6OF01D12S7.27.57.F02.1.454.CMB.1.raw
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (450)..(450): a, c, t, g, unknown or other
  misc_feature (450)..(450): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgagactctcctgtgcagcctcgtggattccacctttagtagttattggatgagcgtggggtccnccagactccgaggggaaggggctgggagttcgtggaccaanataaaccaagataggaagtaaagaaactntggtgactctgtgaaggccattcactatctaccagacgacaacgaccaagactcatgtatatgacaaatgaacngcctagagacgccggaagacgacggtctggtaactactacgttggtacgacggagtacgacttcccgtaagtctaacgtttccggtacttttcggattcccgg

SEQ ID NO: 45297 - DNA, 527 bp, Homo sapiens
  misc_feature: GYAE6OF01BJ94Z.27.57.F02.1.454.CMB.1.raw
  modified_base (450)..(450): a, c, t, g, unknown or other
  misc_feature (450)..(450): n is a, c, g, or t
  modified_base (523)..(523): a, c, t, g, unknown or other
  misc_feature (523)..(523): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccgccagactccgaggggaaggggctggagttcgtggccaacataaaccaagagtgggaagtaaagaaaactatgtggactcgtgtgaagggccgattcacatctccagagacaacgccaagaagtcactgtatctagacaaatgaacngcctagagtagaccggaggacgacggctgtatactactgtcgagaggagactcctagtcacttccgcttttgnttcg

SEQ ID NO: 45298 - DNA, 615 bp, Homo sapiens
  misc_feature: GYAE6OF01BIKKC.27.57.F02.1.454.CMB.1.raw
  modified_base (494)..(494): a, c, t, g, unknown or other
  misc_feature (494)..(494): n is a, c, g, or t
  modified_base (507)..(507): a, c, t, g, unknown or other
  misc_feature (507)..(507): n is a, c, g, or t
  modified_base (607)..(607): a, c, t, g, unknown or other
  misc_feature (607)..(607): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattctacctttagtagttattggatgagtcgtcggggtccgccgagacctccggaagggggaagggggctagggtacggtttcggtcggaccaaacaactaaaaccgaagaagtagggaaaggtaaaagaaaactagtgtaggtactacgtggtaggaacgggaccgtattccaacctatcctacccgagaacgaaccaacgaccaaagaacgtcaacgtgtactcngacaaatcgaacncgcctaggacgacggccggaaggaccgacggctagttaactactaccgtggtacgacgagacgtactcccgtaagttctaacgtttcccgttcgttttgnttcccggg

SEQ ID NO: 45299 - DNA, 557 bp, Homo sapiens
  misc_feature: GYAE6OF01BWS92.27.57.F02.1.454.CMB.1.raw
  modified_base (303)..(303): a, c, t, g, unknown or other
  misc_feature (303)..(303): n is a, c, g, or t
  modified_base (451)..(451): a, c, t, g, unknown or other
  misc_feature (451)..(451): n is a, c, g, or t
  modified_base (543)..(543): a, c, t, g, unknown or other
  misc_feature (543)..(543): n is a, c, g, or t
  modified_base (552)..(552): a, c, t, g, unknown or other
  misc_feature (552)..(552): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactcgagggaagggctggagttcgtggaccaacataaaccaagatagggaaggtaaaagaaaactagtgtaggactcgtgtagaaggccgattcaccatctacagacgacaacgcaaagaactcatgtatcagacaaatgaacngacctaggaacgagccgaacggacacgggtctaggtaactactacgttgtaggacgaaggtagacgttccctaaggtcctagtttacccgtnttttacggnttccg

SEQ ID NO: 45300 - DNA, 553 bp, Homo sapiens
  misc_feature: GYAE6OF01DIP63.27.57.F02.1.454.CMB.1.raw
  modified_base (336)..(336): a, c, t, g, unknown or other
  misc_feature (336)..(336): n is a, c, g, or t
  modified_base (496)..(496): a, c, t, g, unknown or other
  misc_feature (496)..(496): n is a, c, g, or t
  modified_base (519)..(519): a, c, t, g, unknown or other
  misc_feature (519)..(519): n is a, c, g, or t
  modified_base (541)..(541): a, c, t, g, unknown or other
  misc_feature (541)..(541): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattctacctttagtagttattggatggagcgtgggtccgccagactccgaggggagggctggagttcgnggaccaacataaaccaagatagggaaggtaaaagaaaactatggtacggactctggtaggaacgggccgtaattccacctatctaccagagacaacgaccaaagaactcactgtactctagacaaatgaacagcctagacgacgccggaaggacgacggntagtatacctatggtacgagagngactcctagtcctattcccgtnttttgattccgg

SEQ ID NO: 45301 - DNA, 658 bp, Homo sapiens
  misc_feature: GYAE6OF01AG9J2.27.57.F02.1.454.CMB.1.raw
  modified_base (309)..(309): a, c, t, g, unknown or other
  misc_feature (309)..(309): n is a, c, g, or t
  modified_base (515)..(515): a, c, t, g, unknown or other
  misc_feature (515)..(515): n is a, c, g, or t
  modified_base (639)..(639): a, c, t, g, unknown or other
  misc_feature (639)..(639): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcacgcctctggattctaccttttagtagttattggatgagcgtcgggtcccnccagaccgtccggagggggaacggggtctgggtagttcgggtacggaccaaacaactaaaccgaagacgtagggaaaggtaaaagaaaactagtaggtacggtactcgtaggtaggaacgggcctagttaccacctatcctacgaggacgaaccaaacggacctaaagaacgtccaacgttgtactccgtgaactaaatcgaaacncgacccgtaggaaccgacggaccggaacggacgaccggtacttacgtaacttaaccgtacgtggtacggaccggtaaggtaacggtactttacccggtacgttccttaaccgtttcccggtttntttttcgacgtttccccgg

SEQ ID NO: 45302 - DNA, 544 bp, Homo sapiens
  misc_feature: GYAE6OF01EYAWH.27.57.F02.1.454.CMB.1.raw
  modified_base (404)..(404): a, c, t, g, unknown or other
  misc_feature (404)..(404): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggagggctggagttcgtggccaacataaaccaagatgggaaggtaaagaaaactatgtaggactcgtgtgaagggccgattcaccatcnccagagacaacgaccaagacgtacactgtatctagacaaatcgaacacgacctagagacgaccggaaggaccgacggtcgtagtaactactactggtgacgagagactaccgtagttcacgttaccgtcttttgcttccg

SEQ ID NO: 45303 - DNA, 594 bp, Homo sapiens
  misc_feature: GYAE6OF01BKFTE.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgaggggagggctggagttcgtggcaacataaaccaagatggaaggtaaagaaaactagtggtaggactcgtaggtaggaacggggccgtattccaaccattcctacctagaacgaaccaaacgccaaagaacgtcactgtatctagacaatagaacacgacctaggacgacggccgaacggaccgacgggtcttacggtattaaccgtacgtggtccggaccgaaggacgtacttcccgttaaacggttcctaacgtttcccgttctttttgacgtttcccgg

SEQ ID NO: 45304 - DNA, 548 bp, Homo sapiens
  misc_feature: GYAE6OF01BAHWW.27.57.F02.1.454.CMB.1.raw
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (543)..(543): a, c, t, g, unknown or other
  misc_feature (543)..(543): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccncagactccgagggagggctggagttcgnggccaacaataaaccaagataggaaggtaaagaaaactagtagtggaactcgtagtaggaagggtccgattccaacctatcctaccagacgaccaacgaccaaagaacgtcactgtatctgacaatagaacagacctggaagacgaccggaagaccgacggcgtgtatacttacgtgtcgacgagagactctagtctacttccgtcttttgngttcg

SEQ ID NO: 45305 - DNA, 558 bp, Homo sapiens
  misc_feature: GYAE6OF01D0HHW.27.57.F02.1.454.CMB.1.raw
  modified_base (342)..(342): a, c, t, g, unknown or other
  misc_feature (342)..(342): n is a, c, g, or t
  modified_base (479)..(479): a, c, t, g, unknown or other
  misc_feature (479)..(479): n is a, c, g, or t
  modified_base (526)..(526): a, c, t, g, unknown or other
  misc_feature (526)..(526): n is a, c, g, or t
  modified_base (547)..(547): a, c, t, g, unknown or other
  misc_feature (547)..(547): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtgggtccagcctggagaatccctgagactctcctgtgcagcctctggattcacctttagtagttattggatgagctgggtccgcagactccgaggggaagggctgggagttcgtggccaanataaaccaagatagggaaaggtaaaagaaaactataggtaggactctggtaggaaagggcccgaattccaacctatcctccgaagacgaacaaacgacccaaaggaacgtccaacttgtatctagacaaatcgaacngacctagagagccggagacacggctagtatactactggtcgacgagngactctagtcctattcccgtnttttgattccg

SEQ ID NO: 45306 - DNA, 542 bp, Homo sapiens
  misc_feature: GYAE6OF01ENUAJ.27.57.F02.1.454.CMB.1.raw
  modified_base (334)..(334): a, c, t, g, unknown or other
  misc_feature (334)..(334): n is a, c, g, or t
  modified_base (537)..(537): a, c, t, g, unknown or other
  misc_feature (537)..(537): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaggtgtccagtgtgaggtgcaactggtggattctgggaggaggtgtggtccagcctggagaatccctgagactctcctgtgcagcctctggattcacctttagtagttattggatgagctggggtccgccagactccgagggaaggggctggagttcgnggccaaacataaaccaagatgggaaggtaaaagaaaactatgtaggactcgtgtggaagggccgattccaaccatcctaccagagaacaacgaccaaagaagtcactagtatctgacaaatgaacagcctagagagccgaggacgacggtctagtactacgtacttgtgacgagacgatacctagtctacttccgtcttttgnttccg

SEQ ID NO: 45307 - DNA, 587 bp, Homo sapiens
  misc_feature: GYAE6OF01BI436.27.57.F02.1.454.CMB.1.raw
  modified_base (310)..(310): a, c, t, g, unknown or other
  misc_feature (310)..(310): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcggtggtttcgtgtaggctatttagaaggtgtcagtgtgaggtgcaacgtggtggattctgggaggaggtgtgggtccaggcctgggagaactccctgagctctcctgtcgcagcctctggattcctacctttagtagttattggatgagcgtgggtccncagactccgaggggagggctgggtagttcggtggaccaacaataaaccgaagagtaggaaaggtaaaagaaaactgtaggtacggacttctggtagaacgggcctaatcgaccatcctacagagaccaacgccaaagacgtcactgtatctcgactaatagaacacgcctaggagacggccgtaaggaccacggtctaggtactaactacgtggtacggacgaaggactaccgttacctaggttccctagtttccccggtattttggacttcccggg

SEQ ID NO: 45308 - DNA, 536 bp, Homo sapiens
  misc_feature: GYAE6OF01DKQNR.27.57.F02.1.454.CMB.1.raw
  modified_base (302)..(302): a, c, t, g, unknown or other
  misc_feature (302)..(302): n is a, c, g, or t
  modified_base (505)..(505): a, c, t, g, unknown or other
  misc_feature (505)..(505): n is a, c, g, or t
  modified_base (531)..(531): a, c, t, g, unknown or other
  misc_feature (531)..(531): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggagaggtgtggtccagcctggagaatccctgagactctcctgtgcagcctctggattcacctttagtagttattggatgagctgggtccnccagactccgaggggagggctgggagttcgtggccaacataaaaccaagataggaaggtaaaagaaaactagtagtaggactctggtgaagggccgattccaccatctccagacgacaacgccaaagacgtcactgtatctagcaaatgaacagctagagacgccggaggacgacggtctagtataccgtactggtcgcgagngactcctagtctattccgtcttttgngttcg

SEQ ID NO: 45309 - DNA, 936 bp, Homo sapiens
  misc_feature: GYAE6OF01CE4HD.27.57.F02.1.454.CMB.1.raw
  modified_base (121)..(121): a, c, t, g, unknown or other
  misc_feature (121)..(121): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
tcagagcgtcgtctcacgaccggtgctcgatttagctcgatatagttggggtttgaggtcgtcagaggaggagccttagccctggactccaagcctttccacttggtgatccagcacgganccacagacggtcccacggactggacctgggctaggacgtccttcggtttacgtgtagcttagtttagaaggtcggtcctaggtgtaggaggtacacgtaacgtggtagacgttcgnggagtgngtcgtcagcgtagactaactccgtagacaactctccttgtgttcacgcgtctaggacttcgtaacgtttcgtaacgttacgttggatggaagcgttcggggccaacgcggtaacccgtccgggtaaggggaaccggtccgtagggtacggtttccggtaccggaacaaaacggtaactttaaaacccgtaggaacgtacggggtaaaaaccgtaaaaggtaaaaaccttttccggtaaagggaaggtaacccgtttggtaacgggtttaccgggaaaaacccggggtccgttaacgttttaaacccaaaccggttggtaccccggtaacccgaaggggtaaaccggggaaaccctaaaccgggaacgaaaaaccggggtaaactttcccctaaaagggtttttacgtttaacccggtaacgtaaaccggaaccgttaaaaacgtaccggaaaacggtttaccgggtaaaccgggttacggaaaaccgggtaaccggggtaaccggggttaaccggggtaacccggaacgggggtaacgtttaaacgggttaaccgttaaaccggtttccgggtacggtttaaccgggaaccggtaaccgggttaaacccgacccggttaaccggttaccgtttaaaccccgggttccgttttaacccggtttacgtttcccggtttaacccgtttccccggg

SEQ ID NO: 45310 - DNA, 533 bp, Homo sapiens
  misc_feature: GYAE6OF01BNO22.27.57.F02.1.454.CMB.1.raw
  modified_base (304)..(304): a, c, t, g, unknown or other
  misc_feature (304)..(304): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (435)..(435): a, c, t, g, unknown or other
  misc_feature (435)..(435): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcaacctttagtagttattggatgagcgtgggtccnccagacctccgagggagggctggagttcgnggccaanataaaccagatggaaggtaaagaaactatgtgactgtgtgaaggcattcacntcncaganacacgacaagatcactgtatctgacaaatgaacngaccgtagagacgccggaggacgacggtcgtagtatacctacgtgtggacgagtacgacttcccgaagttcctacgtttcccgtnttttcgnttccgg

SEQ ID NO: 45311 - DNA, 778 bp, Homo sapiens
  misc_feature: GYAE6OF01B5P1F.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgttgggttttccttgttgcttattttagaaggtgtccagtgtgaggtgcaacgtggtggattcgtgggaggaggtgtggtccagccgtgggagaactccctgacgactcctccgtgtgcagcctcgtggtacttactaccgtttagtagttattggattggacgtcgtcgggtcccgaccaggtaccctccggaaggggggaacgggcttaggggtagtttccggtacggacctaaaacaaacgttaaaaccgaaaggtagtaacggggtaaagggtaaaaacgtaaaacttagttagggtaggtaaccttacgttagggtaagggaaacgggacccgttattacccgaacctattacccgtaccgaaaggaaccgaacccgaaaaccggaccctaaaggtaaacgttaccaacgttggttaactaccgaacgtaactaaacgtaacgaaacgaccggacccgttaaggaaaccggaccggtaaccgggaacgggaaccgtaccgggtaacctttacgggtaaccttaaaaccgttccggttaaggtccggaaagggtacacgggttaacccttccggttaacgtaccttttaccgttacccggttttcttttagtacccgttcccggg

SEQ ID NO: 45312 - DNA, 609 bp, Homo sapiens
  misc_feature: GYAE6OF01CQR5F.27.57.F02.1.454.CMB.1.raw
  modified_base (181)..(181): a, c, t, g, unknown or other
  misc_feature (181)..(181): n is a, c, g, or t
  modified_base (309)..(309): a, c, t, g, unknown or other
  misc_feature (309)..(309): n is a, c, g, or t
  modified_base (487)..(487): a, c, t, g, unknown or other
  misc_feature (487)..(487): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtntccagtgtgaggtgcaactggtggattcgtgggaggaggtgtggtccagcctggagaatccctgagactctcctgtcgcacgcctcgtggtattctacctttagtagttatggatgagcgtgggtccncagactcgagggagggctggagtcgtgaccaacaataaaccaagatagggaaaggtaaaagaaaactagtggtaggactcgtggtaggaacgggccgtattccaacctatcctaccgaagaacgaacgaaacgaccaaagaacgtcaacgttgtaatctagaacctaaatacgaaacncgacctaggaacgacgaccggaaggaaccgacgggtactaggtaactaccgttacgtaggtcgacggaagtacgtacttacccgtaattccgtactttcccggttcttttgactttcccggg

SEQ ID NO: 45313 - DNA, 537 bp, Homo sapiens
  misc_feature: GYAE6OF01B2XZ6.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaaggggctggagttcgtggccaacataaaccaagatggaaggtaaagaaaactatgtagactctagtgaagggccgattcacctatcctccagagaacaacgccaaagaagtcactgtatctgacaaatgaacagacctaggaacgacgccgaaggacacggctagtatacctatgtgacgagagactacctagtcctattcccgtcttttgacgttcg

SEQ ID NO: 45314 - DNA, 609 bp, Homo sapiens
  misc_feature: GYAE6OF01AU8F9.27.57.F02.1.454.CMB.1.raw
  modified_base (304)..(304): a, c, t, g, unknown or other
  misc_feature (304)..(304): n is a, c, g, or t
  modified_base (455)..(455): a, c, t, g, unknown or other
  misc_feature (455)..(455): n is a, c, g, or t
tcagagcgtcgtctcacgaccggtgctcgatttagctcgatataggttgggtttgaggtctcagaagaggagccttagccctggactccaaggcctttccacttggtgactcagcacggagcacagaggacccaccatggaactgggctgagctgggttttccttgttgctattttagaagtgtccagtgtgaggtgcaactggtggattctggaggaggtgtggtccagcctggagaatccctgagactctcctgtgcagcctctggattcacctttagtagttattggatgagctgggtccnccagactccaggggaagggctgggagttcgtggaccaacataaaccaagatgggaggtaaaagaaaactatgtggaactctgtgaagggccgattcaccatcctccagagacaacgccaaagagtcactgtatcgtgacaaagtcgaaacncgaccctggaacggacggccccgaaggggaccaaccgggggtcttacggtaaacgttaacccttaaccgtggttacggacccggaaggtaacgtaacgtcccccttaagggttacctaacgttttccccggttctttttttgaagtttccccgg

SEQ ID NO: 45315 - DNA, 572 bp, Homo sapiens
  misc_feature: GYAE6OF01ERLJE.27.57.F02.1.454.CMB.1.raw
  modified_base (566)..(566): a, c, t, g, unknown or other
  misc_feature (566)..(566): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagtcgtgggtccgcagactccgagggagggctggagttcgtggccaacataaaccaagatagggaaggtaaaagaaactatagtaggactcgtgtaggaacgggccgtattcaccatcctaccagaacgaaccaacgaccaaagaacgtcactagtactctagactaaatgaacgagaccgtagacgtacgccggaacggacgaccggctagtaacttacctaacgtggtacgacggagacgtactacgtacgtctacttcccgttcttttcgnttccgg

SEQ ID NO: 45316 - DNA, 799 bp, Homo sapiens
  misc_feature: GYAE6OF01DZSSA.27.57.F02.1.454.CMB.1.raw
  modified_base (787)..(787): a, c, t, g, unknown or other
  misc_feature (787)..(787): n is a, c, g, or t
  modified_base (791)..(791): a, c, t, g, unknown or other
  misc_feature (791)..(791): n is a, c, g, or t
tcagagcgtcgtctcacgaccggtgctcgatttagctcgatatagttgggtttgaggtctcagagagggacgtccttacgcccgtggacctaccgaacggtccctttccacgttggtgatcagcgacggagcacagacggacccacagtaggaacgtgggctgagtcgttcgggtttttccttggttgtctttaagtttttaaggaagggttcgtaccagttgtggaggtgacaacgtgggtggtattcgtgggaggtaggtggtcggtccagtccgtaggaagtaacctccccgtggaacgtaccttccttccgtggtcgacgacgtcccttcggtaggtactttacccttaaccgttttaggttaagtttagttggattggacgtcggttcgggtcccgaccgtacggtaccgtaccggaagggggtacgggtccgtagggtacgtttcggacggaacccaaagtaaacgtaaaaccgaaggtacggtaaggggtaaaaggtaaaaacgtaaaacgttaggttagggtacggtaacttcggtaggtaacggggaaccgggtaccgttaatttacccgaaccttacgttcccgtaaccgaaggaaaccgaaacccgaaccggaaccgaaaaggtaccgtacctagttagtaaccttcgtacgaaactaaacgtacgaaccgacgtccgtaaggaacggtaccggaccggaacggaccgtacggtcttacggtactacgtacgtggtacgagtagacgtaccttcgtagttcctacgttcccgtttnttgnttcccggg

SEQ ID NO: 45317 - DNA, 534 bp, Homo sapiens
  misc_feature: GYAE6OF01C2SI4.27.57.F02.1.454.CMB.1.raw
  modified_base (465)..(465): a, c, t, g, unknown or other
  misc_feature (465)..(465): n is a, c, g, or t
  modified_base (523)..(523): a, c, t, g, unknown or other
  misc_feature (523)..(523): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgagactctcctgtgcagcctctggattcacctttagtagttattggatgagcgtgggtccgccagacctccgaggggagggctggagttcgtggaccaaacataaaccaagatagggaagtaaaagaaaactatgtgactctgtaggaacgggcattcacatcaccagacgacaacgacaaagatcatgatctgacaatgaacagcctagagagacgaggacncggctagtactactacgtggtacgcggaagactactacctagtactacgtttcccgtnttttgattccg

SEQ ID NO: 45318 - DNA, 668 bp, Homo sapiens
  misc_feature: GYAE6OF01DDH01.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctgggaggaggtgtggtccagcctggagaatccctgagactctcctgtgcagcctctggtattcctacctttagtagttattggatgagcgtgggtccgccagacctccgagggggaaggggctgggagttcggtggacccaacaataaaaccaagaagtagggaaaggtaaaagaaaactagtaggtggaactcgtaggtaggaacgggtccaattccaaccgtacttccctaaccgaggaacgaaccgaaaccgaaccgaaaaggaacgttacctaacgttaggtactcgttacgaaactaaaagttcggaaaaccaggtacccgttaaggaacggacggacccggaagggacccgacgggtcttaaggttaactaaccgttacgtaggtacggacggtaggaactacttacccgttaagttccttacgttttcccggttacttttggactttccggg

SEQ ID NO: 45319 - DNA, 555 bp, Homo sapiens
  misc_feature: GYAE6OF01BGBD7.27.57.F02.1.454.CMB.1.raw
  modified_base (550)..(550): a, c, t, g, unknown or other
  misc_feature (550)..(550): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggagggctggagttcgtggccaacataaaccaagatagggaaggtaaaagaaaactatgtaggactcgtagtggaacgggccgattcacctatcctccagacgacaacgccaaagaacgtcactgtatctagacaaatgaacacgacctaggagtacggcccgaagggaccacgggtctggtaactacctacgtggtcgcggagacgactcctagtctacttcccgtcttttgnttccg

SEQ ID NO: 45320 - DNA, 610 bp, Homo sapiens
  misc_feature: GYAE6OF01CBIZT.27.57.F02.1.454.CMB.1.raw
  modified_base (309)..(309): a, c, t, g, unknown or other
  misc_feature (309)..(309): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgttgctattttagaaggtgtcagtgtgaggtgcaacgtggtggattcgtgggaggagggtgtggtccagcctggagaactccctgagctctcctgtgcagcctcgtggattctacctttagtagttattggatggagtcgtgggtccncgagacctccgaggggagggctggagttcgngaccaanataaaccaagagtaggaagtaaaanaaactagtaggtggaactgtggtacggaacgggcctattcacctatcctaccgaagacgaacgaaaccgacccaaaggtaactactaacgtagttactacgtacgaactaaagtacgaaacgacgtaccgtaggaacgacggtaccggaaggaccgacggtcttagttaaccgtactacgtaggcggtacggaagacgtacttaccgtagtcctacgttccgtcgttttgcttccggg

SEQ ID NO: 45321 - DNA, 727 bp, Homo sapiens
  misc_feature: GYAE6OF01BF9OH.27.57.F02.1.454.CMB.1.raw
  modified_base (307)..(307): a, c, t, g, unknown or other
  misc_feature (307)..(307): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatggagtcgtgggtccncagactccgaggggagggctgggagttcggtggaccaaacataaaccaagtagtaggaaaggtaaaagaaaactagtggtaggactcgtaggtaggaaacgggtcccgtaattcccaacctattaccttacccgaaggaacgaaacccgaaaccggtacccgaaaaggtaaacgttcctaaacgttaggttaaacttccgtaagtaaccgtaaaattacggaaactacggtacccgttagggaaaccggtaaccgggaaccccgggaaagggaaccccgtacgggtaccgttaacggttaaacgttaaccgttaacggtttcgggtacggaccgggtaagggtaacgtaaccggtttacccgtaaggttacccttaacggttttaccccggttcgttttttacggaccgtttacccgggg

SEQ ID NO: 45322 - DNA, 543 bp, Homo sapiens
  misc_feature: GYAE6OF01AR0KH.27.57.F02.1.454.CMB.1.raw
  modified_base (438)..(438): a, c, t, g, unknown or other
  misc_feature (438)..(438): n is a, c, g, or t
  modified_base (538)..(538): a, c, t, g, unknown or other
  misc_feature (538)..(538): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaaggggctgggagttcgtggccaacataaaccaagatgggaagtaaaagaaaactatgtggactctgtaggaagggccattcaccatctccagagaccaacgccaagaatcactgtatcngacaatgaacagcctaggagagacccggaggaccacgggtctaggtactaccgtactggtgcggaagacgagttacctagtcctattcccggtcttttgnttccg

SEQ ID NO: 45323 - DNA, 635 bp, Homo sapiens
  misc_feature: GYAE6OF01DIV32.27.57.F02.1.454.CMB.1.raw
  modified_base (493)..(493): a, c, t, g, unknown or other
  misc_feature (493)..(493): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtgggtggattcgtgggaggtagggtgtcggtccagtccgtaggagtaactcccgtgacgtactccgtctggtgcacgcctgtgtattcctacctttagtagttagttggatgacgtcgtcggccacacgacgtccggaagggacgggtcgtgggtagttcgcgaccaaacgaataaaaccgagacgtaagggaaagtaaaagaaactgtggtacgacgttcgtaggtggaaacgggtctattaccgacctatctaccgaagacgaaccaacgacaaagacgtacacgttntatacgtagaactaaagtacgaacacgtaccgtaggaacgacggaccgaggaccgacggtattcgtaagtaccgttagacggtcggaagacgtattaccgtaccgtagttacctacgtttccggttctttaggacttccggg

SEQ ID NO: 45324 - DNA, 506 bp, Homo sapiens
  misc_feature: GYAE6OF01BQQLE.27.57.F02.1.454.CMB.1.raw
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggagggctggagttcgtggccaacataaaccaagatggaaggtaaagaaactatagtggactctgtgaaggcattcacatctcagagacaacgcaagaagtcactgtatctgacaatgaacagcctagagagccgaggacacggctgtatactacgtgtgagagngactctagtcattccgntttgnttcg

SEQ ID NO: 45325 - DNA, 706 bp, Homo sapiens
  misc_feature: GYAE6OF01BSGUK.27.57.F02.1.454.CMB.1.raw
  modified_base (696)..(696): a, c, t, g, unknown or other
  misc_feature (696)..(696): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgcttattttagaaggtgtccagtgtgaggtgcaacgtggtggtattcgtgggaggaggtgtggtccagccgtggaagaactccctgagactctcctgtcgcacgcctcgtggtacttcctaacctttaggtagttagttggtatgtagcgtcgggtcccgccgacggaccgtaccggaaggggaacgggcgtagggtacggttccggacggaacccaaacgaaactaaaaccgaaggaagtaaggggaaaaggtaaaaagaaaacttagtaggtacggtacgtcgtaggtacggaaacgggaccgtaatactacgtactactccgtaaccgaagtaacgaaaccgaaccggaacccgaaaaggaacgttacccaacgttaacgttaactaccgtaaggaacaaaagtacgaaaccgtacggtaccgtaaggaacggacggtaacccgggaaggtacccgaacgggtactaacgttactaacgtacggtgaggaccgagaactacgtaccgtaacgtacctagtttcccgtntttcggtacg

SEQ ID NO: 45326 - DNA, 567 bp, Homo sapiens
  misc_feature: GYAE6OF01DMU5L.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcagcctctggattctacctttagtagttattggatggagtcgtgggtcccgccagacctccgaaggggaagggctgggagttcgtggaccaacaataaaccgaagatagggaaaggtaaaagaaaactagtgtacggactcgtagtaggaaggccgtattccaccatcctacagaacgaccaacgaccaaagacgtacaactgtactctagactaaagtcgaacagcctagagtacgcggaagacgacggctagtactactacgtgtagacgagagacgtctacgtactacttccgtcttttgcgttccgg

SEQ ID NO: 45327 - DNA, 638 bp, Homo sapiens
  misc_feature: GYAE6OF01AKJ5D.27.57.F02.1.454.CMB.1.raw
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (496)..(496): a, c, t, g, unknown or other
  misc_feature (496)..(496): n is a, c, g, or t
  modified_base (618)..(618): a, c, t, g, unknown or other
  misc_feature (618)..(618): n is a, c, g, or t
  modified_base (628)..(628): a, c, t, g, unknown or other
  misc_feature (628)..(628): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactcctcctgtgcagcctctggattccacctttagtagttattggatgagcgtgggtccnccagactccgaaggggagggctggagttcgtggccaanataaaccaagntggaaggtaaaacaaactntagtggactcgtggtagaaacgggtcccgtaattccgaccctattccgtaccgaggaacgaaccaaaccggacccaaagtaacggtcctaacgtacggtatacctagacaaagttcgaaacncgacccgttaggaacgtaacggacccggaggtaaccgaccggtacgttactaagtaccgttaagcggttaggaccggtaagacgtacgttaacccgtagttaacccttcgtttaccccggtntttttacggntttacccggg

SEQ ID NO: 45328 - DNA, 864 bp, Homo sapiens
  misc_feature: GYAE6OF01AF958.27.57.F02.1.454.CMB.1.raw
  modified_base (305)..(305): a, c, t, g, unknown or other
  misc_feature (305)..(305): n is a, c, g, or t
tcagagcgtcgtctcacgaccggtgctcgatttagctcgatatagttgggtttgtaggtctcagagaggagccttagccctggactccaaggcctttccacttggtgatcagcacggagcacagaggacccaccatggaactggggctgagctgggttttccttgttgctatttagaaggtgtccagtgtgaggtgcaactggtggattctggaggaggtgtggtccagcctggagatccctgagactctcctgtgcagcctctggattctacctttagtagttatggatgagtcgtggggtccnccagtacctccgaaggggaagggggtctggggagtttcggtcgggtacccaaaactaacgttaaaaacccgaaaggtaagttacgggggaaaggggttaaaaaacgaaaaaaccgtttaggttagggtacgggtaaaccttccggttaagggttacgggaaaacggggggtaccccgtaaacttttacccgaaacccgtacgtttacccgttacccggaaacgggtaacggaaaccccgtaaaaaccgggaccccgtaaaaagggtaaaacggttccccgtaaaccgtttacggggttaaaccttaccggtttaacggaaacccgttaaaaacgtttacgggaaaaaccccgtagggtaacccccgttagggtaaacgggtaaacggtaccccgggggaaacggtaaacccggaccggggtaccctttaaggggtaaacttaaaacccggttacgttaccggggttaggacccgggtaaaggtaacggtaaccgttaccctttaacgggtaccttacccgttttacccggtacccttttttgggaacctttaccccggg

SEQ ID NO: 45329 - DNA, 679 bp, Homo sapiens
  misc_feature: GYAE6OF01EVWWN.27.57.F02.1.454.CMB.1.raw
  modified_base (256)..(256): a, c, t, g, unknown or other
  misc_feature (256)..(256): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttctgtagctatttgaggtgtcagtgtgagtgcaatggtggattctggaggaggtgtggtccaggcctggagaactccctgagctctcctgtgcagcctntaggattctacctttagtagttattggattggagctggggtccgccaggacttccggaaggggtaggggctgggacggtttcgnggaccaanactaaaaccgaaagagtaggggaaagttaaaacgaaagttaagtggtaggaaccttgtaggtaggaacggggtcccgtaattccaacctaattaccaccgacggaacggaacaaccggtaccaaagggtaactacctaaccttagtacttactacggtactaaaacgtacgaaacgcgtacccgtaaggacggtaaccggacccgggaaggacccgtaacgggtcctagtttaaccgtaaccgttaacttagggtgaccgggtaaggtacgtaccgttacccgtaaacgttccgtaacgtttcccggttacttttttgggaacctttccgg

SEQ ID NO: 45330 - DNA, 733 bp, Homo sapiens
  misc_feature: GYAE6OF01DMRB7.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagtcgtgggtccgccagactccgaggggaacgggctggagttcggtcggaccaaacaataaaccgaagtacgtagggaaaggtaaaagaaaacgtagtaggtacggtacttcgtaggtacggaaacgggccgtaatttaccaacccgtaattcccgttacccgaaggaaacgtaaacccgaaaccggtacccaaaaggtaaacggtaccaaacgttacggttaacttacccgtttaaggaaccctaaaaagttacggaaaaaccctacggtaacccgttaggaaacggtaacgggacccggaaggggaaacccgaccggggtacttaacggttaacgttaaccgttaacgttcggtacggtaccggaaaggacgttaaccttacccgttaaggttacccttaacgtttccccgttacgttttttcggacgttttacccggg

SEQ ID NO: 45331 - DNA, 639 bp, Homo sapiens
  misc_feature: GYAE6OF01CSBMR.27.57.F02.1.454.CMB.1.raw
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctgggaggaggtgtggtccagcctggagaactccctgacgactctcctgtgcacgcctcgtggtacttctacctttagtagttattggatgagcgtgggtccncagactccgagggagggctggngttcgngaccaanataaaccaganagggaaagtaaaagaaactagtggtaggtactcgtaggtaggaacggggtcctaacgttccaacctacgttcctacccgaaggaacaaaccaaaccgacccaaaaggtactcgacttaggtactctacgaacaaagtacgaaacacggtaccgtaggacgggacggaccgggaaagggacccgaccgggtacttaggtacttaacgttacgtgggtacgacggtaacggaagtaccttaccgttaggtacctacgtttcccgttacgttttgtacttccggg

SEQ ID NO: 45332 - DNA, 715 bp, Homo sapiens
  misc_feature: GYAE6OF01C5SK8.27.57.F02.1.454.CMB.1.raw
  modified_base (602)..(602): a, c, t, g, unknown or other
  misc_feature (602)..(602): n is a, c, g, or t
  modified_base (682)..(682): a, c, t, g, unknown or other
  misc_feature (682)..(682): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgttggttttcctgttgctatttagaagtgtcagtgtgaggtgcaacgtggtggattcgtggaggaggtgtggtccagtcctggagaatcccgtagacgtactctcgtgtcgcgacgcctcgtggtacttctaaccgtttagtagttagtggatggagtcgtcggtccacagacctccgaaggggaacgggctagggtacgttcggacggaccaaactaaacgtaaaaccgaaaggtaagtaaggggtaaaaggtaaaaaacgtaaaaacgtagttagggtaacggtaaccttcggtaggtaacgggaaacgggtacccgtatttacccgaacctagttaccccgtaccgaaaggtaaacccgaacccgtaaaaccgacccgtaaaaaggtaaccgttaccgtaaccgttagttaaacgtccgtaacggaaaacgtaaacgttaacggaaaccncggtaccgtaggaaccgtaacgggacccgaagggtacccacgggtctaagtactaccgtagttagcgtaagagtaacgtntacccgtgtactacgttcggttcttaggcgtcg

SEQ ID NO: 45333 - DNA, 624 bp, Homo sapiens
  misc_feature: GYAE6OF01B26HZ.27.57.F02.1.454.CMB.1.raw
  modified_base (265)..(265): a, c, t, g, unknown or other
  misc_feature (265)..(265): n is a, c, g, or t
  modified_base (507)..(507): a, c, t, g, unknown or other
  misc_feature (507)..(507): n is a, c, g, or t
  modified_base (538)..(538): a, c, t, g, unknown or other
  misc_feature (538)..(538): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaacgtggtggattctggaggaggtgtggtccagcctggagaactccctgagactctcctgtgcagcctntggattctacctttagtagttattggatggagtcgtgggtcccgcagacctccggaggggaacgggctgggagtttcggtacggaccaaacaataaaaccgaagtagtagggaaaggtaaaagaaaacttagtaggtaggactcgtagtaggaacgggcctattaccgaacctactacctaccaggaacgaaccaaaccggaccaaagtaacgtacactagtactcgtagaacaatagaacncgacgtgaagacgacggaggaaccgacggtntacgttaataccgttacgtggtacgagaggtacgtacgttacccttacggttaccttacgttcccgttacttttcgatttacccgg

SEQ ID NO: 45334 - DNA, 617 bp, Homo sapiens
  misc_feature: GYAE6OF01E18MX.27.57.F02.1.454.CMB.1.raw
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagtttattggatgagcgtgggtccacagcctccgagggagggctggacttcggngccaanactaaaccaagataggaaggtaaaacgaaaactgtgtaggacttcgtggtaggaacgggccgtaattaccgaccactccacctagacgaaccgaaacgaccgaaagtaacgacctacgttgtaactctacgactaaatacgaacgacgtaccgtaggaagacggaccggaaggaaccgacggtcgtaggttaactaccgttaacgtcggtcgacggaaggtagtacgttacccgtaacggttccttaactttcccggttctttttgacgtttcccgg

SEQ ID NO: 45335 - DNA, 694 bp, Homo sapiens
  misc_feature: GYAE6OF01CYG5T.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttcctgttgctattttagaggtgtccagtgtgaggtgcaactggtggattcgtggaggaggtgtggtccagcctggagaactccctgagactctcctgtgcacgcctctggtacttctaacctttagtagttagttaggatgagtcgtcgggtccgccagctaccgaggggaagggcgtaggacgttcggtacggaccaacaactaaaaccaaggaagtagggtaaaggtaaaaagaaaacttagtggtaggtactcgtaggtaggaaacgggtccgtagttaccaaccgtactccttaccgaaggtaaacgaaccaaaccggaacccgtaaaaaggaacgttaccaacgttacgttaacgttcctaggtaacaaaagttaacggaaaccgaacgacccgttacgggaacgggacggaaccccgggaagggaacccgtacgggtacgttacgttaacttaaccgttacgtgggttacgacggtaaggacgtacgttacgttaacgtctaacttttccgttacttttgtacgtttccgg

SEQ ID NO: 45336 - DNA, 600 bp, Homo sapiens
  misc_feature: GYAE6OF01B5M63.27.57.F02.1.454.CMB.1.raw
  modified_base (485)..(485): a, c, t, g, unknown or other
  misc_feature (485)..(485): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttccttgttgcttattttagaaggtgtccagtgtgaggtgcaactggtgattcgtggaggaggtgtggtccagcctggagaatccctgacgactctcctgtgcagcctctggacttcacctttagtagttaattggatgagtcgtggtcccgctagacctcgagggaacgggctgggattcggtaggaccaaacgataaaacccaagtacgtagggaaaggtaaaagaaaacttagtaggtaggtaacttcgtaggtaggaacgggtacatttaccgaacctatccgtaccagacgaacaacggaccaaagaacgtcactagtactacgnaacaatacgaacagtcctaggaagacgaccggaagtccgacggtctagtactaccgtagtggtacgagaagtagtactcctaagttcctaagttccccgttgtttcgcgttccgg

SEQ ID NO: 45337 - DNA, 623 bp, Homo sapiens
  misc_feature: GYAE6OF01EGNZD.27.57.F02.1.454.CMB.1.raw
  modified_base (469)..(469): a, c, t, g, unknown or other
  misc_feature (469)..(469): n is a, c, g, or t
tcagagcgtcgtctcacgaccggtgctcgattttagctcgatatagttgggtttgaggtctcagagaggagccttagccctggactccaaggcctttccacttggtgatcagcacggagcacagaggacccaccatggaactggggctgagcgtggtttctgtgctatttagaaggtgtcagtgtgaggtgcaactggtggattcgtggaggagggtgtgggtccaggcctggagaactccccgtgacgacctctcctgtgcagcctctggattcacctttagagttattggatgagctcgggtaccgcctagacgtccgaggggaagggtctagggacgttcgtaggcccctaaacataaaccaaggagtaggaaaggtaaaacgaaactagtgaggacttcgtaggtacgaaacgggtccaattcaccgatcacgagacgacaaacgacagaaacgttcaactgtanactagacaaatacgaactacgaccgtagaacggagaccgacggacgtaaccggacttacgtaacttaccgtaaacggtggttacgacggtaacggtacggtacttacccgtagttacccgttactttacccgtctttttacgaaccgttccggg

SEQ ID NO: 45338 - DNA, 744 bp, Homo sapiens
  misc_feature: GYAE6OF01BZQXL.27.57.F02.1.454.CMB.1.raw
  modified_base (310)..(310): a, c, t, g, unknown or other
  misc_feature (310)..(310): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttccttgttgcttattttagaggtgtccagtgtgaggtgcaactggtggattctgggaggaggtgtggtccagcctggagaactcccgtgagactctcctgtgcagcctctggattctacctttagtagttattggatggagtcgtgggtcccnccagaccgtccgaaggggagggctgggagttcgtcggaccaaacactaaaaccaagtaagtagggaaaggtaaaaagaaaacttagtacggtaggtaactcgtggtacggaaagggccctaagttacccaaccgtacttacctacccggaagaaacggaaaccctaaaaccggaaccgaaaaacgtaaacggtacctaaaccgttaggtttaaacttaccgtaagaaacccgtaaaaagtccgtaaaaaccgaccgggtaccccttaaggggaaacgtaaccgggaacccgggaaaggggtaacccaccggggtaccttaagggttaaaacctacgttaaccggttcggtaacgggaccggaaaggtaacgttaacccttcccgtaaagttcccttaacgttttcccggttactttttgggaccgtttacccgg

SEQ ID NO: 45339 - DNA, 692 bp, Homo sapiens
  misc_feature: GYAE6OF01CB6ID.27.57.F02.1.454.CMB.1.raw
  modified_base (178)..(178): a, c, t, g, unknown or other
  misc_feature (178)..(178): n is a, c, g, or t
  modified_base (205)..(205): a, c, t, g, unknown or other
  misc_feature (205)..(205): n is a, c, g, or t
  modified_base (319)..(319): a, c, t, g, unknown or other
  misc_feature (319)..(319): n is a, c, g, or t
  modified_base (413)..(413): a, c, t, g, unknown or other
  misc_feature (413)..(413): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagctgggtttccttgtgctatttagagtntcagtgtgaggtgcactggtgattcgnggaggaggtgtggtccagcctggagaactcccgtgacgactctcctgtcgcacgcctctggtacttctaaccgttttagtacgtttagttggactggacgtcgtcggggtcccnccgaagtacctccggaagggggaacggggtctaggggtacgttcggtacggacccaaacgtaataaaaccgaagtacgtagggaaaggtaaaanaaaactagtaggtacgactcgtaggtaggaacgggcctaattcctacctactactaccgtacgaacgaacgaacgacgaacgtaacgtacgtacgtacgtacgtacgtacgacgaaacgtaacgaacgaacgacgtacggaacgtacggaccggtacggacggacggacgtacgtacgtaccgttacgtacggtcggtacggacggtacgtaccgttaccgttacgttaccgttactttacccgggggggggtttaccttttcggttacgttacccggg

SEQ ID NO: 45340 - DNA, 818 bp, Homo sapiens
  misc_feature: GYAE6OF01EOON1.27.57.F02.1.454.CMB.1.raw
  modified_base (174)..(174): a, c, t, g, unknown or other
  misc_feature (174)..(174): n is a, c, g, or t
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctggtttcctgtgctatttagagtntccagtgtgaggtgcaactggtgattcnggaggaggtgtggtccagcctgganaactccctgacgactctcctgtgcagcctntggattccacctttagtacgttagtcggaatggacgtcgtacgggtcccaccgagaccgttccggaaggggtaacgggtcttaggggaacgtttccggtacggaacccctaaacgtaacgtaaaaacccgaaaggacgttacgggggaaaacggttaaaacgtaaaaaccgtttgtacgggtacggtaaccctttacgtacgggttaacggaaacggggtcccgttaagtttacccgtaacccgttaacgttacccgtacccgtaacggtaaccggtaaacccgaaaccgggtacccgtaaaaggtaacccggttacctaacgttacggttaacgttaccgtacggaacctaaacgtacggaaaccgtacggtaaccgttacggaacggtaaccggtacccgggtaacgggtaacccgtaaccgggtccgttaacggtaaaccgttacccgtaacggttacgggttaacggtaccggtaacgggtaaccgttaaccgttcccggttaaacggttccgtaaccggtttacccggttacgtttttacggacgttttacccggg

SEQ ID NO: 45341 - DNA, 683 bp, Homo sapiens
  misc_feature: GYAE6OF01CSXG6.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttcctgttgctattttagaaggtgtccagtgtgaggtgcaactggtggattcgtgggaggaggtgtgggtccaggcctggagaactccctgagacctctcctgtgcagccttcgtggtactttacctacctttttaagtagtttaagttggattggagtcgtcgggtcccgaccaggacctccgaaggggaaggggtctagggagttcgtggaccaaacaataaaaccgaagagtagggaaaggtaaaagaaaactagtaggtacggtaaccttcgtaggtacgggaaacgggtcccgtaatttccaaaccctacgtccctacccgaagaacgaaccaaaccgaacccaaaagacgtaccaacttagtacttacagaacaaattacgaaactacgccgtaagggaacgcggaaccgaaggacccgaggtaccttagtaacttaccgtagtacggtcggaacggagtaacggtacttacccgtaaggttccctaagttttccccgttattttcggtacttacccggg

SEQ ID NO: 45342 - DNA, 653 bp, Homo sapiens
  misc_feature: GYAE6OF01C627B.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcagcctctggtacttctaccttttagtagttattggatgagtcgtcgggtcccgccagacctccgaaggggaaggggtctgggtaggttcgtcggacccaaacaactaaaaccaagaagtagggaaagggtaaaaagaaaaactagttaggtaggtactcgttaggtacggaaacggggtcccgtaattaccgaaccctaactcctaccaagacgaaccaaccgacgaaaagacgtacaacgttgtaactcttagaacgaaatcgaaacgacgccctaaggacggcgacccggaagggacgtaccgggcttaaggttaactaacgttacttgggtacgacggaaggaagtaccttccgtaacggtcttaaccgtttccgttacttttggcttaccgg

SEQ ID NO: 45343 - DNA, 520 bp, Homo sapiens
  misc_feature: GYAE6OF01AZKAB.27.57.F02.1.454.CMB.1.raw
  modified_base (405)..(405): a, c, t, g, unknown or other
  misc_feature (405)..(405): n is a, c, g, or t
  modified_base (442)..(442): a, c, t, g, unknown or other
  misc_feature (442)..(442): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaagggctgggagttcgtggccaacataaaccaagatagggagtaaagaaactatgtggactctgtgaaggccattcacatctcaganacaacgccaagaagtcactgtatctgacaaatgaacngcctagagagccgaggaccacggctagtactactagtgtgacgagagactcctagtctacttccgtcttttgattccg

SEQ ID NO: 45344 - DNA, 780 bp, Homo sapiens
  misc_feature: GYAE6OF01DEKTI.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgttgggttttccttgttgcttattttagaaggtgtccagtgtgaggtgcaacgtggtggattcgtgggaggaggtgtggtccaggtcctggagaactcccgtgacgactctccgtgtcgcacgccttgtggtacttactaccttttagttagtttagttggatggacgtcggtcggtcccgaccgacgaccgtaccggaagggggtaacgggcgttaggggtacggtttccgggtacggaacccaaacgaaacgtaaaaccgaaggtaaacggtaaggggaaaaggtaaaaacgtaaaaactagttacggttacggtaacttacggttaggtaacggaaacggggtacccgtaacgtttacccgaacccgtagttacccttaacccggaaacggaaaccgtaaacccggaaaacccgtaacccggtaaaaacggtaaacgtacccgtaaaccgttaaggttaacttacccgtacggaaaccctaaaggtaaccaaaccgcgtaacccgtaggaacggaaccggaccgggaacggaaccgacggtacttacggtaacttacgtacgtggacgaggaacggagtaccttaccgtacgttacttaccgtttccgttcttttaggcctttccggg

SEQ ID NO: 45345 - DNA, 607 bp, Homo sapiens
  misc_feature: GYAE6OF01CK7AA.27.57.F02.1.454.CMB.1.raw
  modified_base (214)..(214): a, c, t, g, unknown or other
  misc_feature (214)..(214): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (388)..(388): a, c, t, g, unknown or other
  misc_feature (388)..(388): n is a, c, g, or t
  modified_base (487)..(487): a, c, t, g, unknown or other
  misc_feature (487)..(487): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaactggtggattcgngggaggaggtgtggtccagcctggagaactccctgagactctcctgtncagcctctgtattctactttagtagttattggatgagtcgtcgggtccnccagacctccgaaggggagggctggtacggtttcgnggaccaaacaactaaaaccgaagagtagggaaaggtaaaanaaaactgtgtaggtactacgtggtaggaacgggccgtaattccaaccgtactccgtacaagacgaaccaaccggacaaagacgtacacttgtactcganacaaatcaacgacgccgtagacgacgacgaaggccacggctagtataccgtagtcggtgacggaagtagtacttaccgtaaggtcccttaacgtttcccgtttaatttcgaactttccgg

SEQ ID NO: 45346 - DNA, 559 bp, Homo sapiens
  misc_feature: GYAE6OF01A4M5L.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagtcgtgggtccgccagacctccgaggggagggctggagttcgtggaccaacataaaccaagataggaagtaaaagaaaactatagtaggactcgtaggtaggaacgggcctattccacctatctccagagacaacgcaaagagtcactgtactcgtagacaaatgaacacgcctaggaacgacgaccggaagacacggtctagtaactacgtacgtggtcgaggagacgtactaccgtagtctacgtttcccgcttttgacttccg

SEQ ID NO: 45347 - DNA, 615 bp, Homo sapiens
  misc_feature: GYAE6OF01CSPDQ.27.57.F02.1.454.CMB.1.raw
  modified_base (330)..(330): a, c, t, g, unknown or other
  misc_feature (330)..(330): n is a, c, g, or t
  modified_base (409)..(409): a, c, t, g, unknown or other
  misc_feature (409)..(409): n is a, c, g, or t
  modified_base (510)..(510): a, c, t, g, unknown or other
  misc_feature (510)..(510): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttcctgttgctattttagaaggtgtccagtgtgaggtgcaactgggtggattcgtgggaggaggtgtgggtccagcctggagaatcccgtagacgtactcctccgtgtgcacgtcctcgtggtatttcctaacccgttttagtacgttattgggatcggagtccgttgggtccnccagacctccgaggggaagggctgggacgttcgtggaccaaacgataaaccagagtagggaagtaaaacgaaactgtgnggactcgtagtaggagggcctattccacctatctaccagacgacaacgacaaagacgtcacgtagtactcgtagacaagtcgaacgacgaccgtggaacgnggaccggaaggaacccgacggtcttacgtacgtaaccgtacgtaggtacgacgaaggaccgtacttacccgtacgtcctacgtttcccgtcttttggccttaccg

SEQ ID NO: 45348 - DNA, 597 bp, Homo sapiens
  misc_feature: GYAE6OF01DYX0I.27.57.F02.1.454.CMB.1.raw
  modified_base (526)..(526): a, c, t, g, unknown or other
  misc_feature (526)..(526): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggtttccttgttgctatttagaggtgtccagtgtgaggtgcaactggtggattcgtgggaggaggtgtggtccagcctggagaatccctgagactctcctgtgcagcctctggattctacctttagtagttattggatggagtcgtgggtccgccagacctccgaaggggaagggctgggagttcggtggaccaaacgaataaaccgaagacgtagggaaggtaaaagaaaactagtggtaggactcgtagtaggaacgggtccgtaattaccaacctatcctaccgagaacgaccaacgaccaaagacgtacacgtgtatctagaacctaaatacgaacacgacctaggacgacgaccggtaggacgacggtntacgtactacgtactggtcggagaggtacgtacgtcctacggttctaacgtttccgtcttttgcttacggg

SEQ ID NO: 45349 - DNA, 611 bp, Homo sapiens
  misc_feature: GYAE6OF01COT3U.27.57.F02.1.454.CMB.1.raw
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (596)..(596): a, c, t, g, unknown or other
  misc_feature (596)..(596): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggttttctgtagctatttagaaggtgtcagtgtgaggtgcaactggtggattctgggaggaggtgtggtccagcctgggagaatccctgagactctcctgtgcagcctctggattcacctttagtagttattggatgagcgttgggtccnccagacctccgaagggggaacgggcttagggacgtttcggnggaccaaacaataaaaccagaactagggaaggtaaaaagaaactagtgtaggactcgtagtaggaaagggcctagttccaacctatcctaccgaaggacgaaccaaccgaccgaaagaacgttcaacgttgtaactctagacaatacgaacagcctaggaagacgaccggaaggaccacgggtactacgtaactaccgttactggtacggaccggaagtgtacccttacgtacgtacctacgtttcccgttnttttggacttccggg

SEQ ID NO: 45350 - DNA, 587 bp, Homo sapiens
  misc_feature: GYAE6OF01AOD0K.27.57.F02.1.454.CMB.1.raw
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
  modified_base (557)..(557): a, c, t, g, unknown or other
  misc_feature (557)..(557): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttatggatgagcgtgggtccnccagactccgaggggagggctgggagttcgtggaccaanactaaaccaagagtaggaaggtaaaagaaaactgtaggtaggactcgtaggtaggaaacggggcctaattccaaccctattccctaccgaaggaacgaacccgaaacgacccgaaaggaacgtaccacgttagtaactctagaacaaagtagaacacgaccgtaggacgacggaccgaggacgacggcgtagtactacgtacgtggtgagagganacgtcctagtcacgttcctctttgcttcgg

SEQ ID NO: 45351 - DNA, 583 bp, Homo sapiens
  misc_feature: GYAE6OF01A18M8.27.57.F02.1.454.CMB.1.raw
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctgggaggaggtgtggtccagcctgganaatccctgagactctcctgtgcagcctntggattcacctttagtagttattggatggagctgggtccnccagactccgaggggagggctgggagttcggtggaccaaacaactaaaccaagagtagggaaaggtaaaagaaaactagtggtagactcgtagtaggaacgggccgattccacctagtcctaccgagacgaacaacgaccaaagaacgtctaactgtactcgtagacaaagtcgaacacgacctaggacgaggaccgaaggaccacggtcgtagtactaccgtagtggtacgacgagtagacttccgtagtcctacgtttcccgtacttttgcttccgg

SEQ ID NO: 45352 - DNA, 569 bp, Homo sapiens
  misc_feature: GYAE6OF01EXBY2.27.57.F02.1.454.CMB.1.raw
  modified_base (344)..(344): a, c, t, g, unknown or other
  misc_feature (344)..(344): n is a, c, g, or t
  modified_base (457)..(457): a, c, t, g, unknown or other
  misc_feature (457)..(457): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccatcctggagaatccctgagactctcctgtgcagcctctggattcaccttttagtagtttattggatgagctgggtccgcagactccgaggggagggctgggagttcgtggaccaanaataaaccaagagtagggaaggtaaaagaaaactgtgtagacttcgtgtaggaagggccattcaccatctccagacacaacgccaagaagtcactgtatctgacaaatgaacngacctagacgtacgaccggaaggaccgacgggtctaggtaacttacgtacgttggtgacggagtaacgacttaccgtagttacctacgtttcccgtcttttgctttcccggg

SEQ ID NO: 45353 - DNA, 794 bp, Homo sapiens
  misc_feature: GYAE6OF01DCT4X.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccacatggaactgggctgagcttgggttttccttgttgctattttagaaggtgtcagtgtgaggtgcaacgtggtggattcgtgggaggaggtgtgggtccagccgtaggaagtaatccctgagtactcctctggtcgcacgcctcgtggtattcctaacctttagtagtttatggatgagcgtacgggtccaccaggacctacggaagggggaacgggtcgtagggtacgttcggtacggaacctaaacgaaaataaaccgaaaggaacgttaggggaaaaggtaaaaaagtaaaaacgtagtaggtaacggtacttacggtaggtaaggaaacggggtacccctaagtttacccgaacctaacgttaccgtaaccgaacggaaacgtaaacccgaaaccggaacccgtaaaaaggtaacggttaaccaacgtttacggttaaccttacgtaaccggtaaacgtaaaagttaaccgaaacggtaaccgacccggttaaggaacgggtaaccggaccgggtaaacgggtaaccggaaccggggtacttaacggttaaccgttaaccgttacgtaacgggttacggtaacggaaggttaacgtaaccgttaccgttaacgttaaccgttacgtttacccggttctttttacggacgttttaccggg

SEQ ID NO: 45354 - DNA, 775 bp, Homo sapiens
  misc_feature: GYAE6OF01B8VGW.27.57.F02.1.454.CMB.1.raw
  modified_base (761)..(761): a, c, t, g, unknown or other
  misc_feature (761)..(761): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactgggctgagcttgggttttccttgttgcttattttagaaggtgtccagtgtgaggtgcaacgtggtggattcgtgggaggaggtgtcggtccagccgtaggagaactcccgtgacgactctccgtggtcgcctagtcccttgtaggtacttcctaaccgttttaggtagtttagttggatggacgtcgtcgggtcccaccaacgacctacggaagggggaagggtccgttagggtacgtttcggacggaccaaaacgtaacgtaaaaccgaaaggtaagtaaggggtaaaaggtaaaaaacgtaaaacgttagtacggtaggtaaccttacgtagggtaacggaaacggggtccctaagttacccgaacctaacgtttcccgaacccgaaaggaaaccgaaacccgaaaaccgacccgtaaaaaggtaacgttacctaaacgttaggtaaacgtacgtaaggaaactaaaagtacgaaaaccctacggtacccggtaaggaaaccggtaacggaacccgggaacggaacccgtaccgggttacttaaggtaaaccttaaccgtaaccggttggtaccggaagtaagacgtaacgttccttaggtacctacgtttcccgttnttttaggcttccgg

SEQ ID NO: 45355 - DNA, 541 bp, Homo sapiens
  misc_feature: GYAE6OF01CKMOD.27.57.F02.1.454.CMB.1.raw
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctgggagaactcccggtgagactctcctgtgcagcctctggattcacctttagtagttattggatgagcgtgggtccnccagacctccgaggggaagggctgggagttcgtggaccaacataaaccagagtaggaaggtaaanaaactntgtgactcgtagtgaagggcattcacatctccagacgaacaacgcaaagatcatgtatcngacaagtgaacngcctagaacgtacgaccgaggaccacgggctagtactaccgtacgtgtgtagagacgtactccttagtctacttccgtcttttgcttcg

SEQ ID NO: 45356 - DNA, 552 bp, Homo sapiens
  misc_feature: GYAE6OF01AGFLI.27.57.F02.1.454.CMB.1.raw
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (372)..(372): a, c, t, g, unknown or other
  misc_feature (372)..(372): n is a, c, g, or t
  modified_base (402)..(402): a, c, t, g, unknown or other
  misc_feature (402)..(402): n is a, c, g, or t
  modified_base (486)..(486): a, c, t, g, unknown or other
  misc_feature (486)..(486): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccnccagctccgaggggagggctgggagttcggnggccaaacataaaccaagatggaaggtaaagaaactntgtaggactcgtgtagaggccgtatcactntctccgagacgaacaacgaccaagaacgtcacgtagtactctaggacaaatgaacagacctaggagacgccgaaggaccacggntagtatccgtaagtcgtggacgagacggtactaccgttagtcctaacttcgtcttttgcttaccgg

SEQ ID NO: 45357 - DNA, 572 bp, Homo sapiens
  misc_feature: GYAE6OF01DQXKL.27.57.F02.1.454.CMB.1.raw
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (564)..(564): a, c, t, g, unknown or other
  misc_feature (564)..(564): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgagactctcctgngcagcctctggattccacctttagtagttattggatggagcgtcggggtccnccagaccgtccgaggggaaggggctgggacgttcggnggacccaaacactaaaaccgaagtagtagggaaagtaaaagaaaactagtgtaggactcgtaggtaggaacgggcctaattccacctatcctacagacgacaacgaccaagacgtcactgtactcgtagacaagtagaacagcctaggacgtacgaccggagaccgcggattagtactacgtagtgtcgacgagtagactccgtagtctacgttccgttnttgtctcg

SEQ ID NO: 45358 - DNA, 517 bp, Homo sapiens
  misc_feature: GYAE6OF01EY6JU.27.57.F02.1.454.CMB.1.raw
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
  modified_base (512)..(512): a, c, t, g, unknown or other
  misc_feature (512)..(512): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccnccagactccaggggaagggctggagttcgtggccaanataaaccaagatggagtaaagaaaactatgtggactctgtgaagggccgatcacatctccagagacaacgacaagaagtcactgtatctgcaaatgaacacgcctgagagccgaggacacggctgtatactactgtgagagagatacctagtacacgttaccgtcttttgngttcg

SEQ ID NO: 45359 - DNA, 652 bp, Homo sapiens
  misc_feature: GYAE6OF01AGKI7.27.57.F02.1.454.CMB.1.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaactccctgagactctcctgtgcagcctctggattcacctttagtagttatggatgagcgtgggtccncagactccggagggagggctggagttcgnggaccaacataaaccaagatagggaaggtaaaagaaaactagtgtacggtactcgtaggtacggaagggtcctaattaccaacctagtcctaccgaagtaacgaacccaaaccggaccaaaaggtaacgtcctaacgttagttactcgtagaacctaaaagtcggaaacacgtaccgtaaggaacggaccggaccggtaaagggacccgacggtccgttagttaactaaccgttacgcggttacggaccgtaagtacgtaacgttacccgttaacggtaccttaacgtttccccgttacgtttttgaccgtttaccgg

SEQ ID NO: 45360 - DNA, 693 bp, Homo sapiens
  misc_feature: GYAE6OF01D228X.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgtgctattttagaaggtgtcagtgtgaggtgcaacgtggtggattcgtgggagggtaggtggtggtccagccgtggagaactccctgacgtactctcctgtgcagcctcgtgacttctacctttagtagttattggatggagtcgtcggggtccgaccacgaccgtccgaagggggacggggtctgggtacgttcgggtacggaccaaacgaactaaaaccgaagagtaacgggaaaggtaaaagaaaacgtagtaggtacggtactcgtaggtaaggaacgggacctacttaccgaacctatcccgtacgaagaacgaacgaaaccgaccgtaaaaggaacgtaccaagttcgtaacttcgacgtaaactaaagtacggaaacctacggtacccgtaagggacggaccggacccgggtaagggacccgtacgggtacttaggtaacttaccctagtcggtacgggacgtaacggtacgtactaccgttacgttacccttacggttccctttgttttacgcgtttccgg

SEQ ID NO: 45361 - DNA, 524 bp, Homo sapiens
  misc_feature: GYAE6OF01C57YN.27.57.F02.1.454.CMB.1.raw
  modified_base (414)..(414): a, c, t, g, unknown or other
  misc_feature (414)..(414): n is a, c, g, or t
  modified_base (454)..(454): a, c, t, g, unknown or other
  misc_feature (454)..(454): n is a, c, g, or t
  modified_base (489)..(489): a, c, t, g, unknown or other
  misc_feature (489)..(489): n is a, c, g, or t
  modified_base (521)..(521): a, c, t, g, unknown or other
  misc_feature (521)..(521): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgagactctcctgtgcagcctctggattcacctttagtagttattggatgagcgtgggtccgccagacctccgaggggaaggggctggagttcgtggaccaacataaaaccagagtaggaaggtaaagaaaactatgtggactctggtgaagggccattcaccatctccaganacaacgccaaagacgtcactgtatcgtagacaaatgaacngcctagagagccgaaggacacggctagtatactgngtgcgagagactcgtatcacttccgtctttgntcg

SEQ ID NO: 45362 - DNA, 609 bp, Homo sapiens
  misc_feature: GYAE6OF01EY18F.27.57.F02.1.454.CMB.1.raw
  modified_base (309)..(309): a, c, t, g, unknown or other
  misc_feature (309)..(309): n is a, c, g, or t
  modified_base (497)..(497): a, c, t, g, unknown or other
  misc_feature (497)..(497): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggtacttctaccttttagtagttattggatgagcgtggggtccnccagactccgaggggaagggctggagttcgcgaccaacaactaaaccaagagtagggaaggtaaaagaaaactagtggtaggactcgtggtaggaacgggccgtattccgacctattcctaccgaaggacgaaccaaaccggaccaaaggtaacgtccaacttgtaatcctagaactaaatcgaaacncgtacctaggaacgacggaccggaaggaccgaccgggcttagtaactaacgttacgtggtcggacgaagacgacttccgtagttactactttcccgtacttttgcgttccgg

SEQ ID NO: 45363 - DNA, 619 bp, Homo sapiens
  misc_feature: GYAE6OF01A9VMP.27.57.F02.1.454.CMB.1.raw
  modified_base (237)..(237): a, c, t, g, unknown or other
  misc_feature (237)..(237): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctgganaatccctgagactctcctgtgcagcctctggattcacctttagtagttattggatgagcgtgggtccgccagactccgaggggagggctgggagttcgtaggccaacataaaaccaagatagggaaggtaaaagaaactagtgtaggacttcgtaggtaggaacgggcctattaccaacctacttacctaccgaagtaacgaaccaaccggacccgaaaggaacgtacctacttagtactacttggaactaaagtacgaacacgtaccctaggaacggacgaccggaacggaccacgggacttagtaactactacggttgtacggacgaaggacgtacgttaccgtacgtaccttactttcccggttcttttagcttcccgg

SEQ ID NO: 45364 - DNA, 725 bp, Homo sapiens
  misc_feature: GYAE6OF01ETYTQ.27.57.F02.1.454.CMB.1.raw
  modified_base (176)..(176): a, c, t, g, unknown or other
  misc_feature (176)..(176): n is a, c, g, or t
  modified_base (308)..(308): a, c, t, g, unknown or other
  misc_feature (308)..(308): n is a, c, g, or t
  modified_base (607)..(607): a, c, t, g, unknown or other
  misc_feature (607)..(607): n is a, c, g, or t
tcagagcgtcgtctcacgaccggtgctcgatttagctcgatatagttgggtttgaggtctcagagaggagccttagccctggactccaaggcttttccacttggtgatcagcacggagcacagaggacccaccatggaactggggctgagcgtggtttctgtgctatttagaggtntccagtgtgaggtgcaacgtggtggattctgggaggaggtgtggtccagcctggagactccctgacgactctcctgtgcagcctcgtggattctacgtttagtagtttattggatgacgcgtcggggtcccncgagacgtaccggagggggaacgggcttagggtacggttcgtacggaccaaacgaagtaaaccgaaggtacggtaagggaaagggtaaaaacgaaaacgtagtggaggtacttcgtaggtaggaaacggggtcctaagtttcccaacgtacgttaccctaccgaaggtaaaccggaaccaaaccggtacccgaaaaggtaaccgttaaccgtacgttaggtactacgttaacggaacctaaaggtcgaaacgtcgtaccgtagggaacgtaccggtaccgggaacgaccggtaacgggngttaaccggttaaacgttacccgttaacgttgggtaacgggaccgtaagggtaaccgtacgttcccgttaaacggttcttaaccgtttcccggtttacttttaaggccgtttaaccgg

SEQ ID NO: 45365 - DNA, 555 bp, Homo sapiens
  misc_feature: GYAE6OF01A7GA3.27.57.F02.1.454.CMB.1.raw
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcaccttttagtagttattggatgagctggggtccnccagactccgaggggagggctggagttcgnggccaanactaaaccaagatagggaaggtaaaagaaactatgtggactcgtgtgaagggccaattcaccatcctcagagacaacgccaagaacgtcactgtatctgacaaatgaacacgacctaggaacgtagacccggaaggaccgacggctaggtattacgtacgtgtacgacgaagagtactaccgtagtcctactttacccggtcttttgattccg

SEQ ID NO: 45366 - DNA, 531 bp, Homo sapiens
  misc_feature: GYAE6OF01CB3JY.27.57.F02.1.454.CMB.1.raw
  modified_base (521)..(521): a, c, t, g, unknown or other
  misc_feature (521)..(521): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccgccagactccgaggggaagggctggagttcgtggccaacataaaccaagagtggaaggtaaagaaaactatgtggactctgtagaagggccgattcaacctatctccagacgacaacgccaaagaagtccactgtatctagacaaatgaacacgcctgagtacgccggaggacacggctgtatacctacgtgtgacgaggagatcctagtcattccgnttttgcttcg

SEQ ID NO: 45367 - DNA, 732 bp, Homo sapiens
  misc_feature: GYAE6OF01CYBOE.27.57.F02.1.454.CMB.1.raw
  modified_base (307)..(307): a, c, t, g, unknown or other
  misc_feature (307)..(307): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggttttccttgttgctattttagaaggtgtccagtgtgaggtgcaactggtggattctggaggaggtgtggtccagcctggagaatccctgacgactctcctgtgcagcctctggacttctacctttagtagttattggatgagtctgggtccnccagctccgaggggaagggctggtagttcgtgaccaacataaaccaagaagtacgggaaggtaaaacgaaaacgttataggtacggtaactctagggttacggaaacggggtcccgtaatttcccgaaccctaacgtcccttacccgaaggaacggaaacccgaacgtaacccgaaaaggaaccgttaccaacgttcgtaacttcctacggtaacaaattacgaaacctaacggtccccgttaggaacggtaacggaccccggaagggaacccgtacgggaccgtttaggttaaccttaacccggttacgttacgggtacggtaacgggtaaacggtaaccgggtacttacccccggtttaaacggttaaccctttaaccgttttacccccggtttacttttttaccggtaacgttttcccgggg

SEQ ID NO: 45368 - DNA, 678 bp, Homo sapiens
  misc_feature: GYAE6OF01DSANR.27.57.F02.1.454.CMB.1.raw
  modified_base (311)..(311): a, c, t, g, unknown or other
  misc_feature (311)..(311): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagccgtggagaactccctgacgactctcctgtgcagcctcgtggtattctacctttagtagttatggatgagcgtcgggtccncagacgtccgaggggagggctggtagttcgtagaccaacaataaaccgaagagtagggaaaggtaaaagaaaactagtaggtaggtaactcgtaggtaggaacgggtcccgtaagtttaccaacctatccctaccgaaggtaacgaacccaaaccggaccgaaaaggtaacgttccaacgtttacgtacttaccgtagaacctaaatacggaaacacggtaccgtaggaacgaccggaccggaacgggaaccgtaccgggtacttaacgggttaacttaaccgtacgttcggtcggaacggtaaggaacgttaccttaccgtaacgttccgttaacgttttcccgttcgttttagcgtttacccggg

SEQ ID NO: 45369 - DNA, 558 bp, Homo sapiens
  misc_feature: GYAE6OF01CFOZ8.27.57.F02.1.454.CMB.1.raw
  modified_base (460)..(460): a, c, t, g, unknown or other
  misc_feature (460)..(460): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctatttagagtgtccagtgtgaggtgcaactggtggattctgggaggaggtgtggtccagcctggagaatccctgagactctcctgtgcagcctctggattcacctttagtagttattggatgagctgggtccgccagactccgagggaagggctggagttcgtggccaacataaaccaagataggaaggtaaaagaaaactagtggtaggactcgtaggtgaaaggggccgaatttccacctatcctccagagacaacgaccaaagaacgtcactgtatctgacaaatgaacnggacctaggagacgccggaaggacacggctggtaactacgtactgtcgagaaggagactacccttaggtactactttacccgtcttttggcttaccgg

SEQ ID NO: 45370 - DNA, 527 bp, Homo sapiens
  misc_feature: GYAE6OF01EZ5BR.27.57.F02.1.454.CMB.1.raw
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
  modified_base (501)..(501): a, c, t, g, unknown or other
  misc_feature (501)..(501): n is a, c, g, or t
  modified_base (524)..(524): a, c, t, g, unknown or other
  misc_feature (524)..(524): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagctgggtccncagactccgagggaagggctggagttcgnggccaacaataaaccaagagtaggaaggtaaaagaaaactagtagtaggactcgtgtgaagggcctattcaccatctccagacgacaacgccaagaacgtcactgtatctagacaatgaacacgccagagagaccgaggacacggctagtatactacgtgtgagaganactctagtctactccgtctttgntcg

SEQ ID NO: 45371 - DNA, 674 bp, Homo sapiens
  misc_feature: GYAE6OF01CKM74.27.57.F02.1.454.CMB.1.raw
  modified_base (312)..(312): a, c, t, g, unknown or other
  misc_feature (312)..(312): n is a, c, g, or t
  modified_base (340)..(340): a, c, t, g, unknown or other
  misc_feature (340)..(340): n is a, c, g, or t
  modified_base (375)..(375): a, c, t, g, unknown or other
  misc_feature (375)..(375): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaacgtgggtggattcgtgggaggaggtgtggtccagcctggagaactccctgagactctcctgtgcagtcctcgtggtattctaacctttagtagttattggatgagcgtggtccncagacctcgaagggagggctggagtcgngaccaacataaaccaagagtagggaaaggtaaaanaaaactagtgtaggactactggtaggaacgggaccgtattaccgaacctatcctaccgaagaacgaaccaacggaccaaagaacgtaccaacgttagtaactctagaactaaaagtacgaaaccgacgtaccgtaggaaacggtaccgaccggaaacgggaacccacggggtaccttaggttaacttaaacccgttaacgttcgggtacgaaccgggaaaggtacggtaacctttaccccgttaagggtaccccttaacggtttacccccgtttagttttaccgggaacttttcccggg

SEQ ID NO: 45372 - DNA, 804 bp, Homo sapiens
  misc_feature: GYAE6OF01D2IKX.27.57.F02.1.454.CMB.1.raw
  modified_base (318)..(318): a, c, t, g, unknown or other
  misc_feature (318)..(318): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcttgggttttccttgttgctattttagagtgtccagtgtgaggtgcaacgtggtggattctggaggaggtgtggtccagcctggagactccctgacgactctcctgtgcagcctcgtggtacttcctaacctttagttagttagttggatggagtcgtcggggtccnccgagaccgtccggaaggggaggggctagggacgtttcggcggaccaaactaactaaaaccgaaggaacgtagggaaaggtaaaaagtaaaacttgtaggtacggtacttcgtagggtaacggaacggggtacccgtaatttcccaaaccgtacgttacccttaacccgaagggtaaaccgaaacccgaaaccggtaacccgaaaaagggtaaaccgttcccgtaaacgttacggtttaactacccgttaaggaaacctaaaaccgttaaggaaaccgaccgggttacccgtaaggggaaccggaccgggaaccccgggaaacgggtaacccgtaaccggggttcttaaacgggtttaaaccttacccgttaaagggtttcgggttaaccggacgggtaaaggtaaccggttaaaccgtttacccgtacggtttaccccgttaacttttccccggttttacgttttttcgaccgttttaccccggg

SEQ ID NO: 45373 - DNA, 693 bp, Homo sapiens
  misc_feature: GYAE6OF01CRFJC.27.57.F02.1.454.CMB.1.raw
  modified_base (638)..(638): a, c, t, g, unknown or other
  misc_feature (638)..(638): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcttgggttttccttgttgcttattttagaaggtgtccagtgtgaggtgcaacgtggtggattcgtggaggaggtgtggtccagccgtggagaactccctagacgacctctcctgtcgcgacgtcctcgtggtacttctacctttagtagttagttggtatggacgtcgtcgggtccgccgaagtaccgtaccggaagggggtaagggcgtagggtagtttccggtcgtaccaaacgaactaaaaccgaagtaagtaagggaaagtaaaaagtaaaacgtagttaggtacggtaacgttcgtaggtacggtaacgggtccgtaacgtttccgaacctacgtacccgtaccgtaaggaacgaaacccgtaaacgaccgaaaaggtacgtactacgttagtactactagaaacaaagtacgaaacgacgacctagggaacgacgaccggtaaggaccgacgggtacttagtaactacgttcgaggtacgnggaaagtacgacttaccgtacgtactttacgttaccgtttctttagtcttccggg

SEQ ID NO: 45374 - DNA, 857 bp, Homo sapiens
  misc_feature: GYAE6OF01C5AZ6.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttcctgttgctatttagaaggtgtccagtgtgaggtgcaactggtggattctggaggaggtgtggtccagcctggagaactccctgagactctcctgtgcacgccctcgtggtacttacctaacctttttagtaagtttagtttggattggacggtccgtcggggtacccgccgaaggtacccgttacccggaaggggggaaacggggtccttaggggtaacggtttccgggtcgggaaccccaaaacgtaacgttaaaaaccccgaaaggtaacgttaagggggaaaagggtaaaaaacgtaaaaaacgttaagttagggtacgggtaaccttcgttagggttaacgggaaacggggtcccggtaatttccgaaacccttacgtccgttaaccccgaagaaacgaaacccgtaaaaccggacccgaaaaaggtaaaccgttccaaaccgtttagggttaaacctaccgtttagaaaacccgtaaaagtttaccgaaaacttaacgggtaccccgttaaagggaaccgggtaaacggccccggggaaaacggtaaccggacggggtaacctttaggtaaaacctttcccgttaaacggttgggtaccgggaggtaaacggtaaacggacgttttaacccgttacggttacccgttaaaccgttttccccggtttaacttttggtaaccgttttaaccccggg

SEQ ID NO: 45375 - DNA, 553 bp, Homo sapiens
  misc_feature: GYAE6OF01BG3FB.27.57.F02.1.454.CMB.1.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
  modified_base (548)..(548): a, c, t, g, unknown or other
  misc_feature (548)..(548): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccnccagacctccgaggggaagggctgggagttcgtggccaanataaaccaagatagggaaggtaaaagaaaactatggtaggactcgtagtggaagggccattcaccatctccaagagacaacgccaaagacgtacacttgtatctagacaaatcgaacagcctaggagacgaccggaggaccacggctagtactacgtaacgttgtgcgaggagacttcccgtagtactacttccgtcgttttgnttccg

SEQ ID NO: 45376 - DNA, 618 bp, Homo sapiens
  misc_feature: GYAE6OF01ESKZK.27.57.F02.1.454.CMB.1.raw
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctggaggaggtgtggtccagcctggagaatccctgagactctcctgtgcagcctctggattcacctttagtagttattggatgagctgggtccnccagactccgaggggagggctggagttcgtggccaanataaaccaagagtagggaaggtaaaagaaaactagtagtaggacttcgtgtaggaacgggccgtattcaccattcctaccagacgaccaaccgacgaaagaacgtcactgtaatcctagactaaatacgaacacggtaccctaggaacgacggacccggaagggaaccgtaccgggtccttaggttaactaccgttaacgttgggtcgtacgggaaggacggtaacgttccccttaaggttacctacgtttaccccgttctttttggactttcccggg

SEQ ID NO: 45377 - DNA, 723 bp, Homo sapiens
  misc_feature: GYAE6OF01BEHZD.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtcagtgtgaggtgcaacgtggtggattcgtgggaggaggtgtggtccagcctggagaatccctgagactcctcctgtgcagccctgtggtacttcctacctttagtagtttatggatggagtcgtcgggtccgccgagacctaccggaaggggaaggggtcctgggtagttcggtacggaccaaacaacgtaaaaccgaaggtaagtacggggaaaaggtaaaaacgtaaaaacttagtacggtaacggaacttacgtagggtaacggaaacggggtcctaatttaccaaccgtactcctaacccgaaggaaccgaaaccgaaaccggaaccgtaaaacggtaaacgttacccgaacgttagtaacttacctaagaacctaaagtacgaaacgaccggtaccgtaggaacggtaaccggacccggtaaggaacccgtaccgggtacctttaggtaaccttaaccgttacgtaggtcgacggaagtacgtacttacccgtaagttcccttacgtttacccgttcttttaggctttaccggg

SEQ ID NO: 45378 - DNA, 752 bp, Homo sapiens
  misc_feature: GYAE6OF01CD4UZ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaactccccgagacctctcctgtgcagccctctggattcacctttagtagtttattggattggagcgtggggtccgccagacctccgaggggaacggggctgggagttcgtggaccaacaataaaaccaagagtagggaaaggtaaaagaaaacttagtaggtacggaacttcgtaggtaggaaacggggtcccgtaagtttccaaccctattcccgttaacccgaaggtaacggaacccaaaacccggaccccgaaaagggtaaaccgttaccaaccgtttaggttaaaccttccgttaggaaccctaaaaagtttacggaaaacccgtaggtccccgtaagggaaccggaaccgggacccggaaacggggaaccctaaccggggtccttaggttaaacttaccgttaacgttcgggttacggccggtaaggaacgggtaccttacccggttaacggttacctaacgttttccccggttacgttttttacggaaccgtttccggttaacccgggg

SEQ ID NO: 45379 - DNA, 785 bp, Homo sapiens
  misc_feature: GYAE6OF01E0Y52.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcctgtgctatttagaggtgtcagtgtgaggtgcaactggtggattcgtggaggaggtgtggtccaggcctggagaactcccgtgacgactctcctgtgcagtcctcgtggtacttccgtaccttttagtagttagttggattcggagtcgtcggggtcccaccgacgtaccgtccgggaagggggaacggggtcttggggtacgtttcggtacggacccctaaacgtaacgtaaaacccgaaggtaagttaaggggaaaacggttaaaaaacgaaaaacgtttggtacgggttacggtaaccgtttacgtagggttaacgggaaaccggggtcccgttaactttacccgaacctacgttacccgtaccgaagtaacggaaacccgaaaccggaaccgaaaggtaaccgtaccgtaacgtacggttactacgtacgtaaaccctaaaagtaccgaaacgaccgtaccgtagggaacgggtaccgaccgggtaacgggaaccgacgggttaacttacggttaaaccttacgtaaccgttgggtaccggaccggtaaaggtaccgttacgttaacccgttacgttacccttaaccgtttcccgtttacgtttttgacccgttacccgggg

SEQ ID NO: 45380 - DNA, 540 bp, Homo sapiens
  misc_feature: GYAE6OF01EINJP.27.57.F02.1.454.CMB.1.raw
  modified_base (493)..(493): a, c, t, g, unknown or other
  misc_feature (493)..(493): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtggggtccgccagactccgaggggaaggggctgggagttcggtggaccaacaactaaaaccaagatagggaaggtaaaagaaaactagtaggtaggactcgtgtaggaagggccgtattcaaccatctaccagacgacaacgacaaagaatcactgtatctagacaatgaacagcctagagacgccggagacgacgntagtatacatgngagagngatcctagtcctagttcctctttgcttcg

SEQ ID NO: 45381 - DNA, 518 bp, Homo sapiens
  misc_feature: GYAE6OF01EQJ19.27.57.F02.1.454.CMB.1.raw
  modified_base (480)..(480): a, c, t, g, unknown or other
  misc_feature (480)..(480): n is a, c, g, or t
  modified_base (513)..(513): a, c, t, g, unknown or other
  misc_feature (513)..(513): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccagggagggctggagttcgtggccaacataaaccaagataggaggtaaagaaactatgtggactcgtgtgaagggccgattcacatctcagagacaacgaccaagaacgtcaactgtatctgacaaatgaacagcctagagagccgagacgacggctagtatactactgngcgagagatccgtagtctacttccgtcttttgnttccg

SEQ ID NO: 45382 - DNA, 800 bp, Homo sapiens
  misc_feature: GYAE6OF01EY769.27.57.F02.1.454.CMB.1.raw
  modified_base (267)..(267): a, c, t, g, unknown or other
  misc_feature (267)..(267): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaactggtggattcgtgggaggaggtgtggtccagcctggagaatccctgagactctcctgtgcagcctntggtacttctacctttagtagttattggatggagcgtgggtcccgccagaccgtccggaagggggaacggggtctagggtacggtttcggtacggacccaaaacgtaaacgttaaaacccgaaaggtacgttaaagggggtaaaacgggttaaaaaaacggtaaaaacctttaggttaacgggttacggggtaaaccctttcgggttaagggttaacggggaaaccggggtccccgttaaactttacccgaaaccccgtaagtttaccccgtacccgaaagggtaacgaaacccgaaaacccggacccgaaaaaggtaaccgttacctaaacgttggttaacttccgttaggaacctaaaagttcggaaaactacgacccgtaagggaacgaacgggtacccggaaagggaccgtaaccgggtcgttaacggttaaacttacccggttacgtcgggtacggacgtaaggtacgtaaccttcccggttaagttccgtaacgttttccccgttagtttttcggacgtttcccggg

SEQ ID NO: 45383 - DNA, 700 bp, Homo sapiens
  misc_feature: GYAE6OF01BCZ8Y.27.57.F02.1.454.CMB.1.raw
  modified_base (178)..(178): a, c, t, g, unknown or other
  misc_feature (178)..(178): n is a, c, g, or t
  modified_base (314)..(314): a, c, t, g, unknown or other
  misc_feature (314)..(314): n is a, c, g, or t
tcagagcgtcgtctcacgaccggtgctcgatttagctcgatatagttgggtttgaggtctcagagaggagccttagccctggactccaaggccctttccacttggtgatcagcacggagcacagaggacccacatggaactgggctgagcgtggtttctgtgctatttagagtgtccngtgtgaggtgcaacgtggtggattcgtgggagggtaggtgtggtccagccgtaggacgaatccctgacgtctctcctggtcgcacgtcctgtggacttctacctttagttagttatggtatgagtcgtggggtccnccgacgtaccgtccggaaggggacgggcgtgggtagttcggcggaacctaagaactaaacgaagagtaggaaaggtaaacgaaactagtggagacttacgtggtagaacgggctagttaccacgtatacctcgaacgacaacccgaacgacgtaaaacgaacgtacccaagttcgttaacgtcgtacggaaactaagtaaccgaaacgtacggtaacccgtaggaaacggaccggaaccggaccggtaaccggaccgggtaacgtacgggttaaatacccggttaaagttcgggaacgggacggaacggttaacgaacccgtttaccgtaacgttacccgttaacccgttttccggtttacttttaccggacttttaccccggggg

SEQ ID NO: 45384 - DNA, 628 bp, Homo sapiens
  misc_feature: GYAE6OF01ANUA1.27.57.F02.1.454.CMB.1.raw
  modified_base (305)..(305): a, c, t, g, unknown or other
  misc_feature (305)..(305): n is a, c, g, or t
  modified_base (485)..(485): a, c, t, g, unknown or other
  misc_feature (485)..(485): n is a, c, g, or t
  modified_base (511)..(511): a, c, t, g, unknown or other
  misc_feature (511)..(511): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaactggtggattcgtgggaggaggtgtggtccagcctggagaatccctgagactctcctgtgcagcctctggacttcacctttagtagttatggatgagctgggccncagactccgaggggaggcgtggagttcgtacggaccaaacactaaaccgaagatagggaaagtaaaagaaaacttgtaggtagacttcgtggtaggaaacggggtcctagttacccaacctattccgtaacccgaagtaacggaacccaaaccggaccaaaaggtaacgtccaacggttntaacttcgagactaaaagtcgaaacngacccgtaggaaggacccggaccgaacggaaccgaccggtacttacgtaactacctacgtggtaccgacgagtaagacttaccgttaagtcttaccgtttcgtcgttttatcgtacg

SEQ ID NO: 45385 - DNA, 526 bp, Homo sapiens
  misc_feature: GYAE6OF01AH6FG.27.57.F02.1.454.CMB.1.raw
  modified_base (303)..(303): a, c, t, g, unknown or other
  misc_feature (303)..(303): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgagggaagggctggagttcgtggccaacataaaccaagataggaggtaaagaaactatgtaggactctgtggaagggccgattcaccatctccagagacaacgccaaagaagtcactgtatcngacaaatgaacngcctgagacgccgaggaccacggctgtatactacgtgtgagagagactccgtagtctattcccgtcttttgacttccgg

SEQ ID NO: 45386 - DNA, 748 bp, Homo sapiens
  misc_feature: GYAE6OF01BBXBW.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcacgcctctggattctacctttagtagttattggatgagcgtcggggtcccgccgacgacctccggaagggggaacggggcgtggggacgtttcggtcggaccaaacgaactaaaaccgaaagagtagggaaaggtaaaagaaaactagtggtaggactcgtaggtaggaacgggtccgtaattaccacctacttccctaccgaaggaacgaacccgaaaccgaccgaaaaggtaacgtaccacgttaggttaactccgtaggaacctaaaagtacggaaacctacggtacccgttaggaacgggtaacggacccgggaacgggaaccggtaaccgggtcctttaagggttaaaccttaaaccgttaacggtttacgggtacgggtaaccgggtaagggtaacggtaaccgtttaccccggttaaaccggttaccgtttaacccggttttcccccggtttacgttttttacggacccgttttaccccgggg

SEQ ID NO: 45387 - DNA, 716 bp, Homo sapiens
  misc_feature: GYAE6OF01AR1FL.27.57.F02.1.454.CMB.1.raw
  modified_base (266)..(266): a, c, t, g, unknown or other
  misc_feature (266)..(266): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaactccctgagactctcctgtgcagcctntggacttcacctttagtacgttattggatgacgtcgtcggggtcccgaccaaggtacctccggaagggggaacggggtcttgggacgtttccggtcggacccaaaactaacgtaaaaccaaggtacgtaggggaaacggtaaaacgtaaaacgttagtaggtacggtaaccgtttacgtaggttaagggaaacggggtcccgtaagtttacccgaacctaagttccctaccgaaggaaacgtaacccgaaaaccggccctaaaagggtaacgtccctaacggttacgtaacttcgtacggaaactaaaggtacgaaaccgacgtacccgttaggaaacggtacccggtacggaacgggacgaaccggtctaggtacttaaccgtacggtgtacgaccggaagtacgtacttaccgtaggttcccaacgtttcccgtcgtttgtacgtcgg

SEQ ID NO: 45388 - DNA, 724 bp, Homo sapiens
  misc_feature: GYAE6OF01B9LXO.27.57.F02.1.454.CMB.1.raw
  modified_base (338)..(338): a, c, t, g, unknown or other
  misc_feature (338)..(338): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttccttgttgcttattttagaaggtgtccagtgtgaggtgcaacgtggtggattcgtgggagggaggtggtggtccagccgtggagaactccctgagactctcctgtgcacgctcgtggacttctacctttagttagttattggatggagcgtcggtccgcacgacctcgaggggacgggtntagggagttcggtacgaccaaacaacaaaccaagaagtagggtaaaggtaaaacgaaactagtagtggaactcgtaggtaggaacggtacgtactaccaaccgtatcctacgaacgacgaaaccgaaccgtaacgaaaggtaacgtacctaacgttagtaagtaccgtagaaacctaaaattacggaaaaccgtcggtaacccggtaaggaaaccggggtaaccggaacccgggtaaaggggaccccgtaaccgggttcgtttaacccgggttaaacttacccggttaaacgttcggggtacggaaccgtaaagggtaacgtacccgtttacgtacgtttaccgttaacgttttcccggtttacgtttttggaccgtttacccggg

SEQ ID NO: 45389 - DNA, 539 bp, Homo sapiens
  misc_feature: GYAE6OF01AZK5G.27.57.F02.1.454.CMB.1.raw
  modified_base (502)..(502): a, c, t, g, unknown or other
  misc_feature (502)..(502): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactcccgagggaaggggctgggagttcgtggccaacataaaccaaagatagggaaggtaaacgaaaactagtgtaggaactctggtagaagggcattcacatctccagagacaacgcaagaagtcactgtactactgacaatagaacagacctggaacgtagaccgaggaacacggctgtaactactactgtagngagtagataccgtagtactacttcgccttttgctccg

SEQ ID NO: 45390 - DNA, 617 bp, Homo sapiens
  misc_feature: GYAE6OF01AVO8S.27.57.F02.1.454.CMB.1.raw
  modified_base (304)..(304): a, c, t, g, unknown or other
  misc_feature (304)..(304): n is a, c, g, or t
  modified_base (474)..(474): a, c, t, g, unknown or other
  misc_feature (474)..(474): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctggaggaggtgtggtccagcctggagatccctgagactctcctgtgcagcctctggattcacctttagtagttattggatgagctcggggtccnccgagacctccgaggggaacggggctgggagttcgtggccaaacataaaccaagatagggaagtaaaagaaactatggtaggactcgtggtaggaacgggccattcaccactactccaagacgaccaaccgaccaaagtaacgtacaactgtatctgacaaatcgaaacncgaccgtagaacggtacgacccggacggaaccgaccgggtacgtaggtacttaacccgtaacgttcggtggacccggtaagggacgtaccgttacccgtagttacctacttttaccccggtcttttttacggactttcccggg

SEQ ID NO: 45391 - DNA, 799 bp, Homo sapiens
  misc_feature: GYAE6OF01AFXPE.27.57.F02.1.454.CMB.1.raw
  modified_base (782)..(782): a, c, t, g, unknown or other
  misc_feature (782)..(782): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttcctgtgctatttagagtgtcagtgtgaggtgcacgtggtgattcgtggaggtaggtgcggtccaggcctaggacgtactcccgtagacgacttcgtccgtgtgacctacgtcctcgtggtacttccgtaaccgttttagtacgtttagtcgggtattacggtacggtccggtttcggggcccaccctaaggacccgttcccgggaagggggtaacgggtccttaggggtaaccggtttccggtacgggaaccccgtaaacgtaaccgttaaaacccgaaggtacgtaacgggggaaaggttaaaaaccgtaaacgtgttaacggtacggtactaccggtaggtaggaaccggggtcctaagttccaaccgtaagttccgaaccgtaagacgtaaacccgaccgtaacgtaaacggtaacgtcccgtacgttaagtaaccgttaccttaacgggaactttaaacgtaccgggtaactaccgggtacccgtaaaggtaccgggaaaccggtacccgggaaagggtttacccaaaccgggttccttaaaggtaccttaaccggtcgttagggtacccgaaggtaacgtactaccgttccctaacggtcccttacgttaccccggtttnttaggccgtttaccggg

SEQ ID NO: 45392 - DNA, 540 bp, Homo sapiens
  misc_feature: GYAE6OF01ACSZZ.27.57.F02.1.454.CMB.1.raw
  modified_base (414)..(414): a, c, t, g, unknown or other
  misc_feature (414)..(414): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgagggaggggctggagttcgtggccaacataaaccgaagatagggaagtaaagaaaactatggtaggactcgtggtagagggccgtattcaccatcctcaganacaacgcaagagtcatagatctgacaatgaacagaccctggagacgccgaggacacggctgtatacgtacgtgtcggcgagacgtactaccctagtctacgtttcccgtctttttggactttccgg

SEQ ID NO: 45393 - DNA, 644 bp, Homo sapiens
  misc_feature: GYAE6OF01C02G7.27.57.F02.1.454.CMB.1.raw
  modified_base (210)..(210): a, c, t, g, unknown or other
  misc_feature (210)..(210): n is a, c, g, or t
  modified_base (317)..(317): a, c, t, g, unknown or other
  misc_feature (317)..(317): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgtggttcgtgtagctatttagagtgtcagtgtgaggtgcaactggtggattcgtgggaggnggtgtggtccaggcctagggagaactcccgtagagaccttctcctgcgcacgccctcgtggtacttccgtaccttttaagtagtttattggatgcgtcgtggtcccncgagacgtaccgaggggaacggcgtagggacgttcggtacggaccaaacgaataaaccgagtagtaagggaaagtaaaacgaaatagtggtagacctgtaggaggacgggcctattccgaacctgtcaaccgagaacgaacaccggacaaagtacactacgtagtcttacgagtaacgaaagtagaacccgagtacccgtaaggaacggacgtaaccggaggtaaacccgcgggttaactaacggttactaaccgttcgtaggtcggaccgtaaagccggtaacttacccgtagtaccttacgttcccttagtttacgctttccggg

SEQ ID NO: 45394 - DNA, 661 bp, Homo sapiens
  misc_feature: GYAE6OF01C2UD1.27.57.F02.1.454.CMB.1.raw
  modified_base (223)..(223): a, c, t, g, unknown or other
  misc_feature (223)..(223): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgttgctattttagaaggtgtccagtgtgaggtgcaactggtggattcgtggagggtaggtgnggtccagccgtaggagtaactccctgagtacctctcctgtgcacgtcctcgtggtacttcctacctttagtagttagttggatgagtcgtggtccgcagctccgagggagggtctggtagttcgagaccaacaataaaccgaggataggaaagtaaagtaaactgtaggtagtacttcgtaggtacggacggtactacgttacacgtactctaccgagaacgaacaaccgaacgaaagtactcaagttgtactcgtagaaccaagttacgaaacgtcgtaccgtaggaacgtacggacccggaagggaacccgtacgggactttacggtaaactaccgttacgtagggtaccggaggaaacggtcttaacgggttacccttaggttaaccccgttacggttttccccggttttaactttgggttacccgttacccggg

SEQ ID NO: 45395 - DNA, 572 bp, Homo sapiens
  misc_feature: GYAE6OF01BBFU9.27.57.F02.1.454.CMB.1.raw
  modified_base (544)..(544): a, c, t, g, unknown or other
  misc_feature (544)..(544): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagcgtgggtccgcagactcgagggagggctggagtcgtgaccaacactaaaccaagatagggaagtaaaagaaactataggtaggactcgtggtaggaacgggccgtaattaccacctattccctaccgaagtaacgaaccaaaccggaccaaaggaaacgttccaacttaggtaatcctaggacctaaatagaacagaccctaggaagacgccgaaggaccgacggctagtactactagtgcgagagganactactagtctattccgtctttgactcg

SEQ ID NO: 45396 - DNA, 713 bp, Homo sapiens
  misc_feature: GYAE6OF01BCHDG.27.57.F02.1.454.CMB.1.raw
  modified_base (308)..(308): a, c, t, g, unknown or other
  misc_feature (308)..(308): n is a, c, g, or t
  modified_base (390)..(390): a, c, t, g, unknown or other
  misc_feature (390)..(390): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttcctgttgctattttagaggtgtcagtgtgaggtgcaactggtggattctgggaggaggtgtggtccagccgtggagactccctgacgactctcctgtgcagcctgtggattctactttagtagtttatggtatgacgcgtcgggtccncacgacctccggaggggacgggctgggacgttcggtacggaccaaactaactaaaaccgaaggagtaagggaaaggtaaaanaaaacgtataagtacggtaacttcgtaggtaacggaacgggaccgttaagttacccaaccgtacttacccgtaccgaaacggaacgaacccgaaaccggaacccaaaggtaacggtaccctacgttagttactacctagaaactaagtaccgaaacgacgtaccgtaggaacggaccggtaccggaacgggacccgacggtaccgttaagtaacgttaccgttacggtacggttacggacggtaaggtaccgttaacgttaccccgttaaggtttcccgttaaccgttttcccggtttactttttcgggaaccgtttcccggg

SEQ ID NO: 45397 - DNA, 791 bp, Homo sapiens
  misc_feature: GYAE6OF01EMWYP.27.57.F02.1.454.CMB.1.raw
  modified_base (628)..(628): a, c, t, g, unknown or other
  misc_feature (628)..(628): n is a, c, g, or t
  modified_base (648)..(648): a, c, t, g, unknown or other
  misc_feature (648)..(648): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgttgggttttccttgttgcttattttagaaggtgtccaggtgtgaggtgcaacgtgggtggattcgtggggagggtagggtggtcgggtccaggtcccgttagggaacgtaaactccccgtaggacgtaccttcctcccgtggtacgccgacgtcccttcgtggtactttacctaaccgtttttaaggtagtttagttggtatggacggtccggtcggggtccccaccgtaacggaccgtaccgggaagggggtaacggggtcgttaggggtacggtttccggtacgggaacccaaaaacgtaacgttaaaaaccgaaggtaacgttaaggggaaaaggtaaaaaacggaaactttaggtaggtacggtacttcggtacgggtaggaaacgggtccctaattacccgaaccgtacttacccgaccgaagtacgaacccgaaaccgaaccgaaaagtacgtacgtaccttagtacctntaacgaactaaagtcgaacncggtaccgtaagggacggtaggaccccgggtaagaccccggaggtaccttagtacttaccgaaggttggtacgggaagtaggaacgtacgttaacccgttagtacccttacggttttaccgttcgttttcgcgtttacccggg

SEQ ID NO: 45398 - DNA, 726 bp, Homo sapiens
  misc_feature: GYAE6OF01EE21A.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggttgtccagtgtgaggtgcaactggtggattctgggaggaggttgtggtccagcctggagaactccctgagactctcctgtgcagcctctggattctacctttagtagttattggatgacgtctggggtccacagactccgaggggaacgggctgggagttcgtaggccaaacataaaccaagtacgtagggaaacgttaaaagaaaacttagtggtacggaacttcgtaggtaggaaacgggtccgtaattacccgaaccctagttaccccttaccgaaggaacgaaaccctaaaccggacgaaacggtaaacggttccaacgttaggttaaacttccgttacggaaaccttaaaaacgtcgggaaaacctacgggtaccccttaagggaacggtaaaccgggaccccggttaaaggggaacccgtaacccggggtaacttacgggttaaactttacccgtaaacggttcggtaacggaccggtaagaccggttacttacccgtacggtacttacgtttaccgttcgtttttacgacgtttacccgg

SEQ ID NO: 45399 - DNA, 534 bp, Homo sapiens
  misc_feature: GYAE6OF01EVN4R.27.57.F02.1.454.CMB.1.raw
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (500)..(500): a, c, t, g, unknown or other
  misc_feature (500)..(500): n is a, c, g, or t
  modified_base (530)..(530): a, c, t, g, unknown or other
  misc_feature (530)..(530): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggggctgagctgggttttccttgtgctattttagaaggtgtccagtgtgaggtgcaactggtggattctggaggaggtgtggtccagcctggagaatccctgagactctcctgtgcagcctctggattcacctttagtagttattggatgagctggggtccnccagcctccgagggaaggggctggagttcgnggccaanactaaaccaagagtaggaaggtaaagaaactataggtgactctggtaggaacgggcctattaccacatctcagagacgaacgacaagaacgtcactgtatctagacaatcgaacacgacctagagacgacgacggacacggctagtactactacgtgngacgagcgatctagtctacttactctttgnttcg

SEQ ID NO: 45400 - DNA, 685 bp, Homo sapiens
  misc_feature: GYAE6OF01C6GGC.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtcagtgtgaggtgcaactggtggattctggaggaggtgtggtccagcctggagaactccctgagactctcctgtgcagcctctggacttcctacctttagtagtttattggatgagcgtgggtccgccagacctccgaggggaagggcgtggtagttcgtggaccaacaataaaaccagaagtaggaaaggtaaaagaaaactagtagaggtactcgtaggtaggaaacgggcctaacttccgaacctagtccctaccgaaggaacgaaccaaaccgacgaaaaaggtacgtacctaaacgttgttaactcttaagaacctaaaagtcgaaaccacggtaccctaagggaacgaccggaacccggaaggaacccggacgggtccttaaggttaaaccgtacccgttaaggtcggtcgggaacggaaggtaaacggtaactttacccccgttaaagttccctttaaacggtttccccgtttacgtttttaggaccgtttcccggg

SEQ ID NO: 45401 - DNA, 926 bp, Homo sapiens
  misc_feature: GYAE6OF01EECEP.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcttgggttttccttgttgcttattttagaaggtgtccagtgtgaggtgcaacgtggtggattcgtgggaggtaggtggtggtccagcctaggacgaactccctgacgaccttctcctggtgcacgccttcgtggtactttacctaaccgtttttaggtagtttattggaattggacgtccggttcgggggtccccgtccgaacggtacccgttcccgggaaagggggggtaacggggtccgttagggggtacggttttccgggtaccgggaaccccaaaaccgtaaacgttaaaaaccccgaaaggtaacggttaacgggggtaaaaacgggttaaaaaacgtaaaaaccgttagttaacggggttacgggtaaccctttccggttaggggttaacggggaaaaccggggttcccgttaaactttccccggaaaccctaacgtttaccccgtaacccggaaggtaaacccggaaaacccgtaaacccggaacccggtaaaaaggggtaaacccgttacccgtaaacggtttacgttaaaccgtttaccgttaacgggaaacttaaaaacgggttaccgaaaaaccgtccggtaacccggttaagggaaacgggtaacccggggtacccgggaaacgggtaaccccggtaacggggtccttaaacggtaaaccgtttaaccgttaccggttacgggtacggaaccgggaaggtaacgtaccttacccgtaagtttacccgtaacgttttccccggttagttttcgccgttcccggg

SEQ ID NO: 45402 - DNA, 670 bp, Homo sapiens
  misc_feature: GYAE6OF01D1CCI.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaatccctgagactctctgtgcagcctctggtattcctacctttagtagttattggattggagtcgtggggtccgccagacctccggaaggggaacgggtctgggagttcgtcggaccaacgaataaaaccgaagagtagggaaaggtaaaagaaaactagtagtaggactcgtaggacggaacgggccgtaattaccgaacctacttaccgtaccgaaggtaacggaaaccaaaccggaacctaaaggtaaaccgttcctaacgtttaggtacttacgtagaaactaaagtacgaaacacggaccctaggaacggacggaaccggagaaccggaccggtcttaaggtaacttaccgtacgttaggtacgacggaacggtagtaccttacccgtaagttccgtactttacccggttctttttagacgttccggg

SEQ ID NO: 45403 - DNA, 692 bp, Homo sapiens
  misc_feature: GYAE6OF01BZWDS.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtcgcagcctcgtggtattcctaccgtttagtagtttattggatgagtcgtcgggtccgccagaccgtccggaagggggaacggggtcgtgggtacggttcggtacggaccaaacgtaactaaaaccgaagtagtaagggaaaggtaaaagaaaacgtagtgtaggactcgtggtacggaacgggccgtaattccaaccgtatccctaccgaaggaacgaaccgaaaccgaccgaaaaggaacgtaccaacgttgtaactacgtagaactaaaacgtcgaaaccgcgtaccgtaggaacggtaccggacccggaaggacccgaccgggtattacggtaacttaccgtacgtggtacggtaccgaaaggtaccgtaaccgtttaccgtaacgttccgttacgtttaccccggtttacgtttttacggacgttttcccgg

SEQ ID NO: 45404 - DNA, 651 bp, Homo sapiens
  misc_feature: GYAE6OF01CANVV.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcacgcctcgtggattcaacctttttagtagtttattgggtatggagtcgtcggggtcccgccaagacctccgaggggaacggggctagggacgttcgtggaccaaacaataaaaccaagagtagggaaaggtaaaagtaaaacgtataggtaggactcgtggtacggaaaggggtcccgtaatttaccgaaccgtattcctaccgaagagaacccgaaacgaccaaaaggaactacgaacttagtactcgtacgaactaaaagtcgaacaacgacctacggaagcgaccggtaaggaccacgggtacttaggtaacttaccgtaagttcggacgtaggaagtaagtaccttccgttaacgtctacgtttccccgtttagtttcgtacgtttccgg

SEQ ID NO: 45405 - DNA, 725 bp, Homo sapiens
  misc_feature: GYAE6OF01DM94Y.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttccttgttgcttattttagaaggtgtccagtgtgaggtgcaacgtggtggattcgtgggaggaggtgtggtccagccgtggagaactccctagagactctcctgtgcacgcctgtggtacttctacctttagttagttagttggatggagtcggttcgggtcccgccaaggaccgtccggaagggggtaacgggtcgtagggtacggtttccggtacggaacccaaaactaaacgtaaaaccgaaaggtaaggtaaggggtaaaaggtaaaaacgtaaaactagtacggtaggtaacttcgtaggtacggaacgggtaccgtacttaccaacctactaccaccgaagaacgaaccgaaaccgaacgaaacgtaacgttcctaacgttacgtaacgtccgtaggaactaaaagtcgaaaactcgaaccgtaggaacgggtaccgaccgggaaaggacccgtacgggttactacgggttaactaccgttaacgtggttaccggaggtaaagtcgttacctacccgtttacggtcctttaacggtttccgtttacttttgacgtttccggg

SEQ ID NO: 45406 - DNA, 801 bp, Homo sapiens
  misc_feature: GYAE6OF01DFZG7.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctattttagaaggtgtccagtgtgaggtgcaacgtggtggattcgtgggaggaggtgtggtccagcctggagaatccctgagactctcctgtgcagcctcgtggattctacctttagtagttatggatggagtcgtgggtccgccacgacctccggaaggggaacgggctgggtacggttcggtcggaccaaacaactaaaaccgaaggacgtaagggaaaggtaaaaagaaaactagtaggtaggtactcgtaggtagggaaacgggtccgtaattacccaaccgtatacctaccgaaggaacgtaacccgaaaccgtaacccgaaaaggtaacgtaccctaacgttacggttaacttaccgtacgtaaacctaaaaggttaccgaaaaccgtacggtaaccccgttagggaaaccgggaaccgggtaaccccgggaaacggggtaaccccgaacggggtacccgtttaaacgggttaaaccgttaaaccccgttaacgggttacgggttaacggggaaccgggtaaaccgggttaacggtaaacccgtttaccccggtttaaacgggttacccttaacccggttttacccccgggtttaccgtttttttaccggaaccggtttttaccccgggg

SEQ ID NO: 45407 - DNA, 633 bp, Homo sapiens
  misc_feature: GYAE6OF01DZCOB.27.57.F02.1.454.CMB.1.raw
  modified_base (623)..(623): a, c, t, g, unknown or other
  misc_feature (623)..(623): n is a, c, g, or t
  modified_base (628)..(628): a, c, t, g, unknown or other
  misc_feature (628)..(628): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagctttcgtggtactttcctaccttttagtagtttattggatggagtcgtcggggtccgaccagaccgtccgaagggggaaggggtctagggtagtttcggtcggaccaaacaactaaaaccaaaggagtagggaaaggtaaaaagaaaacttagtaggtaggtactcgtaggtacggaaacggggtacccgtaatttccgaaccctagtccctaccaagaacgaacccaaaccgaccgaaaagaacttacacttagtactctacgacaaatcgaacagcctagaacgacgccggaaggacgacggactacgttactactacgttgacggacgaggactactccgtaagtcctacttcccgttntttgnttccg

SEQ ID NO: 45408 - DNA, 695 bp, Homo sapiens
  misc_feature: GYAE6OF01DZ78L.27.57.F02.1.454.CMB.1.raw
  modified_base (553)..(553): a, c, t, g, unknown or other
  misc_feature (553)..(553): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaactccctgagactctctgtgcagtcctctggattcctacctttagtagttattggatggagcgtcgggtccgcagaccgtccgaggggaacgggctagggacgttcggtcggaccaaacgtaactaaaacccgaaaggtacgtaagggaaaagggttaaaaacgaaaaacgttagttggtacggtaactcgttagggttacggaaacggggtaccgtaatttcccgaaccgtaacttccgtaaccgaggaacgaacccgaaccgaaccgaaaagaacgtctacggttagttactcgtagaactaaagtacgaacnggtacctaggaacggtaccgaccggaagggacccgaccggcgttaacgttaactacgttaccgttggtaacgacggtaacggaaagttccttaccgttaacggtcttacctttacccggtttacttttggccctttaccggg

SEQ ID NO: 45409 - DNA, 591 bp, Homo sapiens
  misc_feature: GYAE6OF01A4FX3.27.57.F02.1.454.CMB.1.raw
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (510)..(510): a, c, t, g, unknown or other
  misc_feature (510)..(510): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagtcgtgggtccgccagacctccgaggggagggctggagttcgnggccaanactaaaccaagataggaagtaaagaaactgtgtaggactgtgtaggaagggcctattaccacctatcctaccagtacgaacaaccgcaaagacgtcaacttgtaatcgtagacaaagtcgaacgcgtacctaggaacgtacggacccggaagggaccgaccgggtntaacgtactaccgtacgtcggtacgagtaagacgtactaccgttacgtaccgttactttcccggttacttttggacgttcg

SEQ ID NO: 45410 - DNA, 599 bp, Homo sapiens
  misc_feature: GYAE6OF01BM9HL.27.57.F02.1.454.CMB.1.raw
  modified_base (350)..(350): a, c, t, g, unknown or other
  misc_feature (350)..(350): n is a, c, g, or t
  modified_base (593)..(593): a, c, t, g, unknown or other
  misc_feature (593)..(593): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctcgtggattccaccttttagtagtttattggatgagcgttcggggtcccgccgagaccgtccgaaggggaaggggctgggagttcggnggaccaacaactaaaccgaagagtagggaaggtaaaagaaaactagtgtacggactcgtggtaggaacgggccgtattcacctatccctaccagacgaacgaaccgaccaaagaacgtacactagtatctgactaaatcgaaacacgtccgtaggaacggacggtaccggaaggaccgacggtctagtacttaccgtactggtgacgaagagacttccgtagtcctacgtttccgtcttttgnttccgg

SEQ ID NO: 45411 - DNA, 652 bp, Homo sapiens
  misc_feature: GYAE6OF01DRK7H.27.57.F02.1.454.CMB.1.raw
  modified_base (251)..(251): a, c, t, g, unknown or other
  misc_feature (251)..(251): n is a, c, g, or t
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
  modified_base (388)..(388): a, c, t, g, unknown or other
  misc_feature (388)..(388): n is a, c, g, or t
  modified_base (482)..(482): a, c, t, g, unknown or other
  misc_feature (482)..(482): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcggtggtttcgtcgtaggcgtatttaagaaggtgtcagtgtgaggtgctaagtggtggtattcgtgggaggaggtggtcggtccagccgtggacaactccgngacgacttcgtccttgatcacgccttgtaggtacttcttaaccgtttagtaagttattggtaagngaacgtcgttccggggccncgaacggtccgaccggaaggggaggacgtggaacggtttcgacggacctaaanaacttaaaccgagaagtaaggtaaacggaaaataacgtagtagtggtacctggtagtagggtaaacgtccgattaccacgtctacacccggaanacgaacgaaccgaacgtaacgactacgtagttagtactacgtacgaaactagtaacgacgtcgacgaagacggaccgacgaacggacgtacgtactagtactcgtaacgtcggtaggacgaggtacctacgttacgttacgttacttcgttactttcgttcgcggttcgg

SEQ ID NO: 45412 - DNA, 827 bp, Homo sapiens
  misc_feature: GYAE6OF01BFK3R.27.57.F02.1.454.CMB.1.raw
  modified_base (266)..(266): a, c, t, g, unknown or other
  misc_feature (266)..(266): n is a, c, g, or t
  modified_base (312)..(312): a, c, t, g, unknown or other
  misc_feature (312)..(312): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaactccctgagactctcctgtgcagcctntggattcaacctttgagtttattggattgagcgttacggggtcccnccgagaccgtccgaaggggtaacggggcctagggagtttccgggtcggaccctaaacgaacttaaaacccgaaaggtacgttaacgggaaagggttaaaaacgaaaacgtttaacgtaggttacgggtacttacgtacggtaaggaaaggggacccgtaacgtttacccgaacccgtacttacccgttaccgaacggtaaccgtaaacccgaaaccggaacccgtaaaacgggtaaaccgttacctaaccgtttacggtaaacttccgttaacgtaaccgttaaaacttacgggaaaccctaacgggtacccccgttaggaaaccgggtaaccggtaacccgggaacgggtaacccgaaccgggttacttaaccgggttaaaccgttaaccgtttaaacccggttggttaaccgggacccggtaaagggtaccgtaaaccgtttaccccgttaaaggttacccttaacgttttacccccggtttacttttttcccgggaaaacttttccccgggg

SEQ ID NO: 45413 - DNA, 841 bp, Homo sapiens
  misc_feature: GYAE6OF01CNR4L.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaatcccgtgagacctctcctgtgcacgcctctggacttctacctttagtagttagttggatgagtcgtcgggtccgccagtaccgtacccgaagggggaacgggcgtgggtacggttccggtcggacccaaacaacttaaaaccgaagtaagtaagggaaagggttaaaaacgtaaaacgttagtaggtacggtaacgttcgttagggtacggaacgggtaccgtacgttacccaacccgttaattccccgttaacccggaaggtaacccgaaaacccgtaaaccggaaccccgaaaaaggtaaaccggttccctaaacggtttcgttaaacgtacccgtaacgggtaaaccctaaaaaaggttccggaaaaccggttaccggtacccgttaagggggaaaccgggacggggtaaaccccccggggaaaggggaacccggtaacccgggtcgttaaacggtttaacgttaaaccccgtttaagtcggggttaaaccgggacccgggtaaaggtacccgttaccgtttaacccggtttaacggttacccgttttaacccgttttcccccggttttaattttttccgggaaccgttttcccccggg

SEQ ID NO: 45414 - DNA, 654 bp, Homo sapiens
  misc_feature: GYAE6OF01CRZOO.27.57.F02.1.454.CMB.1.raw
  modified_base (522)..(522): a, c, t, g, unknown or other
  misc_feature (522)..(522): n is a, c, g, or t
tcagagcgtcgtctcacgaccggtgctcgatttagctcgatatagttgggtttgaggtctcagagaggagccttagccctggactccaaggcctttcaacttggtgatcagcacggagcacagaggacccaccatggaactgggctgagctgggttttccttgttgctattttagaaggtgtccagtgtgaggtgcaactggtggattcgtggaggaggtgtggtccagccgtggagaactccctgagactctcctgtgcagccttctggtattcctaacctttttagtagtttatttggattgagcgtgggtccgccaagactccgaggggagggctgggagttcggcgaccaaacaactaaaaccagaagtagggaaaggtaaaaataaaacgtagtaggtaggtaactcgtaggtaggaacggggcctaagttccaacctaattccgtaccaaaggtacaaacccgaacggtccaaaaggacgtacaacttaggtactcgtagaacctaaagcgaaacncgtaccctagggaacgaccggacggaacgggaccacgggtctagttaaccgtaccttacgtggttacggacggtaaggtactacgttacccgttaacgtcttactttaccggttcttttagcgtttacccgg

SEQ ID NO: 45415 - DNA, 551 bp, Homo sapiens
  misc_feature: GYAE6OF01EOTEO.27.57.F02.1.454.CMB.1.raw
  modified_base (303)..(303): a, c, t, g, unknown or other
  misc_feature (303)..(303): n is a, c, g, or t
  modified_base (462)..(462): a, c, t, g, unknown or other
  misc_feature (462)..(462): n is a, c, g, or t
  modified_base (540)..(540): a, c, t, g, unknown or other
  misc_feature (540)..(540): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccncagactccgagggagggctggagttcgtggaccaacataaaccaagagtagggaaggtaaaagaaactatggtaggactcgtgtaggaagggcctattccaccatcctaccgagacgacaaccgacaaagaacgtcactgtactcgtgactaatgaacngacctaggagacgccggaagaccgacggtctagtactactacgtgtacgcgaagcgactccgtagtcacgtttccgtnttttgcttcgg

SEQ ID NO: 45416 - DNA, 823 bp, Homo sapiens
  misc_feature: GYAE6OF01COIHN.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagagtgtcagtgtgaggtgcaacgtggtggtattcgtgggaggaggtgtggtccagcctggagaactccctgagtacctctcctgtgcacgccttcgtggtacttctaaccgtttagtagtttagttggatgtacgcgtcgggtccgcagacctaccgaggggacgggtcgtagggtacgttcggtacggaccaaaaccgtaagtaaaacccgaaaggtaagtaacggggaaaagggttaaaaagtaaaaacgtaagttgggtaacggtaaccgttcgtagggttagggaaacggggtacccgtaacgtttacccaaccctaacgttacccgtaacccgaaggaaaccggaaaccccaaaccggaaccccgaaaaggtaaccgtaccgtaaccgttaggtttaaccgtacgtaacgtaacgtaaaagtaccggaaacgaccggtaccgttaagggaaaccgggaaccggtaaccccgggaagggtaacccggtaccggggtaaccccgtttaaggttaaacccgttaaccgtaaacccggttggggtaaccggtacggtaaacggtacgttaaacccgttacccgtttaacggttacctttaccggttttaccccgttttcgtttttacggacccgtttttaacccgggg

SEQ ID NO: 45417 - DNA, 618 bp, Homo sapiens
  misc_feature: GYAE6OF01ER480.27.57.F02.1.454.CMB.1.raw
  modified_base (351)..(351): a, c, t, g, unknown or other
  misc_feature (351)..(351): n is a, c, g, or t
  modified_base (388)..(388): a, c, t, g, unknown or other
  misc_feature (388)..(388): n is a, c, g, or t
  modified_base (514)..(514): a, c, t, g, unknown or other
  misc_feature (514)..(514): n is a, c, g, or t
  modified_base (605)..(605): a, c, t, g, unknown or other
  misc_feature (605)..(605): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggggctgagctgggttttccttgttgcttattttagaaggtgtccagtgtgaggtgcaactggtggattctggaggaggtgtggtccagcctggagaatccctgagactctcctgtgcagcctctggattcacctttagtagttattggatgagtcgtcggggtcccaccgagacctccgaagggggaacggggctagggagtttcggnggaccaaacaataaaccaaggatagggaaggtaaaanaaacgtagtaggtagtactcgtagtaggaacgggaccgtaattccaacctacttacctaccgaaggaacgaaaccaaaccgaccaaaaggaacgtacaacgtcgtatctagactaaagtcgaaacngacctaggacgacggaccggagaaccgacggtctagtaactacgtacgtggtcgacggagacgtacttccgtacgttctactttcccgttnttttcgcttccgg

SEQ ID NO: 45418 - DNA, 632 bp, Homo sapiens
  misc_feature: GYAE6OF01CHKGX.27.57.F02.1.454.CMB.1.raw
  modified_base (308)..(308): a, c, t, g, unknown or other
  misc_feature (308)..(308): n is a, c, g, or t
  modified_base (395)..(395): a, c, t, g, unknown or other
  misc_feature (395)..(395): n is a, c, g, or t
  modified_base (618)..(618): a, c, t, g, unknown or other
  misc_feature (618)..(618): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttcctgtgctatttagaaggtgtccagtgtgaggtgcaactggtggattcgtgggaggaggtgtcggtccagcctgggagaactcccgtgagacctctcctgtgcagcctctggtattctacctttagtagttattggatgagtcgtggtccncagactcgagggagggctggtacgtcgtggaccaaacaactaaaccgaagagtagggaaagtaaaagaaaactagtggaggactcgnggtaggaacgggccgtaagttccaaccgtatccgtaccgaaggaacaacccgaaaccgaccgaaaaggtaacgtaccaagttacgtactcgtagaaactaaagtacgaaacgtcgaaccgtaggaacggaccggaaccggacggaaccgacggtctaacgttacgtaaacctcgtaggtcggaacggaagacgtacgttacctagtccgttaacttcccgttntttggacttccggg

SEQ ID NO: 45419 - DNA, 771 bp, Homo sapiens
  misc_feature: GYAE6OF01AHPCL.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaactggtgattcgtggaggaggtgtggtccaggtccgtggagaactcccgtgacgtacctctccgtgtcgcacgtcctcgtggtacttcctaccgttttagtagtttagttggtatggacgtccgttcggggtccccgaccgaggtaccgtaccggaagggggaacgggtcgtagggtacggtttcggtacggaacctaaaacgaaacgtaaaaacgaagtaagtaacggggtaaaagggtaaaaaacgtaaaaccgttagtacgggtaaggtaccttcgtaggtacggaaacgggtcccgtaagttacccaacctactacctaccgaagtaaccgaaacccgaaccggaacccgaaaggtaaaccgttcccaacgtttacggtaacttaccgtaagtaaacctaaagtccgaaaacgtcgaacccggtaagggaacgtacccgggaaccggaggaacccgtacggtaacgttacgtaaccttaccgttaaggtggtccgaacggacggtaacgtacccgttacccttaaggtaccttaccgtttccgtttacgtttccggtaacttccgggg

SEQ ID NO: 45420 - DNA, 845 bp, Homo sapiens
  misc_feature: GYAE6OF01AC5IL.27.57.F02.1.454.CMB.1.raw
  modified_base (674)..(674): a, c, t, g, unknown or other
  misc_feature (674)..(674): n is a, c, g, or t
tcagagcgtcgtctcacgaccggtgctcgatttagctcgatataggttagggtttagaggtctcagagaggagccttagaccctggactccaaggcctttccacttggtgatcagcacggagcacagaggacccaccatggaactggggctgagctgggttttccttgttgcttattttagaaggtgtccagtgtgaggtgcaacgtggtggattcgtgggaggaggtgtcggtcccaggccgtggacgaactcccgtaggacgtactctcctggtcgccacggtcccttcgtacggtactttaccgtaacccgtttttagttaacgttttaagttggtacttggacgtccggttcggggtccccgaccgtaacggaacccgttccggggaacgggggtaaacggggtccgttacgggtacgggttaccggtacgggaacccctaaaaactaaaccgtaaaaccggaaaggtaaggtaacgggtaaaacgggttaaaaaacgtaaaacgtttaggtaggttacgggtaaccttacggttagggtaaacgggtaaccgggtaccgtaacttaccgaacccgtacttaccgtaaccgaagaaccgtaaaccaaaccgtaccgaaagtaacgtactaccgttagttacctcgtacgtaacgtaaactcggtaaaccnggtaacccgtaggaaacggtaccggaccggaacgggtaccgaccgggtacttacggttaactaacccgttaggtaccggtacggtaacgggtaacggtacgttacccgttaccgtttaagtacccgtttacgttttaccccggttacgtttttacggacccgtttaccggg

SEQ ID NO: 45421 - DNA, 688 bp, Homo sapiens
  misc_feature: GYAE6OF01BGAH0.27.57.F02.1.454.CMB.1.raw
  modified_base (350)..(350): a, c, t, g, unknown or other
  misc_feature (350)..(350): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggtttccttgttgctattttagaaggtgtccagtgtgaggtgcaactggtggattctggaggaggtgtggtccagcctggagatccctgagactctctgtgcagcctctggattcacctttagtagttattggatgagctcgggtccgccagacgtccgaggggaaggggtctgggacgttcggtcggacccaaanaacgtaaacccgaaagtacgtagggaaaggtaaaacgaaaacttgtacgtaggactacgtaggtaggaaacggggtccctaagtttccgaacctacttcctaccgaaggaaccgaacgaaaccgacccaaaggtaaacgtaccaacgttcggtaacttacgtaggtaacctaaaattacggaaaccgtacgacccgttaggaacggaaccggaccgggaacggaccggaacgggtcctaagggttaacttacctaaccggttggtaggaccggaaggacgtaccgttaccgttaagtaccttacggtttacccgttcgtttttacgaacgtttcccgg

SEQ ID NO: 45422 - DNA, 582 bp, Homo sapiens
  misc_feature: GYAE6OF01DL0OV.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattctacctttagtagttatggatgagcgtgggtccnccagactccgaggggacgggctgggagtcgtggaccaacataaaccagatagggaagtaaaagaaaactgtaggtgactgtgtaggaaggccatcaccatcctacagacacaacgacaaagacgtcacgttgtatctagactaaatgaactacgaccgtaggaacgtacggacccggtaaggaaccgtaccgggtcttaacggtaactaccgttaacgtggtacgaggacggtagtaaccttcgtacgtcctactttcccgttattttgacttaccgg

SEQ ID NO: 45423 - DNA, 734 bp, Homo sapiens
  misc_feature: GYAE6OF01BBS7G.27.57.F02.1.454.CMB.1.raw
  modified_base (321)..(321): a, c, t, g, unknown or other
  misc_feature (321)..(321): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattcgtgggaggaggtgtggtccagcctggagaactccctgacgacttctcctgtcgcagcctcgtggtacttcctacctttagtagtttatggtatggagtcgtcggggtccnccgaagacgtccgaaggggacgggtcgtgggtacggttcggtacggaccaaacgtaactaaaaccgaagtacgtaaggggaaaggtaaaaacgaaaacttaggtaggtacggtaactcgtaggtaggaaacggggtccctaagttaccgaacctacgttcccgtaaccgaaggaaaccggaaaccgaaacccgaaccgtaaaagtaaaccggttacctaacgttaggttaacttccgtaacgaaaccgtaaacgttaacggaaacccgtaggtaccgtaaggaacgggtaccggaaccggaacggaacccgtacgggacgttacgtaacgttacctaacgttggtacggtacgaggacgtacctaccgttacgttccgtaaccgttttaccgttcgttttagtccgttacggg

SEQ ID NO: 45424 - DNA, 639 bp, Homo sapiens
  misc_feature: GYAE6OF01EJR7I.27.57.F02.1.454.CMB.1.raw
  modified_base (301)..(301): a, c, t, g, unknown or other
  misc_feature (301)..(301): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttatggatgagctgggtccncagactccgagggagggctggagttcgtggaccaacataaaccaagatagggaagtaaagaaactagtggtaggactcgtaggtaggaaggggtcccgtattaccaaccgtatacctaccgaagaacgaaccgaaaccgaccgaaaggtaacgtaccgaacttggtactcgtacgaactaaacgtacgaacacggaccgtaggaacggtacggaccggaacgggaccgacgggtacgtacgttaactaccgtacgttggtacgacggaacggtaacggtacttacccgttaacgttaccttaccgtttacccggttacgtttttcgacgtttacccgg

SEQ ID NO: 45425 - DNA, 590 bp, Homo sapiens
  misc_feature: GYAE6OF01EM77O.27.57.F02.1.454.CMB.1.raw
  modified_base (311)..(311): a, c, t, g, unknown or other
  misc_feature (311)..(311): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtggattcgtgggaggaggtgtggtccagcctggagaactccctgagactctcctgtgcacgcctctggattcacctttagtagttattggatgagcgtgggtccnccagactccggaggggagggctgggagttcggaggaccaacaactaaaccaaaggagtagggaaggtaaaaagaaactagtaggtagacttcgtaggtaggaacgggcctattccaaccatcctacgaagacgaacgaaccgaccaaacgtaacgtcacttgtatactacgactaaatagaacacgcctagacgacggccgaaggacacggtctagtacttactataggtcgagagacgtctaccgtagtacctacgttcccgttcttttgacttccgg

SEQ ID NO: 45426 - DNA, 777 bp, Homo sapiens
  misc_feature: GYAE6OF01BB2XD.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtcgcagcctctggattctacctttagtagttattggatggagtcgtcggtccgcagaccgtccgaggggaacggggctgggacgtttcggtaggaccaaacaactaaaaccgaaaggtaacgtagggaaagggtaaaacgtaaaaactagtaggtacggtaacttcgtaggtaggaaacgggccgtaacgtttccgaacctacgttacccgtaccaacggaacgaaacccgaaaccgacccgtaaaaggaaacgttaccctaacgttacggttaactccgttaacgaacctaaaacgttcgaaaaccgacggtaccctaagggaacggaaccggtacccgggaaacggaaccggtaaccgggtaacgtttacgggttaaaccttaaccggtttaaaccggttcgggtaacggtacgggtaaacgggtaaaacggttaccctttaaacccggttaccgggttaaccctttaaccggtttttaccccggtttaacccgtttttttcgggaaccttttcccggg

SEQ ID NO: 45427 - DNA, 731 bp, Homo sapiens
  misc_feature: GYAE6OF01B29DC.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttccttgttgcttattttagaaggtgtccagtgtgaggtgcaacgtggtggattctgggaggaggtgtggtcagcctggagaactcctgagactctcctgtgcagtcctcgtggtacttctacctttagtagttattggatgagtcgtcggtccgccagactccggaggggaacgggtcgtaggtacggttcggtacggaaccctaaacgaaacgtaaaacccaaaggtaagtaaaggggtaaaagggtaaaaaacgtaaaacgtaggttggtaacggtaaccttaggtacgggtaaggaaacggggtacccgttaacgtttacccaacccgtaacttcctaacccgtaaaggaaaccgaaacccgaaaccgtaaccgaaaaaggtaacgtacctaacgttaggtaacctcgtaacgaaactaaagtaccgaaacgtcgtacccgtaaggaacgaccgggaccggaacggtaccgaccggtcttacggtaactaccgttacgaggtaccgaggaagtacgtaccttacccgttagtaccttaccggtttcccgttagttttacgcggtttaccgg

SEQ ID NO: 45428 - DNA, 844 bp, Homo sapiens
  misc_feature: GYAE6OF01CYBZ8.27.57.F02.1.454.CMB.1.raw
tcagagcgtcgtctcacgaccggtgctcgatttagctcgatataggttggggtttgaggtctcagagaggagcccttagccctggacctccaaggcctttccacttggtgatcagcacggagcacagaggacccaccatggactgggctgagctggtttctgtgctatttagagtgtccagtgtgaggtgcaacgtggtggattcgtgggaggaggtgtggtccagcctagggagaactcccgtgacgacttctaccttgtgcacgcctacgtggacttctaaccctttagtagttagttggtataggagtcgtcgggtccacgacgacctccggaagggggtaacggggcttaggggtacgttcggtacggaccctaaaacgtaaacgttaaaacccgaaaggtaacgttaaggggaaacggttaaaaaacgtaaaaccgttagtcggtacggtaacttcgtaggtaacggaaacggggtcccgtaacgttaccgaaccctaacgtttcccgtaaccccgtaaagggtaaaccgaaacccgtaaaaccggacccggaaaaaaggtaaccggttaccctaaacccgtttaggttaaaccgtacgttaacccgaaacgttaaaaacggttaccgtaaaaccgccgggtaaccccttaagggggaaaccggtaaccgggaaccccggggtaaggaaacccggtacccgggttaccgttaacgggttaaaccttaacccggggttaacctacgggggttaccgaaccggtaaacgcggtaacccttacccggttaacggttacccttaacccggttttcccccgttagttttaggccgttacccggg

SEQ ID NO: 45429 - DNA, 581 bp, Homo sapiens
  misc_feature: GYAE6OF01C6DWM.27.57.F02.1.454.CMB.1.raw
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (467)..(467): a, c, t, g, unknown or other
  misc_feature (467)..(467): n is a, c, g, or t
  modified_base (514)..(514): a, c, t, g, unknown or other
  misc_feature (514)..(514): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaggtgtccagtgtgaggtgcaactggtggattctggaggaggtgtgggtccagcctggagaatccctgagactctcctgtgcagcctctggattcctacctttagtagttattggatgagctgggtccnccagactccgaggggaagggctgggagttcgnggaccaaanataaaccagagtaggaaggtaaaagaaactagtggtaggactcgtaggtaggaagggccctaattccaaccaacttcctaccgaagaacgaaccaaacggccaaaaggacgtcaacgtgtanctgacaaatgaacacggcctaggagacgacccggaaggaccacggtntagtatacctagtaggtcgagtaggagtactaccgtagtacctacgtttcccgtattttgacttccg

SEQ ID NO: 45430 - DNA, 669 bp, Homo sapiens
  misc_feature: GYAE6OF01BDB8Z.27.57.F02.1.454.CMB.1.raw
  modified_base (302)..(302): a, c, t, g, unknown or other
  misc_feature (302)..(302): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttatggatgagctgggtccncagactccgaggggaagggctgggagttcgtggccaacactaaaccaagagtagggaaaggtaaaagaaaactagtaggtacggactcgtggtaggaaacggggccgtattaccgaacctattcctaccgaaggacgaaaccaaaccggaccaaaaggaacgtcctaacgttaggttaactacgtagaactaaatacgaaacgtacgaccctaggaagtaacggacccgggaagggaaccgtaccggggtcttaagggttaacttaacccggttaacgttacggtcggacggtaaggtaaccgtacgttacccgtaaggtttaccctaacgttttccccggttacttttttacggaagtttccccgg

SEQ ID NO: 45431 - DNA, 629 bp, Homo sapiens
  misc_feature: GYAE6OF01EOGES.27.57.F02.1.454.CMB.1.raw
  modified_base (312)..(312): a, c, t, g, unknown or other
  misc_feature (312)..(312): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctggaggaggtgtggtccagcctggagaatccctgagactctcctgtgcacgcctctggattctaccttttagtagtttattggatgagtcgtcggggtccnccgagcctccggaggggaacggggcgtggtagttcggcggaccaaactaacgtaaaccaagacgtagggaaaggtaaaacgaaaacgtatggtaggacttgtgtaggaacgggtacctagttccaacctatcctaccgagaacgaacaaaccggacaaaggaacgtctaccttagtactcgtagaacaaatcgaaacacgccgtaggagtaaccggccggaagaccgacggctaggttaactaccgtacttggcgaggacgtagtaccttccgttaacgttcttaaccgttcccgtttgttttcgcgtttacccggg

SEQ ID NO: 45432 - DNA, 777 bp, Homo sapiens
  misc_feature: GYAE6OF01DB4I5.27.57.F02.1.454.CMB.1.raw
  modified_base (184)..(184): a, c, t, g, unknown or other
  misc_feature (184)..(184): n is a, c, g, or t
  modified_base (198)..(198): a, c, t, g, unknown or other
  misc_feature (198)..(198): n is a, c, g, or t
  modified_base (378)..(378): a, c, t, g, unknown or other
  misc_feature (378)..(378): n is a, c, g, or t
  modified_base (602)..(602): a, c, t, g, unknown or other
  misc_feature (602)..(602): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacagtggaacgtgggctggagcgttgggttttccttgttgcttatttagaggtntccagtgtgaggtnacaacgtggtggtacttcgtagggaggtaggtgtcggtccaggtccgtagggaacgtaaccgtcccgtagtaacgtccttcctccgtggtcgaccgtaccgtcccttaggtggttaacttaccgttaaccgtttttaggtaagtttagttacggagttcggacggtcggtcgggtacccnccgtaagtaccggaccggaagggggtaacggtccgtaggtacgttcgggtacgaacctaacgtaaaacgtaaaccggaagtacggaaagggtaaagtaaaaacgtaaacgttggtacggtacggtacttacgtacgggtaacggaaccggtcctacgttaccacgtacgtccgacgaacgaagaacccgaaccaacgaaactacgtactaccgttagaccgttnaacgaaactacgaaccgtaacgcgtaacccgagggaccgaacggccggtaacgtacccggtagtacgttacgtaacctttacggtacgtcggtaacggaacgtcgtaaccgttaccgttcccttaggttaaccccgttacgttttaccgttacgttttgaccgttttacccgggg

SEQ ID NO: 45433 - DNA, 644 bp, Homo sapiens
  misc_feature: GYAE6OF01CAKBP.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcacgcctcgtaggtattcctacctttagtagttattggatgagcgtcgggtccgccagaccgtccgaggggaacgggctgggtagttcgtaggaccaaacaataaaaccgaagagtagggaaaggtaaaagaaaactagtaggtaggactcgtgtaggaacgggccgtattaccactatcctaccgaagaacgaaccaacgaacgaaagaacgtcacgtatactcgtacgaacaaagttacgaaacagtacctagggaaacggacggacccggaaaggacccgacgggtaccttaggttaaacttaaccgtacgttggtaacggacgaaggtaacgaccttacccgtaagtcccttacgtttacccgttcttttgacctttccggg

SEQ ID NO: 45434 - DNA, 602 bp, Homo sapiens
  misc_feature: GYAE6OF01DYDBP.27.57.F02.1.454.CMB.1.raw
  modified_base (497)..(497): a, c, t, g, unknown or other
  misc_feature (497)..(497): n is a, c, g, or t
  modified_base (528)..(528): a, c, t, g, unknown or other
  misc_feature (528)..(528): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttttagaggtgtccagtgtgaggtgcaactggtggattctggaggaggtgtggtccagcctgggagaatccctgagactctcctgtgcagcctctggattcacctttagtagttattggatgagcgtgggtccgccagactccgaggggaaggggctggagttcggtggaccaacaataaaaccgaagacgttagggaagggtaaaaagaaaacttagtaggtacggaacttcgtagtggaaacggggccctaattccaacctactacctccgaagacgaacaacgaccaaagaagtcaacgttgtactctagactaaatgaaacncgacctaggaagcggaccgacggacgacggngtacgtacgtactactggtagacgaggatactccgtaacgttcctaacgtttccgttcgtttttgcgtttccgg

SEQ ID NO: 45435 - DNA, 629 bp, Homo sapiens
  misc_feature: GYAE6OF01AOAE0.27.57.F02.1.454.CMB.1.raw
  modified_base (311)..(311): a, c, t, g, unknown or other
  misc_feature (311)..(311): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaactggtggattctggaggaggtgtggtccagcctggagaactccctgacgactctcctgtgcagcctcgtggacttctacctttagtagtttagttggatgagcgtcgggtccnccgagaccgtccgaaggggagggctgggagttcggtcgaccaaacaactaaaccgaaggaacgtagggaaaggtaaaaacgaaaactagtacggtaggaaccttcgtggtaaggaacgggaccgtaattaccaacctactcctaccaagaacgaaaccaacgaccgaaagaactacaccgttagtactcgtagaacaaagtacgaacacgaccgtagacggacggaccggaaggaaccgaggtctagtaactactacgtggtcgacgaggtacgacgttcctacgttacctactttacccgttcttttgcgttaccgg

SEQ ID NO: 45436 - DNA, 742 bp, Homo sapiens
  misc_feature: GYAE6OF01CQ79E.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttccttgttgctattttagagtgtccagtgtgagtgcaacgtggtggattcgtgggaggtaggtgtggtccagccgtaggagaactcccgtagacgtactcctccgtgtcgacacgtcctcgtggtattcctaccgttttagtagttagtggtatggtacgtcgtcgggtccaccgagaccgtaccggaggggaagggtcgtagggtacgttcggtacggaccaaaactaactaaaaccgaaggtaaggtaagggtaaaacggtaaaagtaaaaaccttagttagggtaacggtaacttcgtagggttaacgggaaacgggtacccgtaagttaccccgaaccttaaccgttaccctaacccggaaggaaccgaaaaccctaaacccggaaccgtaaaaggtaaccgttaccgtacgttacggtaactccggtaacgaactaaaagtacggtaaacgacgtacgtacggaacggaccggaaccggaacggtaccaccggtcttacgtaacgtaccttaggtcggtacgacggagtacgtaccttaccgtagttcctacgtttacccgtctttacgacgttcccggg

SEQ ID NO: 45437 - DNA, 633 bp, Homo sapiens
  misc_feature: GYAE6OF01BBM0R.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatcccctgagactctcctgtgcagcctctggattcacctttagtagtttattggattgagtcgtcggggtcccgccagacctccgaaggggaacggggctgggagttcggtggaccaaacataaaccgaagagtagggaaaggtaaaagaaaactagtagtaggacttcgtggtaggaacggggcctattaccaacctactctccgaagacgaacgaaaccgaccaaaggaacgtacaacgtgtaactctagactaaatgaacacgaccgtaggaacgagaccggaaggaccgacgggtactaggtaacttaccgtaacgttggtacggacgaaggacgtacgtttacccgtaaggttaccctacgtttcccgttcgttttttagcgtttacccgg

SEQ ID NO: 45438 - DNA, 614 bp, Homo sapiens
  misc_feature: GYAE6OF01AHNDT.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggacttcacctttagtagttatggatgagcgtcgggtccnccagacctccgaggggaagggctgggacgttcggtggaccaacataaaccaagacgtagggaaggtaaaacgaaaactgtcggtaggtactcgtggtacggaacgggtcccgtattccaacctatcctaccaaggacgaaaccaaaccggccctaaaaggtaacgtcctaacgttgtaactcgtacgactaaatcgaaacgcgaccttaggaagtacggccgaaggaccgacggtctaggtacttacgtacgtaggtgacgaggtacgacttaccgtagttcctactttcccggtcttttgactttccgg

SEQ ID NO: 45439 - DNA, 619 bp, Homo sapiens
  misc_feature: GYAE6OF01ARQ0N.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcaccttttagtagtttattggatgagcgtgggtccgccagactccgaggggaagggctggagttcgtggccaacataaaccaagatagggaaggtaaaagaaaactagtgtggactcgtaggtaggaacgggccgattaccgacctagtcctaccgaagacgaacaaccgccaaagaacgtccacgtgtactcgtgaacaatacgaacagcccgtaggaacgacgaccgaagggacccacgggtactaggttaactaccgttaacgtggttacggaccggtaaggaacgtacgttaccccgttaggttaccctaacttttaccccggttctttttaggctttacccggg

SEQ ID NO: 45440 - DNA, 650 bp, Homo sapiens
  misc_feature: GYAE6OF01BIU8R.27.57.F02.1.454.CMB.1.raw
  modified_base (533)..(533): a, c, t, g, unknown or other
  misc_feature (533)..(533): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctgggaggaggtgtggtccagccgtggagaactcccgtgagactctcctgtgcacgcctcgtggacttctaccttttagtagtttattggatggagtcgtcggggtcccgccagaccgtccggaagggggaacgggtccgtgggtacgtttcggtacggacccaaacgaataaaaccgaaggtaacgtagggaaagggtaaaacgaaaacgtgtaggtacggtactcgtaggtaggaacgggccctattccaacctatcctaccgaagacgaacgaaccgaccgaaagaacgtctaacttgtactctcgaacaaatagaaccngaccgtagaacggacgaccggaagggaccacggtctagtaactaacgtaccgtggtcgacggaaggaacggtactcccgttaacgtctaccgtttcccgtgttttacgcgttcccgg

SEQ ID NO: 45441 - DNA, 740 bp, Homo sapiens
  misc_feature: GYAE6OF01B21GU.27.57.F02.1.454.CMB.1.raw
  modified_base (722)..(722): a, c, t, g, unknown or other
  misc_feature (722)..(722): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctggaggaggtgtggtccagcctggagaactcccgtgagacctctcctgtcgcacgcctcgtcggtacttcctaaccttttagttaagtttagttcggatggacgtcgttcggggtcccgccgacggtaccgtccggaagggggtaacggggtcgttggggtacggttccggtacggaccccaaaactaacgtaaaaaccgaaggaacgttaaggggaaaagggttaaaaacgaaaaaccgttaggttaggtacggtaacttcgtaggtaggaaaccggggccgtaattcccgaaccgtacttacccgtaccgaaggtacgaaacccgtaaccggacctaaaaggacgttaccaacgttacgtactaccgtagaacctaaagtacgaaacgacgaccgttaggaacggacggacccggaacgggaccgtacggtactaaggttaacttaccgtaggttcggaggtacggaaggtactacgttaccgtacgttaccgttacgtttacccgttnttttggaccgtttccggg

SEQ ID NO: 45442 - DNA, 734 bp, Homo sapiens
  misc_feature: GYAE6OF01E2WZS.27.57.F02.1.454.CMB.1.raw
  modified_base (179)..(179): a, c, t, g, unknown or other
  misc_feature (179)..(179): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaaggtntccagtgtgaggtgcaactgggtggattctgggaggaggtgtggtccaggcctaggagaactccctgagactctcgtgtcgcacgcctctggacttctaacctttagtagttattcggattgagtcgtggggtcccacacgtaccgtccgaagggggaacgggtcgtgggtaggttcggtacggacccaaacgtaacgtaaaacccgaaaggtaagttacgggaaagggttaaaaacgtaaaaacgttaggtacggttacgggtaaccttcgtaggttacgggaaacgggtccgtaatttacccaacctaacgttacctaccgaacgaacggaaccgaaaccgaaccggtaaagaaacggttaccaacgttacgtacttactacggtaactaaagtctaaacgcgaccgttaggaacgtacggaccgacggaaccgtaccgggtactacggttaacgttaccgtaacgttagggtaccgtagggaaccgtaagggtacctttaccggttacggtaccttaactttccggtttaacttttcggtaacttacccggg

SEQ ID NO: 45443 - DNA, 719 bp, Homo sapiens
  misc_feature: GYAE6OF01DROK7.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgctattttagaaggtgtccagtgtgaggtgcaacgtggtggtattcgtgggaggtaggtgtggtccagccgtggagaactcccgtgacgactctcctgtgcacgcctcgtggtacttcctaccttttaagttagttagttggattggagtcgttcgggtcccgccacggaccgtccggaagggggaacgggcgtagggtagttccggtacggacccaaacgaaacgtaaaaccgaaggtaagtaagggtaaaaggtaaaaagaaaacttagtaggtaggtaacttcgtaggtacggtaacgggtccgtaacgttaccgaaccctacgttacctacccggaaggtaaaccgaaacccgaaacccggtaaccgaaaacggtaaacgtaccctaagtttacggttaacttaccgtacggaaactaaagttaacgaaaccgtacgtacccgtggaacggaccgggacccggaaggaaccgacggtcctaagtactaacgtacgtggtacgagagtcgtactaccgtagtacctcgtttaccgttctttagcttccgg

SEQ ID NO: 45444 - DNA, 712 bp, Homo sapiens
  misc_feature: GYAE6OF01ACEQN.27.57.F02.1.454.CMB.1.raw
  modified_base (236)..(236): a, c, t, g, unknown or other
  misc_feature (236)..(236): n is a, c, g, or t
  modified_base (691)..(691): a, c, t, g, unknown or other
  misc_feature (691)..(691): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctgganaatccctgagactctcctgtgcagcctctggattctacctttagtagttattggatgagtcgtcgggtccgcagacctccggaggggaacgggctgggagttcggtcggacctaacaacgtaaaccaagacgtaggggaaaggtaaaacgaaaacttgtgggttacgacgttctagggtacggaacggggtaccctagttaccaaccctagtacccgttaccaaagggtaccgaaacccgtaaaccggtaccaaaaggtaacggttacccgtaacttagggttacctaacgttaggaaccctaaaggttacggaaacccgcgtaccccgttaggaaacgggaccgtaacccgggaaacggtaccgtacggtaccttaaggtacttaacccggttagtacgggtcggaagacgggtactaccgttacccttagggtaccttaccggtttacccgtntttttaaaggcccttaccggg

SEQ ID NO: 45445 - DNA, 624 bp, Homo sapiens
  misc_feature: GYAE6OF01CLJYF.27.57.F02.1.454.CMB.1.raw
  modified_base (389)..(389): a, c, t, g, unknown or other
  misc_feature (389)..(389): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaggtgtccagtgtgaggtgcaactggtggattctgggaggaggtgtggtccagcctggagaatccctgagactctcctgtgcagcctcgtggtacttcctactttagtagttattggatgagtcgtcgggtccgccgagacctaccggaggggaacgggtctagggtagttcggtcggaccaacaactaaaaccgagagtagggaaagtaaaanaaactgtaggtacggacttcgtaggtaggaacgggtcctagttacccaacgtactcctaaccgaagaacgaaccaaacgtaccaaaaggtacgtcaacgttcgtaatccgtagaacaaagtgaaacgcgtaccgtaggaacggacgtaccggaagtaccggtacgcgtaggtaactactagtggtacggagagtacgtactacgttacgtctacgttccttagtttgacgttcgg

SEQ ID NO: 45446 - DNA, 661 bp, Homo sapiens
  misc_feature: GYAE6OF01BJF5Z.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaacgtggtggattcgtgggaggaggtgtggtccagccgtggagaactcccgtgagactctcctgtcgcacgcctcgtggacttcctaccgtttagtagttattggatggacgtcgtcgggtcccgccgagaccgtccggaggggaacggggtctagggtacgttcggacggaccaaacaactaaaccgaagagtaggaaaggtaaaacgaaactagtaggtacgtacgtgtaggtaggaacgggtctacttaccactactccgtacgagacgaaccaacgaccaaagaactcgaacgttagtactcgactaactaaatcgaacacgtaccgtaggaaggaaccggtaccgggaaaggaccgacggtacttagggtaacttacccgttacggttggacggaccggtaaggacgttacgttccgttaacgtcttaccgtttccgttcgttttagcgtttaccggg

SEQ ID NO: 45447 - DNA, 755 bp, Homo sapiens
  misc_feature: GYAE6OF01DEFGT.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccacatggaacgtggggctgagcttggttttccttgttgctattttagagtgtcagtgtgaggtgcacgtggtggattcgtgggaggtaggtgtggtccagccgtggagactccctgacgtactctcctgtgcacgtcctcgtggtacttcctacgtttagtagttagttaggatgacggtcggttcgggtccgaccgagtaccgtccggaagggggaagggccgtagggtacggtttcggacggaaccaaacgtaaactaaaccgaaggtaacgtaaggggtaaaacggtaaaaacgtaaaaacgtttagtacggttacggtaacgttcggttaggtaacgggaaccgggtaccgtaactttaccgaaaccctacgttacccgtaacccgaaggaaccgaaacccaaccggaaccgtaaaacggtaacgttacccaagtttacgtaacttcgtaacgtaacctaaagtacgaacgtacgaccggtaggaacggacggacccggaacggtaccgtaccggtacgttaactacgtaaccgttacgtacggtacggaacgacggtattaccgttacccgttacgttaccgttacgtttcccgtttacggtttgacccgtttcccgggg

SEQ ID NO: 45448 - DNA, 615 bp, Homo sapiens
  misc_feature: GYAE6OF01C6G6P.27.57.F02.1.454.CMB.1.raw
  modified_base (348)..(348): a, c, t, g, unknown or other
  misc_feature (348)..(348): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcttgggttttccttgttgctattttagagtgtccagtgtgaggtgcaacgtggtggattcgtggaggaggtgtggtccagcctggagaactccctgagactctcctgtgcagcctcgtggtacttcctacctttaagtagttagttggatgagtcgtcggtccgccagacctaccgaggggagggctggtagttcgnggaccaaagaactaaaaccgaagtagtaggaaaggtaaaacgaaaactagtgacggtactcgtaggtaggaacgggtacctagttaccaacgtaactcccgtacaaaggactaaacccgaacgaccgaaaagcgtacaacttgtaactctagaactaaatcgaacagccgtagacgacgaccggaagaccgacgacttagtaactacgtactggacgacgagtaacgtactccgtaacgtcttaactttccgttctttgcgttacgg

SEQ ID NO: 45449 - DNA, 733 bp, Homo sapiens
  misc_feature: GYAE6OF01CIUWZ.27.57.F02.1.454.CMB.1.raw
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcagcctctggattcaccttttagtagttattggatgagcgtgggtccnccagactccgaggggagggctggagttcgtggccaanataaaccgaagataggaagtaaaagaaaactatggtagactcgtagtagaagggccgtatttccgaaccctattccctaccgaaggtaacgaaccaaaccggacccaaaagggtaacgtcccaaacttggttaaacttccgtacgaacctaaaagttacgaaaccgtacggtaccccttagggaaaccgggtaccgggaccccgggaaaggggtaacccgaacccggggttaccgtttaacgggttaaacttaaacccgttaaccgtttaggggttaccgggaaccgggtaaaggtacggttaacctttaacccccggtttaaggttaacccctttaaccggttttttcccccggttaacgttttttttcgggaaacccgttttccccgggg

SEQ ID NO: 45450 - DNA, 766 bp, Homo sapiens
  misc_feature: GYAE6OF01BOYB0.27.57.F02.1.454.CMB.1.raw
  modified_base (646)..(646): a, c, t, g, unknown or other
  misc_feature (646)..(646): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacagtggaactgggctgagcgttgggttttccttgttgtcttagttttagaaggttgtccgaggtgtggaggtcgactaacgtgggtggtagttcgtaggggaaggtggttggtcggtaccgagtccgtagggaacgtaacctccccgtaggacgtacctccgttcccgtggtcgcctacggtccttggacggtacttccgttaaccgttttaggtagtttagttaggagtcggacgtccggttcgggcccaccgtagtaccgtccgggaaggggacgggtcgttagggtcgttacggcggaacctaaacgaacgtaaaaccgaaggtacggtaagggtaaaaaggtaaaacgttaaaacgtaggttacggtaacggtaacccttggtagggtaacggacgggtaccctaacttacccgaaccgttaccgttaccaacggaacgtaaacgaacccgaaaccgacgtaaacgacgtacctacggttatacgttacacgaactaaacgacgtaaacncgtacccgtaggaaccgtaggacccggacgtaccgacggtcttaggtaacctactacggtgtacgagacgtacgtacgtcgtaacgttcctaacggttttccgtctttgcgttacccggg

SEQ ID NO: 45451 - DNA, 614 bp, Homo sapiens
  misc_feature: GYAE6OF01DTAX8.27.57.F02.1.454.CMB.1.raw
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtcccagcctggagaactccctgagactcctcctgtgcagcctcgtggtacttcctacctttagtagttaattggatggagtcgtcgggtccgccagacctccgaggggagggctggagttcgngaccaanaactaaaccagagtagggaaagtaaaagaaaactagtgtaggactcgtagtaggaacgggcctaattccaactactcctaccaagacgaacgaaccgaaccgaaagacgtacactagtatcgtagaactaaatacgaacacgcctagggacgtacggaccgaaggacccgacggtcttaagtaactaccgttacgtggtagacggtaagacgttaactccgttagttcctaacgtttcccgtttactttcgtacttccggg

SEQ ID NO: 45452 - DNA, 901 bp, Homo sapiens
  misc_feature: GYAE6OF01DGEKF.27.57.F02.1.454.CMB.1.raw
tcagagcgtcgtctcacgaccggtgctcgatttagctcgatatagttgggtttgaggtctcagagaggagccttagcccctggactccaaggcctttccacttggtgatcagcacggagcacagaggacccaccatggaactggggctgagcgttgggttttccttgttgcttattttagaggtgtccagtgtgaggtgacaacgtggtggattcgtgggaggtaggtgtcggtccagcctaggagaactccctagacgtacctctccgtgtcgccacgtcccttcgtggtactttccgttaaccgttttaagttagtttagttgggattggacgtccggttccggggtcccgacccgaaggacccgtaccgggaagggggtaacggggtcttaggggtacggtttcggtaccgggaacccctaaaacgaacgttaaaaaacccgaaggtaaacggtaaaggggtaaaaaggttaaaaaacggtaaaaactttaggtttacgggtaaggttaacccgttaggttacgggttaacgggaaaccggggttccctaaacgttttacccgaaaccccgttacttacccgttaaaccccggaaggaaacccgtaaaccccggaaaacccggtaaaccccgtaaaaagggtaaacccggttacccgtaaaccgtttagggttaaaccttacggttacggaaaccttaaaacggtacggaaaaccgaccggtccggtaaagggaacgggtaccgaccccgggggaaaggaaccggacccggttcgttaaacgttaacctaaccgttacgttacgggttacgaaccgggtagtaaacggttaccccttaccgtaacggtttccgtaaccgtttttcccggtttaacgtttttggaacgtttacccgggg

SEQ ID NO: 45453 - DNA, 601 bp, Homo sapiens
  misc_feature: GYAE6OF01AOTJ6.27.57.F02.1.454.CMB.1.raw
  modified_base (480)..(480): a, c, t, g, unknown or other
  misc_feature (480)..(480): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
  modified_base (530)..(530): a, c, t, g, unknown or other
  misc_feature (530)..(530): n is a, c, g, or t
  modified_base (548)..(548): a, c, t, g, unknown or other
  misc_feature (548)..(548): n is a, c, g, or t
  modified_base (586)..(586): a, c, t, g, unknown or other
  misc_feature (586)..(586): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaggtgtcagtgtgaggtgcaacgtggtggattcgtgggaggaggtggtggtccaggtccgtgggaagaactcccgtgacgacctcctccgtgtgcacgcctcgtggtattcctaaccgttttagtagtttagttggatggagtcgttcggggtcccgccacggacctccggaagggggaacggggtctgggtacgttcggtcggaccaacaactaaaaccgaagagtagggaaaggtaaaagaaaactgtggtacggactcgtggtaggacggcctatcaccatcctcagacacaacgcaagacncatgatcaganaatcgaacngacgtagagacggaccgaggaccgacggtntagttactactacgtggngacggaagtacgtactaccgtagtacctagttcccttnttttcgagttcccgg

SEQ ID NO: 45454 - DNA, 794 bp, Homo sapiens
  misc_feature: GYAE6OF01AYS90.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaacgtggtggattcgtgggaggaggtgtggtccagccgtggagtaactcccgtagacgtactctcctgtcgcacgcccttcgtagtacttacctaacctttaaggttagtttagttggaagttggacggtccggttcggggtaccccgaccgtaacggtacccgtacccgggaagggggaacggggtccgtagggtacggtttaccgggtacggaaccccaaaacgtaaaccgtaaaaccgaaaggtacggtaaacggggtaaaagggtaaaaaacgtaaaaacgttaggtacgggttaacggtaaccgttacggttaggtaacgggtaaaccgggtacccgttaacgtttaacccgaaccgttaacgtttaccccgaacggtaaacggaaaccgaaacccgtaaacccggaccgaaaagtaaccggtacctaacgttcggttaactcgtaacgaaacgtaacgtaacgaacgcgtacgtaggaacggtaccgaccggaagaccgacggtctaagttacaccgttgtacggtacggaagacgtacgttaccgtcgttacgttaccttacgttccgtttacgtttagccgttacggg

SEQ ID NO: 45455 - DNA, 581 bp, Homo sapiens
  misc_feature: GYAE6OF01BP2D4.27.57.F02.1.454.CMB.1.raw
  modified_base (353)..(353): a, c, t, g, unknown or other
  misc_feature (353)..(353): n is a, c, g, or t
  modified_base (487)..(487): a, c, t, g, unknown or other
  misc_feature (487)..(487): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagacctctcctgtgcagcctctggacttctacctttagtagttattggatgagtcgtggggtccgccagactccgaggggaacgggcgtgggagttcgtggacccaanaactaaaccgaagagtagggaaggtaaaagaaactagtagtagactcgtagtaggaacgggccgtattccacctatcctaccagaacgaaccaaacgaccaaagaacgtcacgttgtatctgacaaatcgaacngacctgaagacgaccggaggacacggcgttagtacttactacgtgtcgagagtacgactccttaagtcctacgtttcccgtcttttgcttccgg

SEQ ID NO: 45456 - DNA, 626 bp, Homo sapiens
  misc_feature: GYAE6OF01DS314.27.57.F02.1.454.CMB.1.raw
  modified_base (312)..(312): a, c, t, g, unknown or other
  misc_feature (312)..(312): n is a, c, g, or t
  modified_base (565)..(565): a, c, t, g, unknown or other
  misc_feature (565)..(565): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactgggtggattctggaggaggtgtgggtccagcctgggagaactccctgagactctcctgtgcagcctcgtggtattcctacctttagtaagttattggatgagcgtgggtccncagacctccgaggggagggtctgggagttcggtggaccaacaactaaaccaagagtagggaaagtaaaagtaaactagtggacgtactcgtaggtacggaacgggtaccattaccaaccttactccctaaccgaagaacgaacccaaaccggacgaaaaggacttaccagttagtactcgtacgaaataagtacgaacgagcccgtaggacgacggaccggagaccgacggtcttaggtaacctagttaccgnggtacggagaggtaaacgtacttccgttagtaccttacgttccgtttacttgtcttccggg

SEQ ID NO: 45457 - DNA, 673 bp, Homo sapiens
  misc_feature: GYAE6OF01CGRCS.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaggtgtccagtgtgaggtgcaactggtggattcgtgggaggaggtggtggtccagccgtggagaactccctgacgacctctcctgtgcagcctgtgattctacctttagtagtttagttggatgagtcgtcgggtccgccagacctccggaggggaacggggtcgtagggtacggttcggtacggaccaaactaacgtaaaacccgaagaacgtaggggaaaagggtaaaaacggaaaaactttagtaggtaggaacctcgttaggtaggaaacggggccgtaacttaccgaacctactcctaccgaagaacgaaccaaaccgcaaaggacgtacacttagtactcgtagaactaatacgaacacggtacctaggaacgacggaccggaacggaaccgaccggtacgttagtaacgtaccgttacgtggtcggacggtaaggacgtaaccgttaccgttacgtaccttaacgtttcccgtacttttgactttcccggg

SEQ ID NO: 45458 - DNA, 633 bp, Homo sapiens
  misc_feature: GYAE6OF01DMZA5.27.57.F02.1.454.CMB.1.raw
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
  modified_base (463)..(463): a, c, t, g, unknown or other
  misc_feature (463)..(463): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtgggaggaggtgtggtccagcctggagaatccctgacgtactctcctgtgcagccctctggtattcctacctttagtagttattggatgngtctgggtccncagactccgaggggagggctgggattcggnggccaacactaaaaccgagatagggaaggtaaaagaaactagtggtggtactcgtgtaggaagggtccgaattccacctatcctaccgagacgaaccaacgaccaaagagtcacttgtacncgtacgactaaatcgaacgacgtcccgtaggaagtacgacccgggaaggtacccgacgggtccttaggttaactaccgttacgttcgggtacgtaccggaaggtacgtaacgtttaccctaacggtttaccctaacggtttccccgtttactttttgaacgtttacccgg

SEQ ID NO: 45459 - DNA, 708 bp, Homo sapiens
  misc_feature: GYAE6OF01CH0GK.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaactgggctgagtcttgggttttccttgttgcttattttagaaggtgtccagtgtgaggtgcaacgtggtggtattcgtgggaggaggtgtggtccagccgtggagaactccctagacgactctctgtgcacgcctgtggtacttctacctttagtagtttagttggatggacgtcgtcgggtcccgccagacctaccggaagggggtaacggggcgttagggtacggttccggtacggaaccctaaaacgtaaacgtaaaaacccgaaaggtaagtaaagggggtaaaaggtaaaaaacgtaaaaccgttagtacgggttaacggtaaccttcgtagggtaagggaaaccgggtaccgtaacttacccgaacctacttctacccgaaggaaccgaacccaaaccgaccgaaagaacgttcaacgttagtatccgtagaacctaaagtagaaaccgtacgaccgtaggaacggtacgaaccggaggaaccgcggtactcggtaactaccgttagtcggagaacggagacgtacttccgttagtccttacttccgttcttttagcttccgg

SEQ ID NO: 45460 - DNA, 684 bp, Homo sapiens
  misc_feature: GYAE6OF01B6RO0.27.57.F02.1.454.CMB.1.raw
  modified_base (667)..(667): a, c, t, g, unknown or other
  misc_feature (667)..(667): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggtttccttgttgcttattttagaaggtgtccagtgtgaggtgcaacgtggtggattcgtgggagggaggtgtggtccaggccgtggaagaactccctgagactctcctgtgcagcctcgtggtattctacctttagtagttagttggatggagtcgtcgggtcccgacgagacctccggaaggggaacgggcgtagggtacgttcggacggaccaaacaactaaaaccgaagtaagtagggtaaagtaaaacgaaaatcgtaggtcggaacttcgtaggtaggaaacgggcctattaccgactactacctaccgaaggaccaacgaaccgaaccaaaaggtactcctaaacgttgtactacgtaacgaacgtaaagtcgaaaaccgtcgaaccgtaggaacgtaccggaacccggaacggtaaccgacgggtcttaggttaactaaccgttacggtgtacgggacgaaagtgtaacctttaccgtacgttacccttacggttttaccccggttnttttacggcgtttccgg

SEQ ID NO: 45461 - DNA, 743 bp, Homo sapiens
  misc_feature: GYAE6OF01ADY4D.27.57.F02.1.454.CMB.1.raw
  modified_base (315)..(315): a, c, t, g, unknown or other
  misc_feature (315)..(315): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaaggtgtccagtgtgaggtgcaactggtggattctggaggaggtgtggtccaggcctggagaatcccgtgagactctctgtgcacgcctcgtggtatctacctttagtacgttattggatggagtccgttcggggtcccnccaggacctccggaaggggtaacggggcttgggagtttcggacggccctaaacaactaaaaccgaaggacgtagggaaagggtaaaacgaaaacttagttacggtaggtactacgtggttaacggaacggggtacctaacgtttaccaaccgtactaccgttaccggaagtaccggaaacaaaccggtaaccaaaggtaaacggtcctaacgttacggttaactaccggtacgtaacgaaagttaaccggaaaaccgtcggacccgttaggaacggtaccggtaccgggacgtaacggaccgggtacttacggtaccgttaaacgttacggtcggttaccgggaacggagttaacgggtaacgtttaccccgtacgggttacccttaggtttacccccgtttagtttttacgaacccgttttccgggg

SEQ ID NO: 45462 - DNA, 584 bp, Homo sapiens
  misc_feature: GYAE6OF01C9JFE.27.57.F02.1.454.CMB.1.raw
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (574)..(574): a, c, t, g, unknown or other
  misc_feature (574)..(574): n is a, c, g, or t
  modified_base (579)..(579): a, c, t, g, unknown or other
  misc_feature (579)..(579): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaactccctgacgactctcctgtgcagcctctggattctacctttagtagttattggatgagtcgtgggtccgccagactaccgaggggaagggcgtgggtacgttcggtcggacccaaacaataaaaccgaagaagtagggaaaggtaaaagaaaactagtgtaggtaactgtaggtaggaagggaccgtattccaacctactcctaccgaaggacgaaccaaacgaaccaaaggactcaacttgtaactctagaactaaagtcgaaacagcctaggaagcgacggagacacggtntagtanacgtngtcgagagtagactcgagtctacttccgtntttgnttcgg

SEQ ID NO: 45463 - DNA, 720 bp, Homo sapiens
  misc_feature: GYAE6OF01EGA00.27.57.F02.1.454.CMB.1.raw
  modified_base (182)..(182): a, c, t, g, unknown or other
  misc_feature (182)..(182): n is a, c, g, or t
  modified_base (267)..(267): a, c, t, g, unknown or other
  misc_feature (267)..(267): n is a, c, g, or t
tcagagcgtcgtctcacgaccggtgctcgatttagctcgatatagttgggtttgaggtctcagagaggagccttagccctggactccaaggtctttccacttggtgatcagcacggagcacagaggacccaccatggaactggggctgagcttgggttttccttgttgctattttagaggtntccagtgtgaggtgcaactggtggattcgtgggaggaggtgtggtccagcctggagaactccctgagactctcctgtgcagcctntggattcctacctttagtagttattggatgagtcgtcggggtcccgaccgagtaccgtacccgggaagggggaaggggtccgttagggtacggttcggtcgggtaacccaaacgtaactaaaaaccgaagaagtagggaaaggtaaaaagaaaacgttagttacgggtaggtaacttcgtaggttagggaaaacgggtcccgtaattacccaacccgtactttaccctaccgaaggtaaacgaaacccaaaccggaaccgaaaaggtaaccgtaccaaccgtttagtaactaccgtagtaactaaaagtacgaaaccaacggcctaaggaaccgacgggaacccgagggaaccaccgggtctaacggttaactaccgtacggtggtacggacggtaaggtacgtaacttaccgtacgttctaacgttttcccttacgttttgtacttacccgg

SEQ ID NO: 45464 - DNA, 703 bp, Homo sapiens
  misc_feature: GYAE6OF01CIT45.27.57.F02.1.454.CMB.1.raw
  modified_base (211)..(211): a, c, t, g, unknown or other
  misc_feature (211)..(211): n is a, c, g, or t
  modified_base (649)..(649): a, c, t, g, unknown or other
  misc_feature (649)..(649): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtcagtgtgaggtgcaacgtggtggattcgngggaggaggtgtggtccagcctggagaactccctggacgactctcctgtgcagcctcgtggtacttccgtaaccttttagtagttattggatggagtcgtcgggtcccgccaacggtacctccggaagggggaacggggtctaggggtacgtttcggtacggacccaaacgtaactaaaaccgaagtaagtagggaaaggtaaaaagaaaacttagtaggtaggtaccttgtaggtaggaacgggtaccgtacttaccgaacctacgtccgtacccgaaggtaaccgaaaccgaaaccggaacccgtaaaaggtaacgttactaacgttagttaacgtaccgttacggaaactaaaagtaccgaaacgacgtacccgtaaggaacggtacggacccgggaaggaccgacggtcttaggtaactaccgtagtggtacgnggaacgtagtacttaccgtagtaccttacgtttccgttcgtttgtagttcccgg

SEQ ID NO: 45465 - DNA, 731 bp, Homo sapiens
  misc_feature: GYAE6OF01CPPH9.27.57.F02.1.454.CMB.1.raw
  modified_base (322)..(322): a, c, t, g, unknown or other
  misc_feature (322)..(322): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagagtgtccagtgtgaggtgcaactggtggattcgtgggaggaggtgtcggtccaggcctggagaactccccgtgacgacctctcctggtgcacgcctcgtggtacttcctacctttagtagtttagttggatgacgtcgtcgggtccnccacgacctccggaagggggtaacggggcgtagggtacggttccggtcggaccaaacgtaactaaaaccgaagtaacgtaaggggaaaggtaaaaacgaaaacttgtaggtaggtaacctcgtaggtacgggaaacggggtccgtaatttacccgaacctactaccgtaccgaaggtacgaaaccaaccgaaccgaaaacgaacggtcctaacgttgtaactcgttacgaactaaacgtaacgaaacgcgtaccggtaggaaccgggacggaacccgggtaacggaacccgggtacggtacgttacgttaaacgtaccgttaccgtaggtccggaacggtaaaggcggttaacgtaccctttacggtaacctttaccgtttaccggtttcttttacggtatttcccggg

SEQ ID NO: 45466 - DNA, 711 bp, Homo sapiens
  misc_feature: GYAE6OF01B2GY8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttccttgtgctatttagagtgtccagtgtgaggtgcaactggtggattcgtgggaggaggtggtggtccagcctggagaactccctgacgactctcctgtcgcacgcctcgtggtacttccttacctttagtagttattgggatggacgtcgtcgggtcccgccgacgaccgtccggaagggggaacggggtccgttggggacggtttcggtcggaccccaaaacgaacgttaaaaaccgaaggtaagtaagggtaaaaggggtaaaaagtaaaaccgtagtaggttaggtaaccttcgtaggtaacgggaaacgggtcccgtaacttaccgaaccctacgttcctaacccgaaggtaaccgaaaccgaaaccgaccgaaaaggtacgtaccaacgttaggtaactacgtacgaactaaaagtacgaaacacggacccgtaggaaacgaccggaccgggtaaggaacccggaccggtcttaaggtaactaccttacggtggtacgacggtagacgtacgtacctacgtctacttaccgttcttttagcgttaccgg

SEQ ID NO: 45467 - DNA, 710 bp, Homo sapiens
  misc_feature: GYAE6OF01EV7Q5.27.57.F02.1.454.CMB.1.raw
  modified_base (177)..(177): a, c, t, g, unknown or other
  misc_feature (177)..(177): n is a, c, g, or t
  modified_base (208)..(208): a, c, t, g, unknown or other
  misc_feature (208)..(208): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggtttcctgtgctatttagaggtntccagtgtgaggtgcaacgtggtggattcgnggaggaggtgtggtccagccgtggagaactccctgacgtactctcctgtcgcacgtcctcgtggtacttcctaaccgttttagttagtttagttggaatggacgtcgtcggggtcccgcaggaccgtccggaagggggaacggggtcgtgggtacgttcggtacggaccaaacgtaactaaaccgaaagtagtagggaaaggtaaaaacgaaaacttagtaggtacggtactacgtaggtacggaacgggccgtaattaccgaaccgtacttaccgtaaccgaaggaacgaaccgaaacggtaccaaaggtaacgtacctaacgttagtaactacgtagaactaaagtcggaaacacggaacctacggaacggtaccggaaccgggaacggaacccgacgggtacttaacgggtacttaaccgtaagtcggtacggacgaacggtaagtacctaccgttaacgtacccttacgtttacccggttcgttttagcgttacccgg

SEQ ID NO: 45468 - DNA, 595 bp, Homo sapiens
  misc_feature: GYAE6OF01AYD34.27.57.F02.1.454.CMB.1.raw
  modified_base (306)..(306): a, c, t, g, unknown or other
  misc_feature (306)..(306): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggacttctacctttagtagttattggatgagcgtgggtccnccagactccgaggggaagggctgggagttcggtggaccaacaataaaccgaaagagtagggaaggtaaaagaaaactagtagtaggactcgtgtaggaacgggccgtattccgaacctattcctaccaagaacgaaccaaaccggacccaaaagtaacgtcccaactgtaatctagaaccaaatcgaaacacggacctaggaacgacggccgaaggaccacggctagtaactactacgtggcgagaggcgtactcccgtagtcctacgtttccgtcttttggacttccg

SEQ ID NO: 45469 - DNA, 671 bp, Homo sapiens
  misc_feature: GYAE6OF01ANRAG.27.57.F02.1.454.CMB.1.raw
  modified_base (174)..(174): a, c, t, g, unknown or other
  misc_feature (174)..(174): n is a, c, g, or t
  modified_base (208)..(208): a, c, t, g, unknown or other
  misc_feature (208)..(208): n is a, c, g, or t
  modified_base (616)..(616): a, c, t, g, unknown or other
  misc_feature (616)..(616): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgtggtttctgtgctatttagagtntcagtgtgagtgcacgtggtggattcgtggaggnggtgtcggtccagccgtggaagaactcccgtagacgtacctctcctgcgcacgtcctgtggtacttcctaccttttagtacgtttagtggactggagtcggttcggcccaccgacgtaccgtaccggaaggggaaggggtcgttgggtacgttcggacggaaccaaactaactaaaccgaaggaagtaagggaaaaggtaaaacgtaaaagtgtaggtacggtaacttcggtaggtaaggaccggtcctagttaccacgtacttccgacgaagaacgaaccgaactaacgaaagtaccgtactaacggtagttacgtcgtaaccgtaataaacgtacgaactcgtacggagacggaccgtaccgggataccggacgtactagttaacgttacgacggttggacggtanaagtcttaccgtacgttagtcccttacgtttcccggttatttcgacgttcccggg

SEQ ID NO: 45470 - DNA, 604 bp, Homo sapiens
  misc_feature: GYAE6OF01CC191.27.57.F02.1.454.CMB.1.raw
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcttgtgctatttagaggtgtccagtgtgaggtgcaactggtggattcgtgggaggaggtgtggtccagcctggagaatccctgacgactctcctgtgcagcctctggtattcctaccttttagtagttattggatgagcgtgggtccncagctccgaggggagggntggagttcgnggaccaacgataaaccgagagtaggaaggtaaaagaaactagtggtacggtactcgtaggtaggaacggggcccgtaatttaccgaacctatacccgtaccgaagacgaaccaaacgaccgaaagacgtacacgttagtactctagaacaaatacgaacagaccgtagaacggacgaccggaaggacgacgggtactaggtactaccgtagtgtcgacggagacgtactaccgttacgtacttacgttcccttacttttggacttccgg

SEQ ID NO: 45471 - DNA, 691 bp, Homo sapiens
  misc_feature: GYAE6OF01C2AO1.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttcctgtgtctatttagaggtgtccagtgtgaggtgcaacgtggtggtattcgtggaggaggtgtggtcaggcctaggagaactccgtagacgactcgtcctgtcgcacgtcctgtggtattctactttagtacgttattaggatggagtccgtcgggtcccgaccaggacctccggaaggggtaacgggcgttagggagtttccggaggaccaaaacgtaagtaaaaccgaaggtagtaagggaaaggtaaaagtaaaacgtagtacggtacggtaactggtagtagggaaacgggtcgtaattacccgaacctacgttacctaaccgaaggaacgaaacccgtaaaccggaccaaaagggtaactccgaacgttagtaactcgtagtaaacctaaagtaccggaacgtacgtaccgtaggaaaccggtggaaccccgtaagggaccctacggggtacctttaggtacctaacgttacgtgtacggacgaggactactccgtaagtcccttagtttcctactttgaacgttcgg

SEQ ID NO: 45472 - DNA, 661 bp, Homo sapiens
  misc_feature: GYAE6OF01BHUWV.27.57.F02.1.454.CMB.1.raw
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagccttctggattccacctttagtagtttattggatgagcgtgggtccncagcctcgaggggagggctggagttcggtgaccaanataaaccaagagtagggaaaggtaaaagaaaactagtggtacggtactcgtaggtaggaaacggggtcccgtaatttaccaacccgtattaccctacccgaaggaacgaacccgaaaaccggacccgaaaaaggtaacgttaccaacgttacggtaacttacgtagaacctaaaagtccgaaacgacgtaccgtaggacggacgtaccggaggtaaccgaccggtcgtagtacttaaccgtacgttggtacgacgggaagtaacgtaccttaccgttacgttcctaacgttttcccgttatttttagctttacccggg

SEQ ID NO: 45473 - DNA, 832 bp, Homo sapiens
  misc_feature: GYAE6OF01BOFTP.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttattttagaaggtgtccagtgtgaggtgcaacgtggtgtattcgtgggaggtaggtgtcggtccagccgtaggactaacttccctagacgtaccttccgtcctggtacgccacgtccctcgtaggtactttacctaaccgtttttagttaagtttacttgggtaattcggagccgttcggggtcccgaccgtaacggtaccgtacccgggaagggggtaacggggtcgttaggggtacgtttccgggtaccggaaacccctaaaagtaaaccgttaaaaccgaaaggtacggttaaaggggaaaaacgggttaaaaacgtaaaaacgttggttagggttaaccggaactttcggtaagggttaacgggaaccggggtaccctaagttacccgaaccgttaacgttaccccgtaacggaacggtaacccgaaacccaaaccgtaacccgaaaaaggttaaacccgtccgttaaacgttcggttaacttacccgtaagtaaactaaacgtaccggaacctacggtaaccctagggaacgtaacccggaccggtaacgggaaccgttacgggtacttagttaacctaccgttagtcggtaacgaggtaacgtactacgttaccggtacgttccgttaacgtttccgttcgttttggtccgtacggg

SEQ ID NO: 45474 - DNA, 627 bp, Homo sapiens
  misc_feature: GYAE6OF01BNXH5.27.57.F02.1.454.CMB.1.raw
  modified_base (308)..(308): a, c, t, g, unknown or other
  misc_feature (308)..(308): n is a, c, g, or t
  modified_base (615)..(615): a, c, t, g, unknown or other
  misc_feature (615)..(615): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatggagcgtggggtcccnccagacctccgaaggggaaggggctgggagttcggtggaccaaacactaaaaccgaagagtagggaaaggtaaaagaaaactagtaggtaggactcgtaggtaggaaacgggcccgtaatttccaaccctattccctaccgaaggaacgaacccaaaccggcccaaaaggaaacgtcaaccgttgtaactctacgaacaaaagtcgaaacacgcccgtaggaacggaaccgcccggaaggaccacgggtctaggtaactacgtacgtggtgacgaggacgtacttcccgtagttcctatttcccgtnttttgcttccgg

SEQ ID NO: 45475 - DNA, 812 bp, Homo sapiens
  misc_feature: GYAE6OF01A5WZF.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtggattcgtgggaggtaggtgtggtccacgtccgtggaagtaactccccgtggacgtactcctccgtggtcgcacgtcccttcgttggtactttccttaaccgtttttaaggttaaggttttagttagggtattggaacggtccggttccggggtccccggaccgaacggtacccgttaccgggaaggggggaacggggtcggttaggggtacggtttccggtacggaacccaaaacgtaaacgtaaaacccgaaaggacggtaaaggggtaaaagggtaaaaaacgaaaacgttaggttacgggttacggtaacttcgggtagggttaagggaacgggtacctaacgtttacccacctagttacccctaacgaaggacaaacccgaaaccgaccgtaaaagaaccgtcgaaccttggtaacctacgtacgaaacgtaagtaacgaaccgacgtaccgtaaggaacgaccggtaaccggacgggaacccgtcgttaccgttaagttaacccgttaaccgttaacggttaggtccggacggtaagaccggtaccttacgtaccggtttaccctacttttacccggttattttccggacgttacccgg

SEQ ID NO: 45476 - DNA, 694 bp, Homo sapiens
  misc_feature: GYAE6OF01CFO0X.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaacgtggtgattcgtggaggtaggtgtggtccagcctggagaactccctgacgactctctgtgcacgcctcgtgacttctacctttagtagttatggatggagcgtcgggtcccgccgacgtactccggaaggggaacggggctagggtacgttcggtcggaccaaacgaacgtaaaaccgaagagtaagggaaaggtaaaacgaaaacgtagtaggtaggtacttcgtaggtaggaacggggcctaagttcccaaccgtacgttcccaacgaaggacgaaacccgaaaccggaacccgaaaagtacgtaccctaacgttagtaacttcgtaacggaaactaaaacgtacggaaacgccggtaccgtaggaacggaacccgggaccggaacggaccgtacgggtacgtacgttaactaccgttacgtagggtcggaagaggtaacgtacgttacccgttagtaccttacgttccggtttctttcggaacttccggg

SEQ ID NO: 45477 - DNA, 648 bp, Homo sapiens
  misc_feature: GYAE6OF01E4BZQ.27.57.F02.1.454.CMB.1.raw
  modified_base (305)..(305): a, c, t, g, unknown or other
  misc_feature (305)..(305): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtcgggtccnccagactccgaggggaacggggctgggacgtttcggtggaccaacaactaaaaccgaagagtagggaaaggtaaaagaaaactagtaggtaggacttcgtggtaggaacgggtccgtattaccacctatcctaccgagacgaaccgaacgaccaaagaacgtacaacgttagtactccgtagaacctaaagtacgaaacgacgtaccgtaggaacgggaccggaccgggaacgggaacccgaccggtacgtaggttacttaaccgttacgtcggtcggacggaaggacggtacttacccggttaacgtccttacgtttacccgttcctttttggactttccgg

SEQ ID NO: 45478 - DNA, 712 bp, Homo sapiens
  misc_feature: GYAE6OF01B064L.27.57.F02.1.454.CMB.1.raw
  modified_base (262)..(262): a, c, t, g, unknown or other
  misc_feature (262)..(262): n is a, c, g, or t
  modified_base (312)..(312): a, c, t, g, unknown or other
  misc_feature (312)..(312): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaactgggtggattcgtgggaggaggtgtggtccagcctggagaactcccgtgagactctcctgncagcctctggtattctaccgtttagtagttatggatgagcgtcgggtccncacgaccgtccgaaggggacgggcgtgggtagttcggtggaccaaactaacgtaaaccgaaggagtagggaaaggtaaaagaaaaagtagtaggtaggtactcgtaggtaggaacgggcctacgttaccaaccgtactaccgtaccgaagaacgaaccgaaaccggaccaaaaggtaacgtacctaacgttagtaacttacgtaaggtaactaaaagttacgaaaccgtacgtaacccgtagggaacgggtaccgggaaccggtaacgggaacccgtaccgggaccttaaggttaaccttaaccgttacggttaggtacgggaccggaaaggtaccgtaaccgtttacccgtaacgttaccctacgttttcccggtttagtttttcgaacgtttcccggg

SEQ ID NO: 45479 - DNA, 787 bp, Homo sapiens
  misc_feature: GYAE6OF01DZXTR.27.57.F02.1.454.CMB.1.raw
tcagagcgtcgtctcacgaccggtgctcgatttagctcgatatagttgggtttgaggtctcgagagaggagccttagccctggactccgaaggcctttccacttggtgatcagcacggagcacagacggacccaccatggaacgtggggctggagtcgttgggttttccttgttgccttattttagaaggtgtccagtgtgaggtgactaacgtggtggtattcgtgggaggaggtgtcggtccagtcctggagaactcccgtagacgactctctgtgcacgtcctgtggtacttacctacgtttagtagttagtggatcggacgtcgtcgggtcccacgtaggtaccgtccggaggggacgggtctagggtacgttcggtacggaccctaaactaacgtaaaccgaaggtaagttaacgggtaaaacggttaaaaacgtaaaccgtaggttacgggtacgtaacgttccgtaagggtaacggtaaccgggtacccgttaacttacccgaacctacgttccctaaccgaacggaaccgtaaaccgaacggtaaccgaaaggtaccgttcctaacgtttaagtaccgttacgtacgaacttaaaacgttacgaaaccgtacggtacccgtaaggaaccgggtaccgggtaacccgggtaacgggaaccgtaccgggttaacgttaggttaaaacccgtacggttaccgtgggtaccggtacggaacggtacgtaccgttacctacgggttaccttccttaccggtttactttgaacccgtttcccggg

SEQ ID NO: 45480 - DNA, 693 bp, Homo sapiens
  misc_feature: GYAE6OF01DEHMD.27.57.F02.1.454.CMB.1.raw
  modified_base (216)..(216): a, c, t, g, unknown or other
  misc_feature (216)..(216): n is a, c, g, or t
  modified_base (327)..(327): a, c, t, g, unknown or other
  misc_feature (327)..(327): n is a, c, g, or t
  modified_base (557)..(557): a, c, t, g, unknown or other
  misc_feature (557)..(557): n is a, c, g, or t
tcagagcgtcgtctcacgaccggtgctcgatttagctcgatatagttgggtttggaggtctcagagaggagccttagccctggactccaaggcctttccacttggtgatcagcacggagcacagacgacccacagtggaactgggctgagtcttgggttttccttgtgacttagtttagaaggtctccagtgtgaggtgcaacgtggtggattcgngggaggaggtgtcggccagcctaggacaactccctagacgtacctctccgtggtgctagccctgtggtacttactacctttagtacgttagttggatgacgcgtcggtccncacgtaccgacggaaggggacggctagggtacgttcggacggaaccaaacgaaacgtaaaccgaagtacgtaaaggggaaacgtaaaaacgtaaaacttgtacggtacggtaacttcggtaggttaacgggaaaccggtccgtaacttacccgaaccttagtcccgaccgaaggaaccaacgaaccgaccgaaaagacgtacctacgtagtacgtacgtagaacgtaaanaccgaaactcgacccgtaggaaccgtaccggaaccggagaacccggtacgtacgttacgttaatacccgtagtacggtaacgcggaaacgtgtaacccgtcgttaacgcttaacgtttcgtctttagccgtttcgg

SEQ ID NO: 45481 - DNA, 703 bp, Homo sapiens
  misc_feature: GYAE6OF01DKOO8.27.57.F02.1.454.CMB.1.raw
  modified_base (339)..(339): a, c, t, g, unknown or other
  misc_feature (339)..(339): n is a, c, g, or t
  modified_base (372)..(372): a, c, t, g, unknown or other
  misc_feature (372)..(372): n is a, c, g, or t
  modified_base (692)..(692): a, c, t, g, unknown or other
  misc_feature (692)..(692): n is a, c, g, or t
tcagagcgtcgtctcacgaccggtgctcgatttagctcgatatagttgggtttgaggtctcgagagaggagccttacgccctggacctccaaggccctttccacttggtgatcagcacggagcacagaggacccacatggaactgggctgagctggtttcctgtgctatttagagtgtccagtgtgaggtgcaacgtgggtggattctgggaggtaggtgtggtacccaggtcccgtggagaactccccgtggacgtacctcgtcctgtacgcagccctcgtaggtactttcctacctttttagtagtttagttcggattcggagtcgttggggtcccnccgtagacctccgaggggtaacgggctagggtnttacggtcgaccctaagaactaaaccagagtacgggtaaaggttaaaacgaaacttagtaggtcggacttcgtacggtaggaacgggacctatttaccgacctaacgtccctaaccgtaaggacgaaacgacccgtaaccgaaaagggtaccgttccaacgttacggtaactaccggttacggaaacttaaaggtacgtaaacacggtacccgttaaggacggtaccgggaccggtacggaaccgtaccggtgttaacgttacgtaacccttacggtggacgacgttaggaccgttactccgtacgtctaacttcccgtntttagctacgg

SEQ ID NO: 45482 - DNA, 560 bp, Homo sapiens
  misc_feature: GYAE6OF01BTWR5.27.57.F02.1.454.CMB.1.raw
  modified_base (464)..(464): a, c, t, g, unknown or other
  misc_feature (464)..(464): n is a, c, g, or t
  modified_base (513)..(513): a, c, t, g, unknown or other
  misc_feature (513)..(513): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctgggaggaggtgtggtccagcctggagaatccctgagactctcctgtgcagcctctggattcacctttagtagttattggatgagcgtgggtccgccagacctccgaggggaacgggctgggagttcggcggaccaacgactaaaaccaagactagggaaggtaaaagaaaactatggtagactacgtgtaggaacgggccgtattccgaccatcctaccgagacgacaacgaccaaagagtacactgtactcanacaatgaacagcctagacgacgccgaaggacacggctgtactactacgngtcgacgagcgtactccgtagtcctacgttccgtcgtttgcttccgg

SEQ ID NO: 45483 - DNA, 793 bp, Homo sapiens
  misc_feature: GYAE6OF01C4Y2G.27.57.F02.1.454.CMB.1.raw
  modified_base (783)..(783): a, c, t, g, unknown or other
  misc_feature (783)..(783): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcttgggttttccttgttgcttattttagaggtgtccagtgtgaggtgcaacgtggtggattcgtgggaggaggtgtggtccagcctggagaatccctgagactcctcctgtcgcacgccttcgtggtacttcctaaccttttagtagttagttggatggagtccgtcgggtcccgccagaccgtaccgagggggaacgggcgtagggtacggttccggtcggacccaaaacgaactaaaaacccgaaggtaacgttaaggggaaaaagggttaaaaaagtaaaaaccgtttaagttcgggtaacggtaacccttacggtttagggtaacggtaaaccggggtacccgtaacgtttacccgaacccgttaaattcccccgtaaccgaaagggaaaccggtaaaccccgaaaacccggtaaccgtaaaaacggtaacgttacccgtaaaccgtttggttaaaccgttccgttaaggtaacctaaaaacggttacgaaaccgtacggtacccgtagggaaacgggaccggacccgggaagggacccgtaacgggcgtttaagtaaccttaccgtacgttaggtccggagtaacgagttaccttacctacggtccttacgtttcccgttacgtttnaccgttcggg

SEQ ID NO: 45484 - DNA, 561 bp, Homo sapiens
  misc_feature: GYAE6OF01AYDZI.27.57.F02.1.454.CMB.1.raw
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (469)..(469): a, c, t, g, unknown or other
  misc_feature (469)..(469): n is a, c, g, or t
  modified_base (548)..(548): a, c, t, g, unknown or other
  misc_feature (548)..(548): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgaggggagggctggagttcgtggaccaanactaaaccaagatagggaagtaaaagaaaactagtaggtaggactcgtaggtaggaagggccgattccaaccatcctaccagagaaccaacgcaaagacgtacaactgtactcgagacaaatgaaacngaccctagaacgacgccggagacacggctacgtaactacctacgtgtacgagagagactccgtaagtctagtttccctnttttgacttccgg

SEQ ID NO: 45485 - DNA, 628 bp, Homo sapiens
  misc_feature: GYAE6OF01CHAE3.27.57.F02.1.454.CMB.1.raw
  modified_base (335)..(335): a, c, t, g, unknown or other
  misc_feature (335)..(335): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaacgtggtggattctggaggaggtgtggtccagcctggagaatccctgagactctcctgtgcagcctcgtggacttctacctttagtagttattggatgagcgtcggggtccgccagacctccgaggggaagggctggngttcgtggaccaacataaaccgagaagtagggaaaggtaaagaaaactagtaggtaggactcgtggtaggaacgggcccgtattccgaccattccctaccgagaacgaaccgaacgaccaaagaacgtacaacgttgtactacgtagactaaagtcgaaacagtacccgtaggaaccggtacggacccggaagggacccgtacgggtaccttaggtaacttacgttacgtgtcggacgagtacgtaccgttacgtagttaccttacgttacccgtttctttaggtcgttccgg

SEQ ID NO: 45486 - DNA, 741 bp, Homo sapiens
  misc_feature: GYAE6OF01BW00U.27.57.F02.1.454.CMB.1.raw
  modified_base (313)..(313): a, c, t, g, unknown or other
  misc_feature (313)..(313): n is a, c, g, or t
  modified_base (648)..(648): a, c, t, g, unknown or other
  misc_feature (648)..(648): n is a, c, g, or t
  modified_base (724)..(724): a, c, t, g, unknown or other
  misc_feature (724)..(724): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgctattttagaagtgtcagtgtgaggtgcaagtggtggattcgtgggaggaggtgtcggtccagccgtaggagaactccgtgacgtactctctgtcgcagcctgtggtattcctaactttagtattattggatggagcgtggtccgngacgtaccgccggaaggggaacggtcgtaggtacggttcgtacggaccaaacgtaaacgtaaaaccgtaaagtaagtaaggggtaaaaggttaaaaaacggaaaaacgttagtaagggttacggtaaaccgttcggtaaggtaacggggaaacgggtcccggtaatttaacccgaacctataacccgttacgaacggaaacgaacccgaaaccggtaacccaaaaaggtaacgttaaccaacgtttaacggttaagtaccttacgaaacgtaaatacgggaaacctacggacctaaggaacggtaaccggaaccggaacggggaacctacccggngttaggaaaccttcgtaagtccggtagggaacgtaaggacgaacttaccgtaacgttcctaacttttcccggtttntttaagcgtttaccggg

SEQ ID NO: 45487 - DNA, 737 bp, Homo sapiens
  misc_feature: GYAE6OF01BZMDF.27.57.F02.1.454.CMB.1.raw
  modified_base (608)..(608): a, c, t, g, unknown or other
  misc_feature (608)..(608): n is a, c, g, or t
  modified_base (726)..(726): a, c, t, g, unknown or other
  misc_feature (726)..(726): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaactggtggattctgggaggaggtgtggtccagcctggagaatccctgagacctctcctgtgcagcctcgtggtattcctacctttagtagtttattggtatggacgcgtcggggtcccgccgaacgaccgtaccggaagggggaggggtcgtgggtaggttccgggtacggacccctaaaacgtaaactaaaaaccggaagtaaggtaacggggtaaaagggtaaaaacgaaaaacgtttaagttaggtacggtaaccgttacgtagggttacgggaaaccggggtcctaacgtttaccacccgtattaccctaaccgaaggaaccgtaaacccgaaaccgaccggaaaacggtaaacggttcctaacgttaggttaacttacggtacgaaactaaacgtaccgtaaancggttaccgtagaaccgggaacggccggaacggaccgtaccggtcttaggttaactacccgtagtacggtcggacggagtaacgtcttcgtacgttctaccgttttccgttacgtttntaccgttccgg

SEQ ID NO: 45488 - DNA, 683 bp, Homo sapiens
  misc_feature: GYAE6OF01CIUQU.27.57.F02.1.454.CMB.1.raw
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaggtgtccagtgtgaggtgcaacgtggtggattcgtgggaggaggtgtgggtccagcctggagaactccctgagctctcctgtgcacgcctcgtggattctaacctttagtagttagttggatgagcgtcgggtcccnccgagacctccggaagggggaacgggtcgtgggtagttcggtcggaccaaacgaactaaaaccgaagagtagggaaacggtaaaaagaaaactagtggtaggtaactcgttaggtaggaaacggggccgtaatttacccaacctactccgtaccgaagaacgaaccaaccgaccgaaaaggtaacgtacaacgttggtaactcgtagaactaaagtacgaaactacgaccgtggaacggacgaccggaagggaaccgaccggtcttacgttaactaccgttacgtcggtacggacggaagtaacggtacttacccgttacgggttaccttaaccgtttcccgtttacgtttttaggaccctttacccggg

SEQ ID NO: 45489 - DNA, 541 bp, Homo sapiens
  misc_feature: GYAE6OF01EHFNH.27.57.F02.1.454.CMB.1.raw
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (507)..(507): a, c, t, g, unknown or other
  misc_feature (507)..(507): n is a, c, g, or t
  modified_base (536)..(536): a, c, t, g, unknown or other
  misc_feature (536)..(536): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagagtgtccagtgtgaggtgcaactggtggattctgggaggaggtgtggtccagcctggagaatccctgagactctcctgtgcagcctctggattcacctttagtagttattggatgagctgggtcccgccagactccgaggggaggggctggagttcgnggccaanataaaccaagataggaaggtaaaagaaaactataggtggactcgtgtaggaagggccgtattccacatcctacagacgacaacgaccaagaacgtcgactgtatctagacaatgaacagacctgagacgaccgaggacacggctagtactactagtggtcgagagngactcctacgtctacttaccgtcttttgnttccg

SEQ ID NO: 45490 - DNA, 655 bp, Homo sapiens
  misc_feature: GYAE6OF01AKHV8.27.57.F02.1.454.CMB.1.raw
  modified_base (329)..(329): a, c, t, g, unknown or other
  misc_feature (329)..(329): n is a, c, g, or t
  modified_base (541)..(541): a, c, t, g, unknown or other
  misc_feature (541)..(541): n is a, c, g, or t
  modified_base (639)..(639): a, c, t, g, unknown or other
  misc_feature (639)..(639): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcttgggttttccttgttgtcttattttagaaggtgtccagtgtgaggtgcaacgtggtggattcgtgggagggaggtgtcgggtccaggcctggagaactcccgtgagtacctcctcctgtgcacgcctgtggtacttcctaccttttagtagtttatggatgagtcgtcgggtcccncgagtaccgtaccggaggggacgggtctagggtacgttcggacggaccaaactaactaaaccgaagagtagggaaaggtaaaagaaacgtagtggtacggtactacgtaggtaacggaacgggtacctattacccgactagtcctacgaaggaccaaccaaccgaccaaaggtaactccagttacgtaactacgtagaactaagtacgaacncgtaccaggaacggtaccgacggaggaacctcggtcttaagtactacttggaggcggagagtacgtcttaacccgttgtaccgttacgtttacccgtnttttaggctttccggg

SEQ ID NO: 45491 - DNA, 646 bp, Homo sapiens
  misc_feature: GYAE6OF01A95T8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgaggggagggctggagttcgtggccaacactaaaccaagagtaggaaggtaaaagaaaactatggtaggactctaggtaggaacgggccgtattccgaacctagttccctaccgagaacgaaccaaacgacccaaaaggaacgtacaaccgttaggtaacttcgtagaacctaaagtacgaaacacggaccctaggaacggtacggacccggaagggaacccgacgggtaccttacggttaacttaaccgttaaccggtggttacggacggtaaggtacggaacttacccgttaaggtcctacgttttacccgtcgtttttggactttacccggg

SEQ ID NO: 45492 - DNA, 751 bp, Homo sapiens
  misc_feature: GYAE6OF01DJ01M.27.57.F02.1.454.CMB.1.raw
  modified_base (645)..(645): a, c, t, g, unknown or other
  misc_feature (645)..(645): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttcttgttgctatttagaaggtatcagtgtgaggtgcaacgtggtggtattcgtggaggaggtgtggtccagtccgtggaagtaactccctgacgtacctctccgtgtgcagtccctgtgtattctaaccgtttagtagttattggatggtagtcgtcgggtaccgccaagacctccggaaggggaacgggtctagggtaacgtttccggtacggaaccctaaaacgtaaataaaaaccgaaaggtaagtaaggggtaaaaacggttaaaaaaagtaaaaccttaggtacgggtaggtaacccgttcgtagggtaacggaaacgggtcccgtaacttccgaacctacgtcctaccgaagaacgaaccaaaccggaacctaaaagggtaactcaaccgttagtaacctcgttaacggaacttaaaacgtagaaaacgtcgtaaccgttacggaaaggtaccggaacccgggaacggtaaaccaccgggtnttaaacggttacttaaaccttacgggtaggtaaccggacggtaaggaactaacgttcccgttaaagttccgtaactttcccgggttacttttaggaacgttacccg

SEQ ID NO: 45493 - DNA, 697 bp, Homo sapiens
  misc_feature: GYAE6OF01ECYYS.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggccctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgaggggaacgggtctggagttcggtggaccaaacataaaaccaaggatagggaaaggtaaaagaaaactagtagtaggacttcgtagtaggaaaggggtcccgtaagtttccaaccctattacccgtaccccgtaaggaacggaaaccaaaaccggacccgaaaaggtaaacgtacctaaaccgttagtaacgttacgtcggaacctaaaagtacggaaaccaacggtacccgtaggaacgggtaaggacccgggaaacgggaccgtaaccgggtcgttaacggttaaacttaaaccgttaacgttggtacggtaaccggagtaaggtaaaccttacccgttaaggtccctaaacgtttccccgttacgtttttgactttccgg

SEQ ID NO: 45494 - DNA, 590 bp, Homo sapiens
  misc_feature: GYAE6OF01CILY6.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatggagcgtgggtccgccagcctccgaggggaagggctggagttcgtggccaacataaaccagataggaagtaaaagaaactgtgtagactctagtgaagggccattccacatctcagacgacaacgcaaagagtacacgtgtactctagacaaagtcgaaacacggaccctagaacggacggaccggaagggaaccgaccgggtacttaggttaactaccgttaacgtggttacggacggaaggacgtacttacccgttacgtaccttacgtttacccgttctttttacgagtttcccgg

SEQ ID NO: 45495 - DNA, 660 bp, Homo sapiens
  misc_feature: GYAE6OF01C49II.27.57.F02.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (283)..(283): a, c, t, g, unknown or other
  misc_feature (283)..(283): n is a, c, g, or t
  modified_base (462)..(462): a, c, t, g, unknown or other
  misc_feature (462)..(462): n is a, c, g, or t
  modified_base (538)..(538): a, c, t, g, unknown or other
  misc_feature (538)..(538): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctggagtcgttgggttttccttgttgcttattttagaggtgtccagtgtgaggtnacagtggtggtattcgngggaggaggtgtcggtccgacgccgtggagaactccccgtgacgactctcctgtcgcacggtcctntggacttcctacgtttagtagttattggatgtacgcgtcgggtcccgacgaggaccgtacggaggggacggggtctgggagttcgcgacctaacaactaaaccgaagtagtagggaaagtaaaacgaaagtagtggtacgacgttcgtaggtaacggaacggtacctattccgaacctntacccgaccgaagaaacgtacccaaaccggtacgtaaacgaaccgttctaagttagtaactcgtacggaactaaancggaacacgaccgtgaccgaacggccgaaggacctaggcttagtaacttcgacgtggaaccgaggtaagtacgtaccttccgtaacgttaccttcgtttacccgttagttcgtcgttccggg

SEQ ID NO: 45496 - DNA, 624 bp, Homo sapiens
  misc_feature: GYAE6OF01A1TU1.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggagggctgggagttcgtggccaacataaaccgaagagtagggaaggtaaaagaaaactatggtaggactcgtgtaggaagggccgtattccacctatcctaccagaacgaccaaacgccaaaaggaacgtcaacgttgtaactcgtagactaaatacgaaacacgccctaggaacgtacggaccggaacgggaaccgaccgggtactaggtaacttaaccgttaacgtgggttacgacgggtaaggaacgtaccgttacccgttaagttccctaacgtttccccggttctttttggacgtttcccgg

SEQ ID NO: 45497 - DNA, 597 bp, Homo sapiens
  misc_feature: GYAE6OF01BSA5Z.27.57.F02.1.454.CMB.1.raw
  modified_base (409)..(409): a, c, t, g, unknown or other
  misc_feature (409)..(409): n is a, c, g, or t
  modified_base (500)..(500): a, c, t, g, unknown or other
  misc_feature (500)..(500): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
  modified_base (558)..(558): a, c, t, g, unknown or other
  misc_feature (558)..(558): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcttgggttttccttgttgcttattttagaggtgtccagtgtgagtgcacgtggtggtattcgtgggaggaggtgtcggtccagcctaggagaactccctagagtacctcctcctgtcgcacgtccttcgtggtacttaccttacgtttagttagttagttggatgacgtcgtcgggccacgagaccgtacgggaaggggacgggtcgtgggtacgttcggacgaaccaagaacaaacgagtagtaaggaaaggtaaanaactggtaggtacgtactagtgtacggacggtactacttaccactactccacgacgaacgaacaaacgacaagtactatactgtagtcaanaacgtaanacgacnctcggaacgacggacgccggaacgccgagtctatacgtctaggngcgacgagctactccgtatcctacttcgtacttgctcgg

SEQ ID NO: 45498 - DNA, 801 bp, Homo sapiens
  misc_feature: GYAE6OF01DTVM6.27.57.F02.1.454.CMB.1.raw
  modified_base (269)..(269): a, c, t, g, unknown or other
  misc_feature (269)..(269): n is a, c, g, or t
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaacgtggtggattctgggaggaggtgtggtccagcctggagaactccctgacgactctctgtgcacgcctntggacttctacctttagtagttattggatgagcgtcgggtcccncgaagacctccggaaggggacgggtcgtagggtacggtttccggtcggaaaccctaaacgtaaaccgtaaaaaccgaaaggtaacgtaaaggggtaaaaggttaaaaaaagtaaaacgtagttaacgggtacggtaaccttcggttagggtaacgggtaaaccggggtacccttaacgtttacccaacccgtaactacccgtaacccgaaggtaaaccgaaacccgtaaaaccggaaccgtaaaacggtaaacgttaccctaaacgtttggtaaaccttaccgttaacggaaaccgtaaaagttaccggaaaacgaccggtaacccggttaagggaacggtaccgggaacccgggaagaaccggtaccggtacgttacgtaacgtaaccgttaaccgtgggtacggaacggtaaaggtccgttaacgttacccgttaacggttaccttaaccggtttcccgtttacgttttagaccgtttacccgggg

SEQ ID NO: 45499 - DNA, 653 bp, Homo sapiens
  misc_feature: GYAE6OF01BC0XB.27.57.F02.1.454.CMB.1.raw
  modified_base (190)..(190): a, c, t, g, unknown or other
  misc_feature (190)..(190): n is a, c, g, or t
  modified_base (557)..(557): a, c, t, g, unknown or other
  misc_feature (557)..(557): n is a, c, g, or t
  modified_base (643)..(643): a, c, t, g, unknown or other
  misc_feature (643)..(643): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgngaggtgcaactggtggattctggaggaggtgtggtccagcctggagaatccctgagactctcctgtgcagcctctggattctacctttagtagttattggatgagtcgtgggtcccgccgacgcctaccggaaggggaacggggtctgggtagttcggtacggacccaaacgtaactaaaaccgaaggtaagtaggggaaaggtaaaaagaaaactagtaggtacggtaactacgtaggttaggaaacggggtcccgtacgttaccaacccgtacttcccgttaaccgaaggaaacgaaacccgtaaaccgacccgaaaagtaacgtacctacgttacgtaatacctacgaacaaacgtagaaacgngtacctaggacgacggaccgaggaccgacggactagtactactacgtggtgacgaagacgactaccttagtactacgtttaccgtntttgacttcg

SEQ ID NO: 45500 - DNA, 662 bp, Homo sapiens
  misc_feature: GYAE6OF01C503K.27.57.F02.1.454.CMB.1.raw
  modified_base (582)..(582): a, c, t, g, unknown or other
  misc_feature (582)..(582): n is a, c, g, or t
  modified_base (601)..(601): a, c, t, g, unknown or other
  misc_feature (601)..(601): n is a, c, g, or t
  modified_base (604)..(604): a, c, t, g, unknown or other
  misc_feature (604)..(604): n is a, c, g, or t
  modified_base (609)..(609): a, c, t, g, unknown or other
  misc_feature (609)..(609): n is a, c, g, or t
  modified_base (617)..(617): a, c, t, g, unknown or other
  misc_feature (617)..(617): n is a, c, g, or t
  modified_base (623)..(623): a, c, t, g, unknown or other
  misc_feature (623)..(623): n is a, c, g, or t
  modified_base (657)..(657): a, c, t, g, unknown or other
  misc_feature (657)..(657): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttccttgttgctattttagaaggtgtccagtgtgaggtgcaacgtggtggattcgtgggagggaggtgtggtcccagcctggagaactccctgagacctctcctgtcgacacgcctcgtggtacttcctaaccttttagttagttagttaggatggaggtcgtcgggtccgacaggtacctaccggagggggtaagggcgtagggtacgttcggacggaccaaacgtaacgtaaaaccgaaggtaacgtaaggggtaaaaggtaaaaacgtaaaacgttagtaggtacggtaactcgttaaggtacggaacggggtaccctacgttacccgaaccgttaactcccgtaaccgaaggaaccgtaaacccgaaaccgaccgtaaaaggtaccgtactaacgttagtactcgtacgaataactagaccncgactagagcgacgagacncgntatanacttacgngtgganagacgtactaccgtagtaccttgtttcctgttgngttcg

SEQ ID NO: 45501 - DNA, 631 bp, Homo sapiens
  misc_feature: GYAE6OF01DSCD0.27.57.F02.1.454.CMB.1.raw
  modified_base (182)..(182): a, c, t, g, unknown or other
  misc_feature (182)..(182): n is a, c, g, or t
  modified_base (619)..(619): a, c, t, g, unknown or other
  misc_feature (619)..(619): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaggtntccagtgtgaggtgcaacgtggtggtattcgtgggaggaggtgtggtccaggcctggagaactccctgagctctcctgtgcagcctctggacttcctacctttagtagttatggatgagcgtgggtcccgaccagaccgtaccggagggggaacggggctaggggtacgtttccggtacggacccaaacgtaactaaaaacccgaaggtagtaaggggaaaaggtaaaaacgaaaacttagtaggtacggtactacggtggtacggaaacggggcctaattccaacctatcctaccagaacgaacaaccgaccaaagtacgtactacgttgtatcgtagaactaaagtcgaaacgacgtccgtaaggacggtacgaccggaaggaccgacggtctagtactactagtgcgagagagtactcgtactcgtacttcctntttgcgttccgg

SEQ ID NO: 45502 - DNA, 630 bp, Homo sapiens
  misc_feature: GYAE6OF01CDIJG.27.57.F02.1.454.CMB.1.raw
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaggtgtccagtgtgaggtgcaactggtggattcgtgggaggaggtgtggtccagcctggagaactccctgagactctcctgtgcacgcctcgtggacttcctaccttttagtagttattggatggagcgtcgggtccncagacctccgaggggagggtctgggacgttcggcggaccaacaactaaaccaagagtaggaaaggtaaaacgaaactagtggtaggactcgtagtaggaacgggcctaattccgaacctataccctcgaagacgaaccgaaaccgaccgaaaagtacgtaccaacgttgtaactctagaactaaagtgaacacggccgtaggaacggacggaccggaacggaaccaccgggtcttagtaacttacctaacgtggtccgaggtaagtaacgtacttacccgttaagtcctacgttttcccggtcttttggacttccgg

SEQ ID NO: 45503 - DNA, 670 bp, Homo sapiens
  misc_feature: GYAE6OF01DHPFD.27.57.F02.1.454.CMB.1.raw
  modified_base (450)..(450): a, c, t, g, unknown or other
  misc_feature (450)..(450): n is a, c, g, or t
  modified_base (474)..(474): a, c, t, g, unknown or other
  misc_feature (474)..(474): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaacgtggtggattctgggaggaggtgtggtccagcctggagaactccctgacgtactctcctgtgcagcctcgtggtacttcctaccgtttagtagttagttggatggagtcgtcgggtccgcgagaccgtccggaggggacgggcgtagggtacggttcggtcggaccaaacactaaaaccgaagagtaggaaagggtaaaacgaaaaactagtggtacggactcgttagaggaagggacctagttcaacctntaccctacgaagacgacaaccganaaagacgtcacgttagtaatccgtagaactaaagtcgaaacgcgtaacgtacggaacggacggacccggggaagaaccgggccggtaacgttacgtaaacgttaccgttaacgtcggtagggtacggaacgtaagttaccgtaccttaccggtacttccgggtttaaccccttcggttttacgtgtttaccccggg

SEQ ID NO: 45504 - DNA, 755 bp, Homo sapiens
  misc_feature: GYAE6OF01B2281.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttattttagaggtgtcagtgtgaggtgcaacgtggtggattcgtgggaggaggtggtgggtccaggccgtggagtaactcccgtgagtactctcctggtcgcacgtcctcgtggtacttcctacctttagtagtttattggatggagtcgtcgggtccgcagacgtccggaaggggagggcgtagggtacgttcggtacggaccaaacgaactaaaccgaaggtaacggtaggggtaaaagggtaaaacgtaaaaccgttagttacgggtaacggtaccgttcgttagggtaacgggtaacggggacccgtaactttaccaacccgttattacccgtaccgaacggacgtaaaccccgaaaccggaacccgaaaaggtaaccggttacctaacgtttacggttacttacgaacggtaaacaaacgttacgaaaccgtacggtaacccgtagggaaccggaccgggaaccggaacgggaaccgtacgggtactttaacgtacgttaaccgtacggtaggtcggaggaacgtacgttacgtaccgttacgttaccttacgtttaccgttcttttacggctttacccggg

SEQ ID NO: 45505 - DNA, 700 bp, Homo sapiens
  misc_feature: GYAE6OF01CM8OD.27.57.F02.1.454.CMB.1.raw
  modified_base (688)..(688): a, c, t, g, unknown or other
  misc_feature (688)..(688): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattcgtggaggaggtgtggtccagcctggagaatccctgagactctcctgtcgcacgcctcgtggtacttcctaaccttttagtagttattggatggagtcgtcggggtcccgccagaccgtccgaagggggaacggggtcgtaggggtagtttccggtacgggacccaaaacgaaactaaaacccgaaaggtaacgtaaggggaaaaggtaaaaaagaaaaactagttggtacggaacttcgtaggtacggaaacgggcccgtaatttcccgaaccctacttacctaccgaaggaacggaaacccaaacccggaaccgaaaaaggtaaccgttacgaacgtttacggtacttacgtaaggaactaaaagtacgaaacgcgaaccgtaggaacgtacggaccggaaggacccgacggtcttagtaactaccgtagttacggtgacggaagagtacctcgtaacgttcctacgtttacccgttnttttgacttcgg

SEQ ID NO: 45506 - DNA, 635 bp, Homo sapiens
  misc_feature: GYAE6OF01CPLZW.27.57.F02.1.454.CMB.1.raw
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (296)..(296): a, c, t, g, unknown or other
  misc_feature (296)..(296): n is a, c, g, or t
  modified_base (586)..(586): a, c, t, g, unknown or other
  misc_feature (586)..(586): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaacgtggggctggagcggtcggtttcgtgtagctattagagtntcngtntgngtncacgtggtgnttcgnggaggngtgtcgtccagctagganactcctagactctctctgcncncgctcgngtactctacttagtatagtgatgcgtcgtcggtccncacgtccgacggaaggggaggtcgtaggtcgttacgacgacaaacgaactaaacgagtacgtaaggaaacgtaaaacaaagtgtggtacgtaactggtagtaacgggaccggtacttaccgtacaaccgttcgtaccgaaccgaagaaaccgtaccgaaacgaaccgtaaagtactacgtacgttacagacgtacgaaactaagaccgtaacgacccgtagacggaacgtccgggaaccgtacggacgtacgtacgtaacgttaacgccgttagtccgaggtacgaacgngttaaccctcgttactaccgttacttccgttacttcgtaacgttccggg

SEQ ID NO: 45507 - DNA, 691 bp, Homo sapiens
  misc_feature: GYAE6OF01DROQG.27.57.F02.1.454.CMB.1.raw
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcaccttttagtagttattggatgagcgtgggtccnccagactccgaagggagggctggagttcgnggccaanataaaccgaagagtaggaaggtaaaagaaactatggtacggactcgtaggtaggaaacggggccgtaatttacccaacctacgttacctacccgaaggaaacggaaccgaaaccggaccaaaacggtaacgttacaaccgtttggtaaacttcgttaggaacctaaaattacggaaacacggtacctaggaacggacggacccggaaggaaccgtaccggtcgtaacgttaacgtaacccgttaagtcgggtacgtaccgggaaaggtggtaaacctttacccgttaaacggttcccgttaaacgttttccccggttttacttttttagggaacctttttaaccccggg

SEQ ID NO: 45508 - DNA, 590 bp, Homo sapiens
  misc_feature: GYAE6OF01EV3MV.27.57.F02.1.454.CMB.1.raw
  modified_base (522)..(522): a, c, t, g, unknown or other
  misc_feature (522)..(522): n is a, c, g, or t
  modified_base (578)..(578): a, c, t, g, unknown or other
  misc_feature (578)..(578): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgagggaagggctggagttcgtggaccaacaataaaccaagagtagggaaggtaaaagaaaactagtaggtaggactcgtggtaggaaacggggccgtaatttccgaacctaattcctaccaaggtaacgaaccaaaccggacccaaaagaacgtcaacttgtaacttctagacaaatgaaacagcctagagacgaccgaaggaccacggntagtaactacctacgttggtcgacggagacgtactccgtagttcacgtttcccgtnttttgattccgg

SEQ ID NO: 45509 - DNA, 691 bp, Homo sapiens
  misc_feature: GYAE6OF01BI8U9.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtggattcgtgggaggtaggtgtggtccagccgtggagaactccctgacgactctcctgtcgcacgtcctgtggtacttacctaccgtttagtagtttagttggatggagtcggtcggtccgacctacgaccgtaccggaaggggacggggtcgtagggtacgttccggtacggaaccaaacgtaactaaaaccgaaagtacggtaaggggtaaaaggtaaaaaacgtaaaacttaggtaggtaacggtactttacgtaggtagggaaacgggtaccgtattaccaacctacgttcccaaccgtaggaaccgtaaacgaaacccgacgaaaacggtaacgttaccaacgttgtaactactagaacaaagtacgaacgtcgaaccgtaggaacggacggaccgaaggaccgaggtcttagtacctagtacgtggacgtacgaagcgtacttcctaagtccttacgttcccgtttattcgtacgtcgg

SEQ ID NO: 45510 - DNA, 607 bp, Homo sapiens
  misc_feature: GYAE6OF01EBKMA.27.57.F02.1.454.CMB.1.raw
  modified_base (176)..(176): a, c, t, g, unknown or other
  misc_feature (176)..(176): n is a, c, g, or t
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggtttcctgtgctattttagagtntcagtgtgaggtgcaactggtggattctgggaggaggtgtggtccagcctaggagaactccctgagactctacctgtgcagcctcgtggattcactttagtattattggactggagtctggggtcccncagctccgaaggggagggctgggagttcgacggccaaagataaaccaagagtaggaaggtaaaacgaaactaagtgtaggacttcgtagtaggaaacgggcctatttccgacctactcctaccgagaacgaaccaaaccgaccaaagtaaccgtcaacgttagtactacgagactaaagtacgaacacggtacctaggagacggaccgtaggaccgacggctagttactacctacgtacgtcgaacggtacgaagtacttcccttaagtcctaacgtttcccgttcgttttgaccgtttccgg

SEQ ID NO: 45511 - DNA, 594 bp, Homo sapiens
  misc_feature: GYAE6OF01DOS9M.27.57.F02.1.454.CMB.1.raw
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgagactctcctgtgcagcctctggattctacctttagtagttattggatgagcgtgggtccgccagacctcgaggggaaggggctgggagttcgnggccaanataaaccaagagtagggaaaggtaaaagaaaactagtggtaggaactcgtaggtaggaaacgggtccaatttccaacctaatcctaccaagaacgaccaaccgaccgaaagacgtcaactgtactctagacaaatgaacagcctagacgagaccggaaggacgacggctagtacttacgtactggtacgacggaagtacgacttaccgttaaggttcctaacgtttcccgttactttttgagtttcccgg

SEQ ID NO: 45512 - DNA, 849 bp, Homo sapiens
  misc_feature: GYAE6OF01C82HV.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtggggctgagtcgttgggttttccttgttgtcttagttttagaggtgtccagtgtgaggtgcaacgtggtggtattcgtgggagggtaggtgtcggtccagccgtggagaactcccgtgacgactctcctgtgcagtcctgtagtacttcctaccgtttagtagttattaggatggtagtcgtcgggtcccgcgacgaccgtccggaaggggtacgggtcgtagggtacgttcgtacggaaccctaaacgtaaacgtaaaccgaaaggaagtaacggggtaaaaaggtaaaaacgtaaaaacgttgtacggtaacgtacttacggttagggtaacgggtaaccggggtaccctaagtttacccgaacctacgtttcccgtaaaccccgaaagggtaaacccgaaaacccgttaaacccgggaaacccgtaaaacgggtaaaccgttaaccctaaccggttttaacgttaaccgttaccgtaacgggtaaacccttaaaacgggtaaccgaaaccgaacggttcccggtaaagggaaaccggtaacccgggacccgggtaaacggtaaacccgaccgggttaacttaacgggttaaacttacccggttaacgtggggtaaacctacgggaaaggtacgtacccgttaacccggttaagttaccctttaacggttccccgttttaaggtttgaacccggtttacccggg

SEQ ID NO: 45513 - DNA, 546 bp, Homo sapiens
  misc_feature: GYAE6OF01AECGJ.27.57.F02.1.454.CMB.1.raw
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (452)..(452): a, c, t, g, unknown or other
  misc_feature (452)..(452): n is a, c, g, or t
tcagagcgtcgtctcacgaccggtgctcgatttagctcgatatagttgggtttgtaggtctcagagaggagccttagccctggactccaaggcctttccacttgtgatcagcacggagcacagaggacccaccatggaactggggctgagctgggtttctgttgctatttagaaggtgtccagtgtgaggtgcaactggtggattctggaggaggtgtggtccagcctggagaatccctgagactctcctgtgcagcctctggacttctacctttagtagttactggatgagcttgggtccgccagtctccgagggaagggctagggtgttcgtggcccaacagtaaaccgaagatgggaagtaaagaactagcgtagacgtcngtgaagggctntcgacatcaccagacgacacgacaagaactcgactagtctactcgaacaatagaacngaccgtgaacgtacgacgaggaccgacggtctagtactactcgtagtcgaggaagcgtactctacggttcctacgttccgttgtttcgcgttcg

SEQ ID NO: 45514 - DNA, 542 bp, Homo sapiens
  misc_feature: GYAE6OF01BAOVC.27.57.F02.1.454.CMB.1.raw
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcttgtgctatttagaaggtgtccagtgtgaggtgcaactggtggattctggaggaggtgtggtccagcctggagaatccctgagactctcctgtgcagcctctggattcacctttagtagttattggatgagctgggtccnccagactccgagggagggctggagttcgtaggccaacataaaccaagataggaaggtaaagaaactntggtgactntgtgaagggccattcacatcncagagacacgcaagancatgtactctgacaagtnaactcgacctaggagacgccggaagaccgagggtcttaggacttaccgtacgtggtggcgaaggacttacgttccgtaacgttcctagtttacccgctttttggacttccgg

SEQ ID NO: 45515 - DNA, 739 bp, Homo sapiens
  misc_feature: GYAE6OF01C4R0U.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagctgggttttccttgttgctatttagagtgtccagtgtgaggtgcaacgtggtggattcgtgggaggaggtgtcggtccagcctggagaactccctgagactctctgtgcacgcctgtggtattcctaccgtttagttagtttagttaggtagtggacgtcgtcgggtcccgaccgacgtaccgtaccggaaggggaacgggtctagggtacggttcggacggacccaaaacgtaacgtaaaacccgaaggtaacgtaagggtaaaaggtaaaaacgtaaaacgttaagtgggttaacgaaccgttcgtaggtacggaacgggtaccgtataccgaaccctactcccgtaaccgaagaaccgaaccgaaccgaaccgaaaggtaacgtaccaagttcttaacgtccgtaagtaacctaaaaggtccgtaaacgacgtacccgtaaggacgtaaccggacgggtaacgaccggaccgtacgttagtaaccttacgttaccgtaggtacggtacgaacgggtacgtaaccgttcccgttaacgtaccgtttacccgtttcccggtttactttacgtaccggtttacccggg

SEQ ID NO: 45516 - DNA, 824 bp, Homo sapiens
  misc_feature: GYAE6OF01AWYOM.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtggattcgtgggaggaggtggtcggtccaggtcctggacgaactccccgtgacgtacctctcctgtcgcctacggccttcgtggtactttccgtaccgttttaaggtagtttagttgggattaggacgtcgtcggggtcccgaccgacgtaccgtacccggaagggggaacggggtcgttaggggtacggtttccgggtacggaacccctaaaacgtaaacgttaaaaccccgaaaggtaaggttaacggggtaaaaacggttaaaaacgtaaaaacgtttgtacgggttaccggtacccgttaggtagggtaacgggaacggtaccgtaacttaccgaacctcgttacccgaacgtaacgaaccgaaaccgaacccggaacgaaacgttaaccgaccgttaacggttataccgtacgtaaccgtaaacgtaagtaaccgaacgccgtaacggacgggaacggaaccggaccgggaaaccgaccggtacggtacgttaaccgttctaaacggtttcgtagggtaaccggtaaggtaacggtaaccgttaccgttaaccgttacgttacccgttttacccgggttaccgttttacgtttacgtcccggtttaaccgggg

SEQ ID NO: 45517 - DNA, 663 bp, Homo sapiens
  misc_feature: GYAE6OF01AQR7F.27.57.F02.1.454.CMB.1.raw
  modified_base (302)..(302): a, c, t, g, unknown or other
  misc_feature (302)..(302): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctatttagaaggtgtccagtgtgaggtgcaacgtggtggattctggaggaggtgtggtccagcctggagaatccctgagactctcctgtgcagcctctggattcacctttagtagttatggatgagcgtgggtccncagactccgaggggagggctgggagttcgtgaccaacataaaccgaagtagtacgggaaggtaaaacgaaaacttagtaggtaggactacgtaggtaggaacgggccgtaattccgaacacgtacctaccgaacggaacgaaccctaaaccggacctaaacggaaactcccgtaaacttggtaacttcgtagtaacaaaagtcgaaacacggtaccctagggaacggtacggacccggaagggtaacccgacgggtaccgttagttaaccttaaaccgttacgtaggtccggagaggtaacgtaccttacccggttaacttcccgtaagtttccccggtttactttttaggcgtttcccgg

SEQ ID NO: 45518 - DNA, 642 bp, Homo sapiens
  misc_feature: GYAE6OF01AMOQD.27.57.F02.1.454.CMB.1.raw
  modified_base (519)..(519): a, c, t, g, unknown or other
  misc_feature (519)..(519): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaacgtggtggattcgtgggaggaggtgtggtccagccgtggagactcccgtgacgtactctccgtgtcgcacgtccttcgtggtactttcctaaccgttttagtagtttagttggatggagtccgtcgggtcccgaccgagtaccgtaccggaggggagggtcgtagggtacgttcggtacggaccaaacaactaaaccgaagtagtaagggaaagtaaaagaaactagtaggtacgtactacgtggtaaggacggacctacttaccgacctatacccgtacgaaggaccgaacgaaccgaaccgaaagtacgtccacgtntacgtcaagaactaagcgaacgcaccgtaggacgtacgacggagaccacggtactagtaactcgtagtggacgacgagtactaccgtacttacgtacttcgttaccgttctttagccgttcgg

SEQ ID NO: 45519 - DNA, 931 bp, Homo sapiens
  misc_feature: GYAE6OF01CX14T.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttccttgttgctattttagaggtgtcagtgtgaggtgcaacgtggtggattcgtgggaggtagggttgtgggtccaggtcccgttagggagaactccctgacgtacctctcctgtcgcacgtccttcgtggtactttccttaaccgtttttaaggttagtttagttggattggacgtcggttcgggtcccgaccgaggtacccgtaccggaaggggggtaacgggtccggtagggtacggtttccggtacgggaaccctaaacgtaaacgtaaaaccgaaggtaacggttaaaggggtaaaacggttaaaaaacgtaaaaccgtttaggttacgggtaacggtaaccttcggttagggtaacggggtaaaccggggtacccttaagtttaccccgaaacccgttacttaccccggttaaccgaaagggaacccggtaaaacccgaaacccggaaacccggtaaaaaggtaaccgttaccccgaaacggttttaggttaaccgtttaccctaacggtaaaacctaaaacggttaaccgtaaaaccgtccggtaacccgttaggggaaaccgggtaaccggaacccggggaaaccgggtaacccggtacccgggtttaccgttaaaggtttaacccgtttaaaccggtttaacggtcggggttaccggaaccgggtaaagttaaccgggtaaccccgttttaaccgggtaaccgttttacccggtttaccgtttttccccgggtttaacgtttttggacccggttttaccccgggg

SEQ ID NO: 45520 - DNA, 704 bp, Homo sapiens
  misc_feature: GYAE6OF01A9W6Y.27.57.F02.1.454.CMB.1.raw
  modified_base (314)..(314): a, c, t, g, unknown or other
  misc_feature (314)..(314): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaactggtggattcgtgggaggaggtgtgggtccagcctggagaactccctgagactctcctgtgcagcctctggacttctacctttagtagtttatggatgagtcgtcgggtccnccagactccgaagggggaagggctagggtacgttcggtacggacccaaacgaactaaaccgaagtagtagggaaaggtaaaagaaaactagtgtaggactcgtggtaggaacgggcctattaccgaacctattcccgtaccgaaggtaacgaaacccaaaccggacccgaaaagtaacggtaccaacgttagttaactccgtagaacctaaaagtcgggaaacctaggtacccgttaggaacggacccggacccgggaacgggaacccgaccggggtacttacggttaaacttaacccgttacgttggtcggaaccgtaagggtaacgtaccttacccgttaacggtcccttaacggttttccccgttactttttacgacgtttcccggg

SEQ ID NO: 45521 - DNA, 854 bp, Homo sapiens
  misc_feature: GYAE6OF01EZ9VF.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttagttttagaggtgtccagtgtgaggtgcaacgtggtggtattcgtggaggaggtgtcggtccacggcctggagaactccctgagacctctcctgtgcacgcctcgtaggtattccgtacctttagttagttagttggatggagtccggtcggggtcccacgacggaccgtaccgggaagggggaacggggtcgttgggtacggtttccggtacggaacccgaaaactaaacgtaaaacccgaaaggtaacggtaaggggtaaaacgggttaaaaaacgtaaaaacgtttaggttacgggttaaccgggtaacttaccggttaggttaacggggaaacggggtccccgtttaacttacccgtaacccgtaactttacccgtaaccgtaaggtaaccgaaacccaaaacccgggtaaccgaaaacgggttaaacggttacccttaaacgtttacgttaaccttaccgtaacgtaaccctaaaaacgggttccgaaaacggtaaccgtccccggttaaagggaacggggtaaccggtacccgggaaccggtaaccggtaacccgggttccggttaaagttaaccgtttaaaccgtacggttaggtaccggaggtaaacgtacggtaaccttacggtaacgtttaccgttacggttttcccgttacttttacgggtcttacccgggg

SEQ ID NO: 45522 - DNA, 725 bp, Homo sapiens
  misc_feature: GYAE6OF01C2MES.27.57.F02.1.454.CMB.1.raw
  modified_base (578)..(578): a, c, t, g, unknown or other
  misc_feature (578)..(578): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctggagtcttgggtttttccttgttgcttaattttagaaggttgtccagtgtgaggtgcaacgtgggtggattcgtgggagggtagggttggtcggtcccaggtccgtaggacgtaactcccgtagacgtacctcctccgttgtgcacgtcctcgtaggtactttaccttaaccgttttagttaagtttagttaggatggacggtccggttccggggtcccgcccgtaacggaccgtacccgggaaggggggaaggggtccgttaggggtacggtttccggtacggacccaaaactaactaaaaaccgaagtaagtaagggaaaaggtaaaagtaaaactagtaggaggtactgtaggtacggaacgggtaccgtattccgaacctactcctaccgaagtaaccgaacgaacgaccaaagactacacttgtanctagaactaatagaacacgtaccgagacgacgaccggaagaaccgacggtactagttaactaccgttacgtaggtacggagtaacggtaactaccgttaccgttacgtaccttaaccgtttccgtttactttcggaactttcccggg

SEQ ID NO: 45523 - DNA, 654 bp, Homo sapiens
  misc_feature: GYAE6OF01C1PDB.27.57.F02.1.454.CMB.1.raw
  modified_base (215)..(215): a, c, t, g, unknown or other
  misc_feature (215)..(215): n is a, c, g, or t
  modified_base (324)..(324): a, c, t, g, unknown or other
  misc_feature (324)..(324): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (386)..(386): a, c, t, g, unknown or other
  misc_feature (386)..(386): n is a, c, g, or t
tcagagcgtcgtctcacgaccggtgctcgatttagctcgatatagttgggtttgaggtctcagagaggagccttagccctggactccaaggccctttccacttggtgatcagcacggagcacagacggacccaccatgggaactggggctgagcttgggttttccttgttgctattttagaaggtgtccagtgtgaggtgcaacgtggtgattcngggaggtaggtgtggtccagcctggaagaactcccgtgaagtactctcctgtgacacggccctcgtaggacttctaacctttagtagttattggatgagtcgtggtccnccagactccggagggaggctggattcgngaccaanataaaccagacgtaggaaaggtaaaanaactaagtgtaggtacctgttaggtaggaaacggcctaattcccgaacctaagtcctacgaagaacgaacaaccggaaccaaaagtaacgtacctagtacgtaatacgtagtaactaaaacgtacgaaacgaacgtcccgtaaggaacgacggtaaccggaagaaccgacgtctacgttaataccgtacgcggtagaccggaagtacggaactttacccgtaagggtaccttaacgtttcccggttactttttaggcgtttaaccggg

SEQ ID NO: 45524 - DNA, 803 bp, Homo sapiens
  misc_feature: GYAE6OF01BCHP2.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaacgtggtggattcgtgggaggtaggtggtggtccagccgtggagaactcccgtagacgacctcctcctgtcgcacggtccttcgtggtacttcctaaccgtttaagttagtttagttggtatggacgtcggtcgggtcccgaccgagaccgtaccggaaggggtaacggggtctgggtacgttcggtcggacccaaacgaactaaaaccgaaggtaacgtagggtaaaaggtaaaaagtaaaacgttaggtacggtacggtaacgttacgttaggtaacgggtaaacggggtacccgtaacgttacccaacccgtacttacccgtaacccgaaggaaaccgaaacccgtaaaaccgaacccgtaaaacggtaaccgttacccgtaacgtttacgttaaactaccgttacgaaaccgtaaaacgtacgggaaaacctacgggtaaccctaaggggaaaccggtaccggaacccgggaaacggaacccggtaccggtacgttaacgttaacttaaccgttaccgttaggtacggtaaggaacggtacgtaccgttacccgtaacgttacgtaccgttttcccggtttactttagtccgttaccggg

SEQ ID NO: 45525 - DNA, 685 bp, Homo sapiens
  misc_feature: GYAE6OF01CZD55.27.57.F02.1.454.CMB.1.raw
  modified_base (183)..(183): a, c, t, g, unknown or other
  misc_feature (183)..(183): n is a, c, g, or t
  modified_base (562)..(562): a, c, t, g, unknown or other
  misc_feature (562)..(562): n is a, c, g, or t
  modified_base (626)..(626): a, c, t, g, unknown or other
  misc_feature (626)..(626): n is a, c, g, or t
  modified_base (672)..(672): a, c, t, g, unknown or other
  misc_feature (672)..(672): n is a, c, g, or t
tcagagcgtcgtctcacgaccggtgctcgatttagctcgatatagttgggtttgggagtctcagagaggagccttagccctggactccaaggcctttccacttggtgatcagcacggagcacgagacggacccacagtggaactggggctgagtctgggttttcctgttgctatttagacgtntcagtgtgaggtgcaacgtggtgattcgtggaggaggtgtggtccagtccgtggaagaactccctagacgacctctcgtgcgcagcctcgagtacttctacctttagtagttagttggatggacgtcgtcggtccaccgagacctccggaggggtacgcgtaggtacggttcgacggacaactaaacgtaaaccgaagtaactaaggggaaacgtaaaaacggtaaactagttagggacgtacgtacgtaggtaacgggaaccggtccgtatacccaaccgtactaccgtaaccgaaggaacccgaaacccgaaacgaccgtaaaagtaacggtaccctaagttaggtaccttagtacggaaacttaagactaaaccgngggtaacctggaaaccggacgtaccgggaacgtaacgcggtaaccgttataacggtacttacgnggttgaacgagacgtaccttccgttagtcccgttattacccggttntttgaacgtccgg

SEQ ID NO: 45526 - DNA, 778 bp, Homo sapiens
  misc_feature: GYAE6OF01DAP9L.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttcctgttgcttattttagaaggtgtccagtgtgaggtgcaacgtgggtggattcgtgggaggtaggtggtcggtccagccgtggaagaactccctgaagcctcgtctgtagcagtcctctggtattctaaccgtttagtagttatggaatggtacgtcgttgggtacccgacgagaccgttccgagggggaacgggccttaggggaacgttcggtacggacctaaaacggaaataacccgaaaggtagtacggggaaacgtaaaaagtaaaacgttacgtagggttacggtaacccttaggtttagggtaacgggtaaacccgggggtaccggttaaaccttttaacccgaacccggtaacttaacccgttaacccggtaaacgggtaaaccggaaaacccggttaaaccccggtaaaccgaaaaaccgttaaaccggttaaccgtaacgttaaccggttaacgtaccgttacgggtaaaccctaaagtaaccgtaaaccgtaccgaccgttaggaaacggtacggacccggttaacggaacgtacggtcgtacgtactacgtacgtaggtcgacgtaggcgtaactcgtactactacgttaccgtcttttggcttaccgg

SEQ ID NO: 45527 - DNA, 781 bp, Homo sapiens
  misc_feature: GYAE6OF01EKXJ0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactcccctggactctcctcgtgtcacgcgtcctgtagtacttacctttacgtttagttagtttaggtagtagtaggtcggtcggttccgggtcccgacgaccgtaccgtacgggaagggggtacgggtggtagggttacggttcggtaccgaaccaaacgtaaaacgtaaaaccggaaggtaacgggtaaagggtaaaacggtaaaaacgtaaacgttaggtacgggtacgtacgttaggtacgggtaaggggaaccggtaccgttaaccttacccgaacctacgttcccgaacgaacggaaaccgtaaacccggaaccgaaacgaaacggtaacccgtacgtaacggttaacgttactcggtaacgaaactaaggtaccgaacgtaccgtacgtaagggaacggaccgggaaccgggaaacgtaccgggtacgtacgttaacgttaaaccttaccgtaggttacggacgtaaggaacgtacgttacccttacggtaacgttaccttaccgtttcccgttttagtttacgacccgtttccgggg

SEQ ID NO: 45528 - DNA, 790 bp, Homo sapiens
  misc_feature: GYAE6OF01EMON2.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacagaggacccaccatggaactggggctgagcttgggttttccttgttgcttattttagaaggtgtccagtgtgaggtgcaacgtggtggattcgtgggaggaggtgtggtccagcctggagaactccctgagactctcctgtgcagcctcgtggacttcctacctttagtagtttattggatgagtcgtggggtcccgccagactccggaaggggaacggggctgggagttcggtaggacccaaacaactaaaaccgaagacgtagggaaaggtaaaagaaaacgttgtaggtaggaacttcgtaggtacggaaacggggtcccgtaagtttacccaacccgtaagttcccctaaccgtaagggaaaccgaaacccgaaaacccggaacccgtaaaaggtaaaccgttacctaaccgtttacgttaacgttccgttaacggaacctaaaacgttacgaaaccgacggtacccgtaaggaacgggtaaccggacccgggaaacgggacccgtaaccggggtaccgttacggttaaacctttaaccggtaaccgtttcgggtaacggtacgggtaaacggaacggttaacccgtttacccgttaaacgggttacccttaaccgttttacccccgggtttactttttttaccgggaccttttaccccggggg

SEQ ID NO: 45529 - DNA, 716 bp, Homo sapiens
  misc_feature: GYAE6OF01BY98P.27.57.F02.1.454.CMB.1.raw
  modified_base (297)..(297): a, c, t, g, unknown or other
  misc_feature (297)..(297): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctgggaggaggtgtggtccagcctggagaatccctgagactctcctgtgcagcctctggattccacctttagtagtttattggatggancgtggggtccgccagacctccggaggggaacgggctgggagttcggtggaccaacaataaacccgaagtagtagggaaaggtaaaacgaaaactagtaggtacgggaacttcgttggtagggtaaacgggcccgtatttaccgaaccctagtcctaccgaaaggacgaaacccaaaccggtaccccaaaaggaaccgttaccaacgtttggtaacttaccgtacgaacctaaattacggaaactacggtaccccttagggaaacgggtaccggacccgggaaacgggacccgtaaccggggtaccttagggttaactttaaacccgttacggttacgggtacggaccggaaagggtacgaccgttaccgttaacggtcctacccgttttccccgttatttttaccggactttccccggg

SEQ ID NO: 45530 - DNA, 831 bp, Homo sapiens
  misc_feature: GYAE6OF01DTXGU.27.57.F02.1.454.CMB.1.raw
  modified_base (196)..(196): a, c, t, g, unknown or other
  misc_feature (196)..(196): n is a, c, g, or t
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagtcttgggttttccttgttgcttattttagagtgtccagtgtgaggtncaacgtggtgtattcgngggaggnggttgtcggtccagtccgtaggactaactcccgtgacgtaccttctccgtgtcgcacgtcctgtacgtacttccgtaactttagtattagtggactggtagtccggtcggtacccgacgtacggtaccggtccgggaaggggtacgggtcttagggtacgttcggacgaaccctaaaacgaacgtaaaccgaaggtaacgtaaggggaaaaacggttaaaaacgtaaacgttcggttaggtacgtaaccgtttacggtagggtaacgggtaacggtacccgtaacttacccaaccggtactacccgaaccgaggaaaaccgaacccgaaaaccgacgtaaacgggtaaccttaccgtaacgttcgttaacgtaccgtaacgaaccgtaaacgtacggaaccgtaagggtcctaagggaacccgggtaagggtaaccccggaacgggtacctaaccggggttacttaacggttaaccttacgggttaaccgtcggggttaacggaaacggttaacggtaaccgttaaacccgtttccccgttaaaaggtttccccccggtttaagttttttcccccgggaactttttttccggaaccggtttaccccggggg

SEQ ID NO: 45531 - DNA, 637 bp, Homo sapiens
  misc_feature: GYAE6OF01AZVFS.27.57.F02.1.454.CMB.1.raw
  modified_base (254)..(254): a, c, t, g, unknown or other
  misc_feature (254)..(254): n is a, c, g, or t
  modified_base (320)..(320): a, c, t, g, unknown or other
  misc_feature (320)..(320): n is a, c, g, or t
  modified_base (528)..(528): a, c, t, g, unknown or other
  misc_feature (528)..(528): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtggattcgtgggaggaggtgtggtccagcctaggagaactccctgacnctctcctgtgcacgcctgtcggtattcctacctttagtagtttattggatgacgtcgtcgggtccnccgagaccgtccgaaggggacgggcgtagggtacgttcggcggaccaacaactaaaccgaagtacgtaagggaaaggtaaaacgtaaaactagtggtaggtactcgtaggtaggaacgggtccgtagttaccacctatccaccgaagaccgaacgaaccgaccgaaaggaactccctaagttacgtatcgagaactaaagtaccgaancgtaccgtagacggtacgaccggaaggacccgacggtactagtacctactacggtgacggacgagacgtactccgtaagtcctacgtttccctgtttacgcttaccggg

SEQ ID NO: 45532 - DNA, 674 bp, Homo sapiens
  misc_feature: GYAE6OF01C6AW2.27.57.F02.1.454.CMB.1.raw
  modified_base (345)..(345): a, c, t, g, unknown or other
  misc_feature (345)..(345): n is a, c, g, or t
  modified_base (501)..(501): a, c, t, g, unknown or other
  misc_feature (501)..(501): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattcgtggaggaggtgtggtccagcctggagaatcccgtgacgactctcctgtgcagcctctggtacttcctacctttagtagttatggatgagtcgtcggtccgccagacctccgagggggaagggctaggtagttcgnggaccaacaataaaaccagaagtagggaaaggtaaaagtaaaactagtaggaggtactcgtaggtaggaacgggccgattccgaaccatcctacgaagacaacaacgaccaaagtactctaacgtagtactacgtagaaaccaaagtacgaaaccngtaccgtaggaacggacgacccgggaaggaacccgtacgggtaacttacggttaaactaaacccgttagtacgggtcggaaacggttaagggaaacttaaccggttacccgttaaggttacccctttaaacgtttcccccgggttttacttttaagggtacctttaccccggg

SEQ ID NO: 45533 - DNA, 617 bp, Homo sapiens
  misc_feature: GYAE6OF01EDHXS.27.57.F02.1.454.CMB.1.raw
  modified_base (334)..(334): a, c, t, g, unknown or other
  misc_feature (334)..(334): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagactccgagggaggggctggagttcgnggaccaacgactaaaccgaagagtaggaaggtaaaagaaaactataggtggaactcgtagtggaacgggccgtaattccaaccattcctaccgaagaacgaacccaaacgacccaaaggtaacgtcaacgttgtaactctaggaacctaaagtagaaacgacgtaccgtagacgggacgaccggaagggaccacggtactaggtaactactaacgtggtacgacggaaggacgacgttacctaacggttcctaacgtttcccggttacttttggacttaccgg

SEQ ID NO: 45534 - DNA, 583 bp, Homo sapiens
  misc_feature: GYAE6OF01CTNSZ.27.57.F02.1.454.CMB.1.raw
  modified_base (179)..(179): a, c, t, g, unknown or other
  misc_feature (179)..(179): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (310)..(310): a, c, t, g, unknown or other
  misc_feature (310)..(310): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaaggtncagtgtgaggtgcaagtggtggattcgtgggaggaggtgtggtaccagcctgggagaactccctgagctctcctgngcagcctntaggtattcctaccgtttagtagttagttggattgagcgtgggtccnctagactcgaggggaggctggagttcggcgacaacaagtaaaccaagtagagggtaaagtaaaacgaaataggttgaggactcgtaggtggaagggtccattaccacctatctccaagacgaacaaccggcgaaagattacgaacttgtaactcgtaanaactaaganacgacgacgagacgacggacgagacctaggtactagttactacgtagcgtacggagagtacgtaccttacgtacgttactaccgtttcgttacgtttcgcgttcg

SEQ ID NO: 45535 - DNA, 745 bp, Homo sapiens
  misc_feature: GYAE6OF01A1QN6.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtggggctgagcgttgggttttccttgttgcttatttagaaggtgtccagtgtgaggtgacaacgtggtgattcgtggaggaggtgtggtccagccgtggagtactcccgtagacgtactctccgtgtcgcacgtcctcgtggtacttctacctttagtagttagtggatgacgtcgtcggtcccgacgacgaccgtaccggaagggggacgggtcgtagggtacggttcggacggaacccaaacgtaaaccttaaaaccgaagtaggtaagggtaaaaggtaaaaacgtaaaacgttaggtacgggtacggtaacttacggtacggtaacggggaaacgggtccggttaacttacccgaacccttaacgttacccgtaaccgaaaggaaaccggaaaccccgtaaaccggaaccgaaaaggtaacgtacctaacgttaggtaacttacggtaacgaactaaacgtacgaaactcggtaccgtaacggaacggtaaccgggaccgaacggaaccgacggtctaagtaccttacgtacgtggtacgagacgtacgtacctaccgtagttaccttacgtttacccgttagttttcgactttccggg

SEQ ID NO: 45536 - DNA, 841 bp, Homo sapiens
  misc_feature: GYAE6OF01EDWTE.27.57.F02.1.454.CMB.1.raw
  modified_base (680)..(680): a, c, t, g, unknown or other
  misc_feature (680)..(680): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgtgctatttagaggtgtccagtgtgaggtgcaacgtggtggattctgggaggaggtgtggtccagcctggagaatccctgacgactctcctgtgcagcctgtaggtacttctaaccgtttagtagtttagttggataggtacgtcgtcgggggtccccgacaacggtaccgtaccggaaggggaacgggggccttaggggtaagtttccgggtagggaaccccaaaacgtaacttaaaaacccggaagtaacggttaaggggaaaagggttaaaaaacgaaaaccgttagtagggttaacggaccgttacgtaggtaggaaacgggtccgtaacgttccgaaccctagttaccctaccgggaacgaacggtaaacccaaaccggacccaaaagggtaaaccgtacccgtaaacgtttacggtaaacttccgttaagaaccttaaaacgtaacgaaacgttaaccgacccggttaaggaaacggtaacgggacccggaaacgggaccgtaaacccggngtttaaaccggtaaacgtttaccccgtaaaggtttcggtaaccgggtaaccgggtaaaggtaccggttaaaccgtttcccggttaaaccggttaaaccgtttaaccccgggttttttacccggtttacggttttttaaccggtaacctttacccccggggg

SEQ ID NO: 45537 - DNA, 550 bp, Homo sapiens
  misc_feature: GYAE6OF01DKCB6.27.57.F02.1.454.CMB.1.raw
  modified_base (265)..(265): a, c, t, g, unknown or other
  misc_feature (265)..(265): n is a, c, g, or t
  modified_base (340)..(340): a, c, t, g, unknown or other
  misc_feature (340)..(340): n is a, c, g, or t
  modified_base (456)..(456): a, c, t, g, unknown or other
  misc_feature (456)..(456): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctcnggattcacctttagtagttattggatgagcgtggtccgccagactccgagggaaggggctggagtcgtggccaanataaaccagagtaggaaggtaaaagaaaactataggtgaactctagtagaaggggcctaattcaacccatcctaccagacgaacacgaccaagaatcatgtatctgacaatgaacngacctgacgagaccgagacgcgctgtaactactctggtacgaggaggacacgtacccgttagtaccttactttacccggttctttgtagttccg

SEQ ID NO: 45538 - DNA, 690 bp, Homo sapiens
  misc_feature: GYAE6OF01CK236.27.57.F02.1.454.CMB.1.raw
  modified_base (677)..(677): a, c, t, g, unknown or other
  misc_feature (677)..(677): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttccttgttgtcttattttagaaggtgtccagtgtgaggtgcaacgtggtggattcgtgggaggaggtgtggtccagcctggagaactccctgacgactctcctgtgcacgcctcgtggtacttctacctttagtagttagttggatgagtcgtcggtcccgcagacctccggaaggggacgggcgtgggtacgttcggtacggaccaaaacgaactaaaaccgaaaggtaacgtaagggaaaacgggtaaaaaacgtaaaaacgtagttacggtacggtaacttacgtaggtaacggaacgggtacccgtaacgtttaccgaaccctagtacccgtaccgaaggaacgaaaccgaaaccggaccaaaagggtaacgtaccgtaacgttagttaactacgtacggaaactaaagtacgaaactacgacccgtaggaacggacgaccggaaggaaccgacggtacttagtaactacgtagtggtacgacgagacgtactacgtagtccttacgttccgttntttgacgttccgg

SEQ ID NO: 45539 - DNA, 667 bp, Homo sapiens
  misc_feature: GYAE6OF01D520R.27.57.F02.1.454.CMB.1.raw
  modified_base (266)..(266): a, c, t, g, unknown or other
  misc_feature (266)..(266): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (605)..(605): a, c, t, g, unknown or other
  misc_feature (605)..(605): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaagtgtccagtgtgaggtgcaacgtggtggattcgtgggaggaggtgtggtccagccgtggaacaatcccgtagacgactctcctgtcncgacgtcctgtgtactttcctacctttagtagttntggatggacgtcgtcgggtccnccgagactccggaagggagggcttaggagttcggcggaaccaactaacgtaaaccgaagtacgtaagggaaagtaaaacgaaacttagtacggtagtaacgtcgtaggtaggaacgggtacctagttacccaacctactacctacgaacgtaacgaaacccgaaaccgaaccgaaaggtaaccgtactaaccgttagtactacgtaacgaactaaagtacgaacgagaccgtaggaacgacggaaccgacggaaccgacggtacgtagttactacgttacgnggtacgaggaacgtactacgttaccagttaccctcgtttacccttgttttcgcgttaccggg

SEQ ID NO: 45540 - DNA, 730 bp, Homo sapiens
  misc_feature: GYAE6OF01CBT61.27.57.F02.1.454.CMB.1.raw
  modified_base (328)..(328): a, c, t, g, unknown or other
  misc_feature (328)..(328): n is a, c, g, or t
tcagagcgtcgtctcacgaccggtgctcgatttagctcgatatagttgggttttgaggtctcagagaggagccttagccctggactccaaggcctttccacttggtgatcagcacggagcacagacggacccaccatggaactgggctgagcttgggttttccttgttgcttattttagaaggtgtccagtgtgaggtgcaacgtggtggattcgtgggaggagggtgtgggtccagtccctagggagaactccctgacgtctcctcctgtgcaggtcctcgtggattcctaccttttagtagtttattggatggagcgtgggtcccncagacctccgaaggggaagggtctggggtagtttcggtcggaccaaacaacgttaaaaacccaggagtaagggaaggtaaaaaacgaaacttaggtggtacggacttcgtaggttagggaaacggggtcctagtttacccaaccctattacccgtaccgtaacggaacgaaccaaacccggaccgtaaaagacgttacaacgttgtaacgttcagactaatacgaacacgacctaggacgacggaccggaacgcgtaaccggtcgttacggttaacttacgttaacgtttcggtacggtacggtaaacggtcggttaaaccgtttacccgttaacggtttaacccgttaaaccggtttttccccgtttaccggtttttttaagcccggtttttaacccgggg

SEQ ID NO: 45541 - DNA, 927 bp, Homo sapiens
  misc_feature: GYAE6OF01CSEFT.27.57.F02.1.454.CMB.1.raw
  modified_base (184)..(184): a, c, t, g, unknown or other
  misc_feature (184)..(184): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtgggctgagcttgggttttccttgttgcttattttagaaggtntccagtgtgaggtgcaacgtggtggatttcgtgggaggaggttgtggtcccaggcccgtaggacgaactccctgacgtacctcctccgtgtcgcacgccttcgtggtacttacctaccgttttaagttagtttagttggagttggacgtcgttacgggtcccgaccgacgtaccgtaccggaagggggtaacgggtccgtagggttaacggtttccggtacggaaccccgaaactaaacgttaaaaaccccgaaaggtaaacgttaacgggggtaaaaacgggttaaaaaacgtaaaaaacgtttacggttacgggtaacgggtaacccgttacggtttagggtaacggggtaaaccgggggtacccgtaacgttttacccgaaccccttaacgttccccttaaccccggtaaggtaaaccggaaaccccggtaaaaacccggtaaaccccggtaaaaacggttaaaaccggttacccgtaaaccgtttaccgggtttaaaacttcccgtttaaaccggaaaccttaaaaacggttaaaccgaaaacccggtaacccggtaacccggttaagggaacgggacccgggtaaccggaacgggtaaacccgtaccggggtaccttacgggttaaacttacccgttaacggttcggttaacgggacggtaaaggtaaccgtaaccgtttaccttaacggttacctttaacccggtttccgtttacgtttttccgggaacttcccggg

SEQ ID NO: 45542 - DNA, 840 bp, Homo sapiens
  misc_feature: GYAE6OF01BYRE5.27.57.F02.1.454.CMB.1.raw
  modified_base (333)..(333): a, c, t, g, unknown or other
  misc_feature (333)..(333): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaacgtggtggattcgtgggaggaggtgtggtccaggcctggagaactccctagacgacttcctcctgtcgccagtcccttcgtggtacttcctaaccgttttagtagtttattggatggacgtcgtcgggtcccnccaggacctccggaagggggagggtccgtgggtacgttccggtacggaccaaaacgaactaaaaccgaaggtaacgtaaggggtaaaacggtaaaaacgtaaaacgttagttacgggtaggtaaccttcgttgggttaacgggaaacggggtccccgttaagttacccgaaccctacgttaccccgtaccgaaaggtaaccgaaacccgaaaacccggaacccgtaaaaacgggtaaaccgttaacccgtaaccggtttacgttaacctttaccgttacggaaaccttaaaagtaccggaaaccgtaccggtaacccgtagggaacgggtaaccgggaacccggaaacggggaacccggtaccgggtaacgtttacggttaaacgtttaaccgtaacggtttcgggtacggtacggaacgggttaaccgtaaccgttaccccgttaaggtttacccgttaacccgttttaccccggtttccgttttttaggacccgtttacccgggg

SEQ ID NO: 45543 - DNA, 577 bp, Homo sapiens
  misc_feature: GYAE6OF01C6GNS.27.57.F02.1.454.CMB.1.raw
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
  modified_base (506)..(506): a, c, t, g, unknown or other
  misc_feature (506)..(506): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaggtgtccagtgtgaggtgcaacgtggtggattcgtgggaggaggtgtggtccagcctggagaatccctgacgactctcctgtgcagccttcgtggtacttacctaccgtttagtagttattggatgagtcgtcggtccgcaggacctccggaggggagggctggagttcgtcggaccaacataaaccgagagtaggaaaggtaaaagaaactntaggngtactcgtaggaggaacgggtctattccactactcctacaagacaacaaccgacaaagagcctatntactntanacaatgaacngacctagacgagaccggacggacacggnttagtaacaccttagtgtacggagagacggtacttccgtagtccttaacgtttccgtcgttttgcttccgg

SEQ ID NO: 45544 - DNA, 720 bp, Homo sapiens
  misc_feature: GYAE6OF01A2QL4.27.57.F02.1.454.CMB.1.raw
  modified_base (570)..(570): a, c, t, g, unknown or other
  misc_feature (570)..(570): n is a, c, g, or t
  modified_base (579)..(579): a, c, t, g, unknown or other
  misc_feature (579)..(579): n is a, c, g, or t
  modified_base (670)..(670): a, c, t, g, unknown or other
  misc_feature (670)..(670): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgctattttagaaggtgtccagtgtgaggtgctaacgtggtggattcgtgggaggaggtgtggtcacgcgtaggagaactccctgagtactctcctgtcgcacgcctgtggtattctaccgtttagtagttagttggatgaggtcgtcgggtccgaccgacgtaccgtaccggaagggggtaacggggtccgttaggggtacggtttccggtaaccgggaccctaaaaacgtaacgtaaaaaacccggtaaggtaacgtttaaacgggggtaaaaggaaaaacgttaaaaacgtagttagggttacgaaccgtttgttacgggtaggtaacgggccgtaaatttcccgaactacgttacacccgtaggaaccgaaccgaaaccgcgaaaacgtagctaacggttntactcgtanaactaaacgtggtaaaccggaccttaggaaccggaccgtacgaacgtacggacgtagtacttacgtaacgtacgtacggcgtagaacggtntaccgttaaccgagtttaccttacggtaccgtttttctagcccggtttcg

SEQ ID NO: 45545 - DNA, 689 bp, Homo sapiens
  misc_feature: GYAE6OF01EZLFD.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaactggtggattcgtgggaggaggtgtggtccagccgtggagaactccctgagactctcctgtgcacgcctctggtacttctacctttagtagttattggatgagcgtcgggtcccgcacgtacctccgaggggacgggtcgtgggtacggtttcggtacggaccaaactaacgtaaaaccgaagtaagtagggaaaggttaaaaacgaaaacttagtaggtacggtacttcgtagggtacggaacgggtaccgtacttaccacctattcctaccgaaggtaacgaaaccctaaccggaccaaaggtaaccgtccaacgttagtacttacgtacgaactaaagtacgaacacggtacccgtaggaacggaaccggaccggaaggacccgacggtcttaaggtaacttaccgtacgttggtacgtacggaaggtacgtaccgttcccgtacgttaccttactttcccggtttcttttaggctttacccggg

SEQ ID NO: 45546 - DNA, 743 bp, Homo sapiens
  misc_feature: GYAE6OF01CAECJ.27.57.F02.1.454.CMB.1.raw
  modified_base (286)..(286): a, c, t, g, unknown or other
  misc_feature (286)..(286): n is a, c, g, or t
  modified_base (564)..(564): a, c, t, g, unknown or other
  misc_feature (564)..(564): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgcttattttagaaggtgtccagtgtgaggtgcaacgtgggtggatttcgtgggagggtaggtgtggtcccaggtccctagggacgaactcccctggaacgtcctcctcctgtgcacgcctntggtattcctactttagtagttagtggatggagtcgtcgggtcccgctacgacctccggaaggggacgggtcgtagggacgttcggacggtaaccaaacgtaaacgtaaaaccgtaaggaacgtaagggaaaggtaaaaacgaaaacttgtacggtaggtacctgtacgggtaggaacgggtccgacttaccacctacttccgtacgaaggtaaccgaactaaccggaactaaaggactccaacttgtaaactcgttaagaacttaaagacgtaaacngtacccgtaagggaacgtaccgggaaccgggagtaaacccggtacggttacgttacggttaaactaaacccgttggtaccggtagggaaccggtaaaggtcccgttaactttaaccccgggttagttaccctttaacccgtttcccgggtttacttttaacgggcgtttaaccccgggg

SEQ ID NO: 45547 - DNA, 710 bp, Homo sapiens
  misc_feature: GYAE6OF01A0CLH.27.57.F02.1.454.CMB.1.raw
  modified_base (192)..(192): a, c, t, g, unknown or other
  misc_feature (192)..(192): n is a, c, g, or t
  modified_base (233)..(233): a, c, t, g, unknown or other
  misc_feature (233)..(233): n is a, c, g, or t
  modified_base (620)..(620): a, c, t, g, unknown or other
  misc_feature (620)..(620): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttcctgttgcttatttagagtgtccagtgtgaggtncaacgtggtgattctggaggtaggtgtggtccagcctgganaactccctgagcctctcctgtgcagtccttcgtaggtctttccgtaacctttaggtagtttaacgttgggtattcgaggtcccgttggggccctacgaacgtacctccggaagggggtaacgggtccgttagggtacgttacggtcgggacccaaacgtaacttaaaacccggaagtagtaggggtaaacgttaaaaacggaaacctttgttcggtagacttaccgtgggttacggaacgggtcccgtaatttccgaacctgttacctacccgtaaggaccggaaaccctaaccggccgtaaaagaacgttccaacgttagtctacggtatacgtaaacgtcgaactccggacttaggactacgggtccgaacggtacaaccgggtnttaacggtattaaccgtacgtggtccgagtaagaggtacctttaccgaagttcccgttaacgtcccgtttaagtttgaaccgtttccggg

SEQ ID NO: 45548 - DNA, 715 bp, Homo sapiens
  misc_feature: GYAE6OF01AKGXY.27.57.F02.1.454.CMB.1.raw
  modified_base (269)..(269): a, c, t, g, unknown or other
  misc_feature (269)..(269): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctggttttccttgttgctattttagaaggtgtccagtgtgaggtgcaactggtggattctggaggaggtgtgggtccagcctggagaatccctgagactctcctgtggcacgcctctggnttcaccttttagtacgttattggatggacgtcgtggggtcccgaccaggactccgaggggaagggtcctgggacgttccgtcggaccaaacaactaaaccaagacgtagggaacgggttaaaaagaaaaacctcgtagtcgggtaacctcttaggtacggaaacggggtcccgtaattttcccgaccctataccttacccgaaggacggaaacccaaaccggaccccgaaaagggtaaacggttccctaacgtacgttaacgttccgttacggacctaaaagttcggaaacccgtaagaccccgttagggaacggtcggaacccggtaaggaaccgacggtaccttaggttaactaaccggttaccggtgttacggggaccggaagaccggttacgttccccttaaagtcccttacgttcccgttacgtttttcggcttacccggg

SEQ ID NO: 45549 - DNA, 584 bp, Homo sapiens
  misc_feature: GYAE6OF01DKRYW.27.57.F02.1.454.CMB.1.raw
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (517)..(517): a, c, t, g, unknown or other
  misc_feature (517)..(517): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcagcctctggacttcacctttagtagttattggatgagtctgggtccnccgagcctccgaggggaagggtctggagttcgnggccaaanataaaaccgagatgggaaagtaaagaaactatggtgactcgtagtaggaagggccgtattccgaacctatcctaccgtaagacaacgtaacgacccaaagacgtacacttaggtatcgtagacaaatgaacagcctaggagagaccgagacacggcttagtactacgtacgnggtgaccggaagacgtacgtacccgttaagtccttaaacgtttcccggttcttttggagtttcccgg

SEQ ID NO: 45550 - DNA, 732 bp, Homo sapiens
  misc_feature: GYAE6OF01BYSX7.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaagtgtccagtgtgaggtgcaactggtggattctgggaggaggtgtggtccagcctggagaactccctgagactctctgtgcagcctctggtattctacctttagtagttatggatggagcgtcggggtccacgagtacctccggaggggaacgggtctagggtaggttcgtacggaccaaacgaactaaaaccgaagtagtaagggaaaggtaaaaagtaaactagttaggtacggtaactcgtaggtaaggaaacgggtcctaacttaccaaccgtattaccgtaaccgaaggaaacgaaacccgtaaaccggaacctaaaaggtaacctaccgtaaacgttgtaacttaccgtaagtaaaccctaaaagttacgggaaaccaccgttaccgaacgggtaagggaaaccgggacccgaaagggtaacccgaccgggtacgttaacggttaaacttaccgtaacggttgggtacgaacggtaacggaagttacccgttacccgtaaggttaccttaaccgtttccggtttacctttttacggcgtttaccccggg

SEQ ID NO: 45551 - DNA, 725 bp, Homo sapiens
  misc_feature: GYAE6OF01CT7DI.27.57.F02.1.454.CMB.1.raw
  modified_base (336)..(336): a, c, t, g, unknown or other
  misc_feature (336)..(336): n is a, c, g, or t
  modified_base (673)..(673): a, c, t, g, unknown or other
  misc_feature (673)..(673): n is a, c, g, or t
tcagagcgtcgtctcacgaccggtgctcgatttagctcgatatagttgggtttgaggtctcagagaggagccttagcccctggactccaaggccctttccacttggtgatcagcacggagcacagaggacccacatggaactggggctgagcgttgggttttccttgttgctattttagaaggtgtccagtgtgaggtgcaacgtggtggattcgtgggaggaggtgtggtccagcctggagaactccctagagacctcctccgtgtcgcacgccttcgtggtaacttcctaaccttttaggtagtttaagttggatggaggtcgtcggggtcccnccgaagaccgtaccggaagggggaacggggtccgtagggtacggtttccggtacggaaccccaaaacgaaaacgttaaaaacccgaaaaggaagttaacggggaaaaggttaaaaaacggaaaaaccttagtacggtacggtacttacgtagggtaagggaacgggtacccgtaattacccgaacctacttccgtaaccgaaggaaaccgaaaccgaaaccgaacgaaaagtaactacgaacttagtaactctaaggaactaaatacgaaactacgaccgtaggaagaccgggaaccgaggaaccgacggtccttagtactacgtaccgtggtacgnggaagtcgaacttccgtaagttctaacgtttccgttattttcgcttaccggg

SEQ ID NO: 45552 - DNA, 613 bp, Homo sapiens
  misc_feature: GYAE6OF01ETO5U.27.57.F02.1.454.CMB.1.raw
  modified_base (248)..(248): a, c, t, g, unknown or other
  misc_feature (248)..(248): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaactggtggattcgtggaggaggtgtggtccagcctggagaatccctganactctcctgtgcagccctctggacttctacctttagtagtttattggatggagcgtcgggtccgccgagactccgagggggaacggggctagggagtttcgcggacccaaacgaactaaaaccgaagagtagggaaggtaaaagaaaactagtaggtaggactcgtggtaggaacgggcctattccaccatccaccgagacgaacaaccgcaaaggtaactctactgtactcgtgaactaaagtgaaaccagaccgtaggagacggccggaagaccgacggtcttagtaacttaccgtagtgtacgacggaagcgtaacttccgtaagttacctacggtttacccgtcttttggactttcccggg

SEQ ID NO: 45553 - DNA, 680 bp, Homo sapiens
  misc_feature: GYAE6OF01BCK8X.27.57.F02.1.454.CMB.1.raw
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttccttgttgcttattttagaaggtgtccagtgtgaggtgcaacgtggtggattcgtgggaggaggtgtggtccagcctggagaactccctgagactctcctgtgcngcctntggtattctacctttagtagttattggatgagtctcgggtccncgagacctcgaggggaagggctgggagttcgnggaccaacaactaaaccaagagtaaggaaggtaaaaagaaactagtcggtaggtacctgtaggtaggaaacgggtccgtaacttcaaccctattaccctaccgaagacgtaaacccgaaaccggaccaaaaggtacgtacgtaacgttagttaactccgtagaactaaataacgaacacggtactagggaagtaaccgggaccggaacggaaccgacggtaccgttagttaaaccttaaccgtacggttacggtaccgggacggaaacgtaggtaaccgtttcccgtaaacggttccttaacgttttcccgttacgtttttcgactttaccccggg

SEQ ID NO: 45554 - DNA, 628 bp, Homo sapiens
  misc_feature: GYAE6OF01BK1YD.27.57.F02.1.454.CMB.1.raw
  modified_base (614)..(614): a, c, t, g, unknown or other
  misc_feature (614)..(614): n is a, c, g, or t
tcagagcgtcgtctcacgaccggtgctcgatttagctcgatatagttgggtttgaggtctcagagaggagtccttagccctggactccaaggcctttccacttggtgatcagcacggagcacagaggacccaccatggaactggggctgagctgggttttccttgttgctattttagaggtgtccagtgtgaggtgcaactggtggattctgggagggagggtgtggtccagccgtggagaactccccgtgagacctctcctgtgctagtcctcgtggacttcctaaccttttagtagtttattggtattggaggtcgtcggggtcccgccaggacctccggaagggggaaggggctgggtagttcggtggacctaacgaactaaaccaagtagtagggaaaggtaaaagaaaactgtagtacggactcgtggtacggaacgggccgtattccaacctatcctaccaagacgaacaacgaccaaaggaacgtacacttgtactcgtgactaatcgaactgcctaggacgtacggaccggacggacgcggtacttggtataccgtactggtgacggaggtacgacttaccgtaacgttcgtaactttcccggttnttttcggattccgg

SEQ ID NO: 45555 - DNA, 581 bp, Homo sapiens
  misc_feature: GYAE6OF01D4YFU.27.57.F02.1.454.CMB.1.raw
  modified_base (348)..(348): a, c, t, g, unknown or other
  misc_feature (348)..(348): n is a, c, g, or t
  modified_base (487)..(487): a, c, t, g, unknown or other
  misc_feature (487)..(487): n is a, c, g, or t
  modified_base (567)..(567): a, c, t, g, unknown or other
  misc_feature (567)..(567): n is a, c, g, or t
  modified_base (574)..(574): a, c, t, g, unknown or other
  misc_feature (574)..(574): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctgggaggaggtgtggtccagcctggagaatccctgagactctcctgtgcacgcctcgtggtacttctaccttttagtagttattggatggagcgtcggggtccgccagacctccgaggggaaggggctggagttcgnggaccaacaataaaccaagagtagggaaggtaaaagaaactatggaggactcgtagtggaacgggcctattaccactatccacgaagacgaacaacggaccaaagaacgtccatagtactctagaactaaatcgaaacncgcctaggacgaggccgaggaccacggtactgtaactacgtatggtgacgaagacacgttctacgtctacgtttcccgtnttttcgnttaccgg

SEQ ID NO: 45556 - DNA, 758 bp, Homo sapiens
  misc_feature: GYAE6OF01EN6IP.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacagacggacccaccatggaactggggctgagcttgggttttccttgttgcttattttagaaggtgtccagtgtgaggtgcaacgtggtgtattcgtgggagggaggtgtggtccaggccgtggacgaactccccgtgacgtacctccttccgtgtcgcacgtccttcgtggtacttaccgtaaccgtttttaggttaagtttagttggtatggacgtccggttcggggtcccgccgaacggtaccgtaccggaaggggggaacggggtcttaggggtacgtttcggtacggaacccaaaacgtaaactaaaaccgaaaggtagtaaggggaaaaggtaaaaacgtaaaactgtagggtacggtaccttcggtagggtaacggaacgggtccgtaacgttacccaaccgtaccttacccgtaaccgaaggtaaaccgaaacccgaaacccggtaaccgaaagtaaccgtactaaccgttagttaactaccgtagaacctaaagtacgaaccacggtacgtaggacggacggaccgaagggaccgtacggtcgtagttaacctacgtaacgtggtaccgaggagtacgtaccttaccgtacgttccgttaaccgtttccgttacgttttgcttcccggg

SEQ ID NO: 45557 - DNA, 530 bp, Homo sapiens
  misc_feature: GYAE6OF01AO3YX.27.57.F02.1.454.CMB.1.raw
  modified_base (237)..(237): a, c, t, g, unknown or other
  misc_feature (237)..(237): n is a, c, g, or t
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctggaggaggtgtgggtccagcctgganaatccctgagactctcctgtgcagcctctggattcacctttagtagttattggatgagctgggtccncagactccgagggaagggctggagttcgtggccaacataaaccaagataggaaggtaaaagaaaactagtgtaggactactgtagaagggcctattcaccatctccagagacaacgccaagaatcactgtatctgacaatgaacagcctgagagcgagacacggactgtacgtactacgtgtcgcgaagagactaccgtacgtctattcccgtattttgattccgg

SEQ ID NO: 45558 - DNA, 784 bp, Homo sapiens
  misc_feature: GYAE6OF01CS2Z0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaggtgtccagtgtgaggtgcaacgtgggtggattcgtggagggtaggtgtgggtccaggcctggacgaactccctggagacctctcctggtgcacgcccttcgtggtacttccgtaccgttttaagtagtttagttgggattggacgtccggttcggggtcccgaccgaaggtacctcccggaaggggggtaacggggccgttagggacgtttccgggtcgggaacccaaacgtaagttaaaacccgaaggtacgtaaggggtaaaggtaaaaacgtaaaacgtagttaggtacggaacttcgtaggtacgggtaaacgggcccgtaacttaccgaacctacgttcctacccgaagtaacgaaccgtaaacccggaccaaaagggtaacctcctaacgttacggtaactccgtagaaacctaaagtaccggaaacgtaacgaccgttacggaacgacggacccgggtaaggaacccggtacgggtaccgttaagtaaccgttaaccgttaccgttagggtaccgacgggtaaagaccggttaaaccttcccgtaagtttaccccgttaacgttttcccggtttaacgttttggaacccttttcccgggg

SEQ ID NO: 45559 - DNA, 745 bp, Homo sapiens
  misc_feature: GYAE6OF01ESAES.27.57.F02.1.454.CMB.1.raw
  modified_base (233)..(233): a, c, t, g, unknown or other
  misc_feature (233)..(233): n is a, c, g, or t
  modified_base (598)..(598): a, c, t, g, unknown or other
  misc_feature (598)..(598): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgtggtttctgtgctatttagaggtgtccagtgtgaggtgcacgtggtgattcgtgggaggtaggtgtggtccagcctgggaanactccctagagtactctcctgtcgacacgtcctgtaggtacttaccgtactttaggtagtttagttggatggagtcggttcggggcccgtaccaggtacccgtccggaagggggtacgggccttagggtacggtttcggtacggaacccaaacgtaaacgtaaaaccgaaggtaagtaacggggtaaaaggtaaaaacgtaaaacttacggtacgggtacggtaaccttggtagggtaacgggtaaaccgggcctaactttaccgaaccgtacttcccgaacgaacgtaacgaaacccgaaacccgtaacgaaaggtacgtacctacgttacgttactaccgtagaacctaaagtacggtaaacncggtacccgtaaggacggaacccggacggtaacggacccgtaagggtcttaacggtacttaccgacggttggtaacgacgggtagaaccgttactacccggttaatccgttaacgtttccccggtttattttggaacgtttcccggg

SEQ ID NO: 45560 - DNA, 643 bp, Homo sapiens
  misc_feature: GYAE6OF01BEPNW.27.57.F02.1.454.CMB.1.raw
  modified_base (307)..(307): a, c, t, g, unknown or other
  misc_feature (307)..(307): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaatccctgagactctcctgtgcacgcctcgtggattcacctttagtagttattggatgagcgtgggtccncagacgtccgaggggagggcgtggacgttcgtggaccaacactaaaccgaagagtagggaagtaaaagaaactagtaggtaggacttgtggtaggaacgggacctattccacctatcctaccaagacgaacaaccgaccgaaagaacgtcacttaggtactacgtagaaccaaattacgaacaacggaccgtaggaacgggacgaaccgggacggaacccggtacggaccgttaggttaaccttaacgttaaccggttaggtcggacgggtaacgaacggtaccttaccggtaacgttccttacctttccggttactttttggaaccgtttccggg

SEQ ID NO: 45561 - DNA, 665 bp, Homo sapiens
  misc_feature: GYAE6OF01EELDQ.27.57.F02.1.454.CMB.1.raw
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (185)..(186): a, c, t, g, unknown or other
  misc_feature (185)..(186): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgtggtttcgtgtagctattagagtntnagtntggnnagtgtgntgngagngtgtgcngcgngatactccgtgacgtctctcgtgtcgactacgtccgtcgtagtacttaccgttaacgtttagttagttagtggtagtgtcgtcggtcggtaccgacgtacgacgtacggaggggacggtgtaggtcgttcgacgtacaacgaacgaaacgagtaaggtaaggtaaagtaaaacgtaagtagtaggtacgtacgtaggtaggtacggaacggtcgtactacacctacgtaccgacgtaacgacgaaacccgaacgtaaccggaagtacgtactacgttagtactacgaagaataacgaagtaccgaacgtacgaagaccgggacgaaccggtaggtaccctacggttacgttacgtaaccgttacgtagggtacgacgtaacggaagttaccgtaccgtttacgttaaccgttccgtttacggtttaccgtttcgtttaacggtcccgttaaggg

SEQ ID NO: 45562 - DNA, 762 bp, Homo sapiens
  misc_feature: GYAE6OF01E1S7M.27.57.F02.1.454.CMB.1.raw
  modified_base (212)..(212): a, c, t, g, unknown or other
  misc_feature (212)..(212): n is a, c, g, or t
  modified_base (738)..(738): a, c, t, g, unknown or other
  misc_feature (738)..(738): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgctattttagaggtgtccagtgtgaggtgcaacgtggtggattcgngggaggaggtgtcggtccagccgtaggacgaactccctggacgtacctcttccgtagtgccacgtcccttctcggactttccgtaacctttagtagtttagttcggatgacgtcgtcggtccacacgactccggaggggacgggtcgtgggacgttcggtacggacctaaacaactaaaccgaaggtacgtagggtaaaggtaaaacgtaaaacttgttacggacggtacttaccgtaggtacggaacgggtacccgtacttaccgaacccacgttccctaaccgaaggaaccgtaaaccccgaaaccggaccgtaaaacggtaaaccgtacctaacgttacgttaaccttaccgtacggaaacctaaacgttacgaaaccgtcggtacctaagggaacgtaaccggacccgggtaaacgggaacccgtaaccgggtacttagggtaaccttacgtaaccggtgtacggaacggttaacggaacgtacttaacccggttaaacgtcctaaccgtttttaccccggntttttaaccggcgtttacccgggg

SEQ ID NO: 45563 - DNA, 575 bp, Homo sapiens
  misc_feature: GYAE6OF01EALPY.27.57.F02.1.454.CMB.1.raw
  modified_base (343)..(343): a, c, t, g, unknown or other
  misc_feature (343)..(343): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctggaggaggtgtggtccagcctggagaatccctgagactctcctgtcgcacgcctcgtggacttctacctttagtagttattggatgagcgtgggtccgccagacctccggaggggacgggctgggagttcgnggaccaacaataaaccaagagtaggaagtaaaagaaaactagtaggtcgactctaggtacggaagggcctaattccgaaccatcctacaagaacgaacaacgaccaaagacgtccaacgttgtactactagaacaaacgtcgaacacgcctagagacggcgaacggacacggtctagtaactactagtgcgacgagagactaccgtagtctacttccgttactttgatccgg

SEQ ID NO: 45564 - DNA, 623 bp, Homo sapiens
  misc_feature: GYAE6OF01AVXX2.27.57.F02.1.454.CMB.1.raw
  modified_base (311)..(311): a, c, t, g, unknown or other
  misc_feature (311)..(311): n is a, c, g, or t
  modified_base (596)..(596): a, c, t, g, unknown or other
  misc_feature (596)..(596): n is a, c, g, or t
  modified_base (615)..(615): a, c, t, g, unknown or other
  misc_feature (615)..(615): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattcgtggaggaggtgtggtccagcctggagaactccctgagactctcctgtgcagcctcgtggattctactttagtagttagttggatggagtcgtcgggtcccnccgacgcgtaccggaaggggaacggggctgggacgtttcggtacggacccaaacgaacttaaaaccgaaaggaacgtaaggggaaaggtaaaaagaaaaccgtagtaggtaggaacttcgtggtaggaacgggcctattacacctaattccgtaccgaagacgaaacccgaaaccgaccaaaagaacgtaccacgtagtaactcgtacgacaaatacggaactacgccgtagaacggtacgaccggaagaccgacgtcgtagtactactacgtagtcgagagtancttctagtctacttccgtntttgctcg

SEQ ID NO: 45565 - DNA, 918 bp, Homo sapiens
  misc_feature: GYAE6OF01C2VOU.27.57.F02.1.454.CMB.1.raw
  modified_base (205)..(205): a, c, t, g, unknown or other
  misc_feature (205)..(205): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgtggtttctgtgctatttagaggtgtcagtgtgaggtgcaacgtgggtggattcgngggaggtagggtgtcgggtccaggcctaggaataactcccttgaacgtctccgtccgtgtgcctacgccttcgtggtacttaccgttaaccgtttaggttaacgtttagttgggtattaggtaacggtccgggttcgggggtacccctacccgaacggtacccgttacccgggtaacgggggggaagggggtccttggggttaaccggtttccgggtaccgggaacccctaaaacgaaaactaaaaaacccggtaaggtaaaggtaacgggggtaaaagggttaaaaaactaaaacgtttaacggttagggaacggttaacccgttgtttagggaacggtaaacggggtaccttactttaccgaaacccgttcggttaccccaacccggaaagggtaacccaaccgtaaacccgtaaaccggaaaacggtaaccggttccaaacgggtttcgttaaacaacccgtttagggaaaaccctaaaagggttaccgaaacccgacgggttacccggtaaaggaaccggggaacgggtaccccggaaagggtaaccccggtacgggtacctttaacggggttaaacttaaaccccttttgggacccggtttaacggggacgttaaaacgggcgttttaaacccccgttacggtttaaacggtacccttttaccgtttaaccccggtttatttttccggggaactttttaccccggggg

SEQ ID NO: 45566 - DNA, 917 bp, Homo sapiens
  misc_feature: GYAE6OF01CYTOR.27.57.F02.1.454.CMB.1.raw
tcagagcgtcgtctcacgaccggtgctcgatttagctcgatatagttgggtttgaggtctcagagaggagccttagccctggacctccaaggccctttccacgttggtgatcagcacggagcacagacggacccaccatggaacgtgggctgagtcgttgggttttccttgttgcttattttagaaggtgtccagtgtggaggtgacaacgtggtggtattcgtgggaggtaggtgtcggtccaggtccgtaggacgtaactccctggacgtacctctccgtgtcgctacgtcctcgtggtacttccgtaactttagtagttagttggattggacgtcgtcgggtacccgaccgtaacgtaccgtaccggaaggggtaacgggtcgtacgggttacggtttccggacggaaccctaaaacgtaacgtaaaaaccgaaggtaaacggttaaacggggtaaaaagggttaaaaaacgtaaaacgtttaggttacgggtaacgggttaacccttcgggttaagggtaacggggtaaaccgggtcccgttaaacgtttacccaaacccgtaacgtttcccgtaaaaccccgaaggtaaaacccggaaaccccgtaaaacccgggtaaacctaaaaagggttcccgttaaccgtaacccgtttaagggttaccgttaccgttaaagggaaaccctaaaaggttacccggaaaacccgtaccggttaccggaaacgggtaaccgggacccggtaaacccgggaagggtaaccccgtcggggtttaacttaacgggtttaaacctacccttacgggtagggtaacccggtaacgggaaacgttaacggtaaccccgtttccggtaaacggtttacccctaaccggtttttccggttaacgttttcgggaaccgttttacccggg

SEQ ID NO: 45567 - DNA, 697 bp, Homo sapiens
  misc_feature: GYAE6OF01BZZF2.27.57.F02.1.454.CMB.1.raw
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (247)..(247): a, c, t, g, unknown or other
  misc_feature (247)..(247): n is a, c, g, or t
  modified_base (272)..(272): a, c, t, g, unknown or other
  misc_feature (272)..(272): n is a, c, g, or t
  modified_base (546)..(546): a, c, t, g, unknown or other
  misc_feature (546)..(546): n is a, c, g, or t
  modified_base (563)..(563): a, c, t, g, unknown or other
  misc_feature (563)..(563): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccccacgatggaacctggggctggagtcttgggttttcctgttgcttattttagaaggtgtccagtgtagaggtncaagtggtgattcgngggaggaggtggtcggtccagccgtggaanactcccagacgctcctcctgtgacncgcctacgtggtacttcgtacctttagttagttattggtatcggagtcggtcgggtcccacgacgaccgtcgggaacgggggagggtcgtagggttacggtttcggacggaaccaaacgtaaacctaaaaccgaagtaacggtaaggggtaaacgtaaaaagtaaactgtaggtacggacttggtaggtaacgggaacggtaccgtaattaccgaacctagtccctaacgaagaaccgaaacccgaaacgtcccgaaaagacgtacctaacgtntacgtactagaactaanacgaacgtcgacgtaacggagaaccggacggaacgtaccggagtacgttacgtacgttaccgagttgaccggataacggcgttaccgtacgttaaccgtcgtttaaccgttcgtttctttacgtcgttaccggg

SEQ ID NO: 45568 - DNA, 627 bp, Homo sapiens
  misc_feature: GYAE6OF01CY0SZ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggtttttccttgttgctattttagaaggtgtccagtgtgaggtgcaacgtggtggattcgtgggaggaggtgtggtccagcctggagaactccctgagacctctcctgtgcacgcctcgtggtacttctacctttagttagttattggatgagcgtcgggtccgccacgacctaccggaggggaaggggtctgggtagttccggtcggaccaaacaactaaaaccaagagtaggaaaggtaaaacgaaaactagtgtaggtactcgtaggtaggaacgggtaccgtacttaccgaacctactcctaccgaagacgaaccaaacgaccaaacggagtcacttagtactcagaactaagacgaacaacgcctagacgacgaccggaaggaccgacggtcttagtactaccgtacgtggacggcgaagtcgaccttacctacgttccttactttcccgttcttttgtcgttaccgg

SEQ ID NO: 45569 - DNA, 674 bp, Homo sapiens
  misc_feature: GYAE6OF01BP3PH.27.57.F02.1.454.CMB.1.raw
  modified_base (328)..(328): a, c, t, g, unknown or other
  misc_feature (328)..(328): n is a, c, g, or t
  modified_base (570)..(570): a, c, t, g, unknown or other
  misc_feature (570)..(570): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtcagtgtgaggtgcaacgtggtggattcgtgggaggaggtgtcggtccaggcctagggaacgaactccccgtaggagaccttctccgtgtgcacgcctgtggtacttctacctttagtagttagtggtatgagtcgtgggtcccncgaacgaccgtccggaaggggagggtctgggacgttcggacggaccaacaacgtaaaccgaagaacgtagggaaacggtaaaagaaaacgtgttaggtacgtactgtaggtacggaacgggactacttaccaactagtcaaccagaacgaaccaaccgacgaaagagtctaacttgtaactctagaacctaaagtcgaaacacgtacctaggaaccggacgaacccgggaagaccgacggtnttaacgttaacgtacccgttagtgggtcccggaaggacggtaacgtacttaccccggttaggttaccttaccgtttcccgtttagttttacggcgttacccggg

SEQ ID NO: 45570 - DNA, 630 bp, Homo sapiens
  misc_feature: GYAE6OF01DZ1QC.27.57.F02.1.454.CMB.1.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (594)..(594): a, c, t, g, unknown or other
  misc_feature (594)..(594): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtncaactggtggattcnggaggaggtgtggtccagcctgganaatccctgagactctcctgtncngcctctggcttctacctttagtagttnttgatgagcgtggtccgccagacctaccggaggggaacgggctgggtacgttcgtcggaccaaacgtaactaaaacccgaaggagttaggggaaaaggtaaaaagtaaaaacctttagtaggtacgggtacttccgtgggttaacggaaagggtccctaattcccgaacctatccctacgaagacgaaaccgtaacgaaccaaaggtaactccaacttgtaactcgtagaactaaagtgaacagacctaggaacgacgcccggaagtaccgcggtctacgtaataccgtagtggtacgacggtaganacttcgtacgttctacttcgttacttgtcgttccgg

SEQ ID NO: 45571 - DNA, 777 bp, Homo sapiens
  misc_feature: GYAE6OF01CDCYM.27.57.F02.1.454.CMB.1.raw
  modified_base (220)..(220): a, c, t, g, unknown or other
  misc_feature (220)..(220): n is a, c, g, or t
  modified_base (677)..(677): a, c, t, g, unknown or other
  misc_feature (677)..(677): n is a, c, g, or t
tcagagcgtcgtctcacgaccggtgctcgatttagctcgatatagttgggtttgaggtctcagagaggagccttagccctggacctccaaggtcctttccacttggtgatcagcacggagcacagaggacccaccatggaacgtgggctgagcgttgggttttccttgttgtcttagttttggaaggtgtccagtgtgaggtgcaagtggtggtattcgngggaggtaggtggtcggtccagccgtggaacgtactcccgagacgaccttcgtcctgtcgcgacgtccctgtgtactttacgtaccgtttagttagttattggaattggacgtcggtccggtaccaccgacgtaccgaccgggagggggtaacggtcggttacgggtagggttccggtacggaaccgtaaaaaccgaaacgttaaaacccggaaaggtaaggtaaacgggtaaaagggttaaaaaacgtaaaaccggttgtaacggtacggtaacgtttacgtaaggttacggggaaacggtacccgtattacccaaccgtaccttacgaaccgaagaaacgacccgtaaaacgaccgtaaaacgtagtacctacgttaagtactttacgagaacctaaagtaacgaaccggagtacccgtaaggcgaacccggtacggacggtaaccacgggttanacggttaaattacgttacgacggttcgaacggttagtaacgtacgtaccgttaacgtttccgttaacggtttcccgtttaacttcggtctttacccgggg

SEQ ID NO: 45572 - DNA, 644 bp, Homo sapiens
  misc_feature: GYAE6OF01DT7D4.27.57.F02.1.454.CMB.1.raw
  modified_base (175)..(175): a, c, t, g, unknown or other
  misc_feature (175)..(175): n is a, c, g, or t
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
  modified_base (424)..(424): a, c, t, g, unknown or other
  misc_feature (424)..(424): n is a, c, g, or t
  modified_base (474)..(474): a, c, t, g, unknown or other
  misc_feature (474)..(474): n is a, c, g, or t
  modified_base (485)..(485): a, c, t, g, unknown or other
  misc_feature (485)..(485): n is a, c, g, or t
  modified_base (515)..(515): a, c, t, g, unknown or other
  misc_feature (515)..(515): n is a, c, g, or t
  modified_base (544)..(544): a, c, t, g, unknown or other
  misc_feature (544)..(544): n is a, c, g, or t
  modified_base (575)..(575): a, c, t, g, unknown or other
  misc_feature (575)..(575): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactgggctgagcgtggtttcgtgtagctattagagtncagtgngagtnacactggtgattgnggagnggtgtaggtccagccgtagganactcctagacgtctcgtctggtcgcacgtcctcgtgtacttctacgttttagtagtttagttggataggtacgtcggtggggtcccacgagtcccgtacgggaggggaggtgttaggcgtttaccggacggaacctaacgaaacttaaaccggaagtagtaagggtaaaggtaaaataacgtagtggtacgacgttnagggtaacggaggtcctagtacacctatccgacaaggtcaacgaaccganaacggtatccngttatactacgtcgaataaagtgtaaccgnccgtaaggacgtacccggagtaacgggcnccgggttaataggtttaacctcttaacgggnggtaccggaaggaactcggtttacctagttacgtacctttaccgttacggtttcttaggaccgttcggg

SEQ ID NO: 45573 - DNA, 583 bp, Homo sapiens
  misc_feature: GYAE6OF01AOK9W.27.57.F02.1.454.CMB.1.raw
  modified_base (306)..(306): a, c, t, g, unknown or other
  misc_feature (306)..(306): n is a, c, g, or t
  modified_base (538)..(538): a, c, t, g, unknown or other
  misc_feature (538)..(538): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaggtgtccagtgtgaggtgcaactgggtggattcgtggaggaggtgtggtccaggcctggagaatccctgagactctcctgtgcagcctctggattcacctttagtagttattggatgagtcgtgggtccnccagtactccgaggggaagggctgggagttcgtggccaacagtaaaccaagatagggaagtaaagaaactagtgtggtactcgtaggtggaacgggccgattccacctatcctaccgagacgaacaacgacccaaagacgtcactagtatctagacaagtacgaacacgaccgtgaaggacgaccggacggaaccacgggtcttgtacgtaccttacgtggtcgacgaaggngtaccgtccgtacgtcttacttacccgttcttttcgagttcccgg

SEQ ID NO: 45574 - DNA, 790 bp, Homo sapiens
  misc_feature: GYAE6OF01CX6KY.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtggtattcgtgggaggtaggtgtggtccagccgtaggacgaactcccgtgacgtactctccgtgtcgcacgtcctcgtaggtacttaccttaccgttttaagttacgtttagttggtagttggagtcggttcgggtacccgccgacggtacgtaccgggaagggggacgggtcgtagggtacgttcggtacggaccaaacgtactaaaaccgaagtagtaacggaaaggtaaaagtaaactagtggtacgtacgtacgtggtaacggtacgggtaccctagttcccgaaacctacgtacccgtaaccgaaagggaacaaaccccgaaacccggtaacgaaaaggtaaccgttacaaccgtttaaggtacttacgtaacgtaactaaaattacggaaaccgtacgaccggtaacggaacgtacccgggaaccggtaacgggtaaccggtaccggtaacggttaacgttaaccgtaaaccgttacggtacgggtacgtaacgggtaacggtaacggaccctttacccgggtaagttcccgtttaaccgtttccccggttttacgtttcgttaccgtttacccgggg

SEQ ID NO: 45575 - DNA, 620 bp, Homo sapiens
  misc_feature: GYAE6OF01A1DZ1.27.57.F02.1.454.CMB.1.raw
  modified_base (308)..(308): a, c, t, g, unknown or other
  misc_feature (308)..(308): n is a, c, g, or t
  modified_base (502)..(502): a, c, t, g, unknown or other
  misc_feature (502)..(502): n is a, c, g, or t
  modified_base (539)..(539): a, c, t, g, unknown or other
  misc_feature (539)..(539): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtggtggtccagcctggagaactccctgagactctcctgtgcagcctcgtggattctacctttagtagttattggatgagcgtgggtccnccagactcgaggggacgggctgggagttcgcgaccaacaactaaaccaagatagggaaggtaaacgaaaactagtggtagtacttcgtggtaggaacgggtccgtattccgaacctacgttcctaccgaaggaaccgaacctaaaccgacctaaagaaccgttcaacgttgtactcgtagaactaaagtgaacncgtacctaggaagtacggaccggacggacgaccggtntaggttactaccgtaagtgtacggagaggtacgtacttaccgttagttaccttactttcccgttctttttcggacttccgg

SEQ ID NO: 45576 - DNA, 786 bp, Homo sapiens
  misc_feature: GYAE6OF01C8HCS.27.57.F02.1.454.CMB.1.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
tcagagcgtcgtctcacgaccggtgctcgatttagctcgatatagttgggtttgaggtctcagagaggagccttagccctggactccaaggccctttccacttggtgatcagcacggagcacagaggacccacatggaactggggctgagctgggttttccttgttgctattttagaggtgtccagtgtgaggtgcaacgtggtggattcgtgggaggaggtgtggtccagccgtggagaactccctgagactctcctgtgcngcctctggattctactttagtagttnttggatgagtcgtcgggtccgccagacctaccggagggggaagggctagggagttcggcggaccaacgaataaaaccagtaagtagggaaaggtaaaagaaaactagtagggtaggacttcgtaggaggaaacgggtcccgtaatttacccgaacctaacgtccctaaccgaaaggaacgtaaacccgaaacggaacccgaaaaaggaaccgttacctaacgtttacgtaactacgttaaggaaccctaaaagttacggaaaaccctaacgggtacccttaagggaaacgggaacccgggtaaccccggggaaacgggaacccgtaccgggggtacctttaaggtaaaccgttaaaccgtttacccgttaggggttaccgggaaccggttaaacgggaaacgttaaacccgttttaccccgggttaacggtttaaccctttaaccggtttttaccccggttttaacgttttttcggggtaaacccttttccccgggg

SEQ ID NO: 45577 - DNA, 749 bp, Homo sapiens
  misc_feature: GYAE6OF01DWF9A.27.57.F02.1.454.CMB.1.raw
  modified_base (613)..(613): a, c, t, g, unknown or other
  misc_feature (613)..(613): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgttgctattttagaggtgtccagtgtgaggtgcaacgtgggtggtattcgtgggaggaggtggtcggtccaggtccgtagggaagaactcccgtagacgtactctcctgtcgcacgtcctcgtaggtacttacctaccgttttaggttagtttagttagggtattggtacggtccggttcgggggtcccgtacccgaaggtacccgttaccgggaaggggggtaacggggtcgttagggtacgtttcggtacggaccctaaactaacgtaaaaccgaaggtaacgtaaggggaaaaggtaaaacgtaaaacgttagtacggtacggacttcggtaggtacggaacgggtcctaactttccgaacctacttccgaccgtaagaacgtaaccgaaccgaacccgaaagtaccgtactaagttcgtaactcgtacgaaactaaagtacggaaacncggtaccgtaaggacgtaccggaccggaacggaccgtaccggtattacggtaactaccgtagttcgggacgtacgggaggtacgtaccttaccgaacgttccttacctttccggtttacttttgctttacccgggg

SEQ ID NO: 45578 - DNA, 597 bp, Homo sapiens
  misc_feature: GYAE6OF01BQH69.27.57.F02.1.454.CMB.1.raw
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
  modified_base (345)..(345): a, c, t, g, unknown or other
  misc_feature (345)..(345): n is a, c, g, or t
  modified_base (473)..(473): a, c, t, g, unknown or other
  misc_feature (473)..(473): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctgggaggaggtgtggtccagcctggagatccctgagactctcctgtgcagcctctggacttcacctttagtagtttattggatgagtcgtcgggtccnccagctccgaggggagggctggagttcgngaccaanactaaaccagataggaaggtaaaagaaacgtatgtaggactcgtgaggaagggcctattccactagtcctaccgagacgaaccaacgaccaaagtacgtcaacgtgtactctagacaaagtacgaacngtaccctaggaacgtaacggccggaaggacccacggtcgttagtaactaccgttaacgtgtacggacgaaggtacgaccttaccgtagttccttaccgtttccgttcgttttgacgttcccggg

SEQ ID NO: 45579 - DNA, 812 bp, Homo sapiens
  misc_feature: GYAE6OF01DMKAB.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaacgtgggctgagtcgttgggttttccttgttgtcttagttttagaaggtgtccagtgtgaggtgcaacgtggtggattcgtgggaggaggtgtggtccagccgtggaagtaactccctgacgtactcctccgtgtcgcacgtcctgtaggtacttccgttaacctttagttagtttagttaggatggacggtcgtacgggtcccgacgaacgtaccgtaccggaaggggtaacgggtcgttacggggtaggtttccggaggaaccccaaaacgtaacgtaaaaaccgaaggtaacggtaaagggtaaaacgggttaaaaacgtaaaacgtaggttacggtacggttaacctttacggtacgggtaagggaaacccgggtaccgttaaccgtaccctaacccttagttaccccgtaccggaaagggaaccgaaacccgaaaccggtaacgaaaaggtaccgttaacctacgttacgttaacgtcgtaacggaaactaaagtaccgaaacggtcgtaccgagggtaaacggacccgggaaccggtacgggaaaccctccggggtaacttaggttaaacctaaccggttagtcggggtacggacgttaaacgcggttaacccttaccggttaagttccccgttaacggttttcgtttaccgttttcgaagtttcccgg

SEQ ID NO: 45580 - DNA, 701 bp, Homo sapiens
  misc_feature: GYAE6OF01B82O1.27.57.F02.1.454.CMB.1.raw
  modified_base (312)..(312): a, c, t, g, unknown or other
  misc_feature (312)..(312): n is a, c, g, or t
  modified_base (605)..(605): a, c, t, g, unknown or other
  misc_feature (605)..(605): n is a, c, g, or t
  modified_base (639)..(639): a, c, t, g, unknown or other
  misc_feature (639)..(639): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgttgctattttggaaggtgtccagtgtgaggtgcaactggtggattctggaggaggtgtggtccagcctggagaatcccgtgagactctctgtgcagcctcgtggaattcctaacctttagtagtttattggatggagtcgtcggggtccncgtagactaccggagggggaaggggctagggtaagttccggtaggacccaaagtaactaaaaccgaaggaacgtagggaaaggttaaaacgaaaactttagtcggtaggtaaccttcggtacggtaggtaaacggggcctaacgtttacccaaccgtacttccctaaccgaaggtaaacgaaccccgaaaccggaaccgaaaagaacgttacaaccgttaggttaactccttagaacctaaagtaccgaaacgacgtccgtaagacggacggacccggtaagaccgaccggtntacggttacttaactacgtacggtcggaaggaanacgttacgtaaccctttagtcccgttaactttcccggttacgtttttgaacgttttcccggg

SEQ ID NO: 45581 - DNA, 722 bp, Homo sapiens
  misc_feature: GYAE6OF01DQ2P1.27.57.F02.1.454.CMB.1.raw
  modified_base (211)..(211): a, c, t, g, unknown or other
  misc_feature (211)..(211): n is a, c, g, or t
  modified_base (711)..(711): a, c, t, g, unknown or other
  misc_feature (711)..(711): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttcctgttgctattttagaggtgtccagtgtgaggtgcaacgtggtggattcgnggaggaggtgtggtccagcctggagaatccctgagctctcctgtgcagtccctcgtaggtacttcctaaccgttttagtaacgtttagttggattggacgtcgtcggggtcccaccgaagtaccgtccggaagggggtaacggggtcgtaggtacggttcggtacggaacccaaagtaactaaaaccgagtaacgtaacgggaaaggtaaaaacgaaaacgtttagtaggtcggtaaccttgtacggtaagggaacgggtccctaagttccaacccttataccgtaccgaagaacggaaacccaaacggaaccctaaaaggaacgttaccgtaaccgttagtaaacgttccgttagaaaccgtaaaataccgggaaaactcggaacccgttagaaacgggtaccggacccggaagggtaccgtaccgggacttagtaatacccgtagtcggtgacggaaggtactaccgttccaagttccttaacttccgtttacgtttnacgtttcccgg

SEQ ID NO: 45582 - DNA, 647 bp, Homo sapiens
  misc_feature: GYAE6OF01CKKK6.27.57.F02.1.454.CMB.1.raw
  modified_base (118)..(118): a, c, t, g, unknown or other
  misc_feature (118)..(118): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (337)..(337): a, c, t, g, unknown or other
  misc_feature (337)..(337): n is a, c, g, or t
  modified_base (584)..(584): a, c, t, g, unknown or other
  misc_feature (584)..(584): n is a, c, g, or t
  modified_base (636)..(636): a, c, t, g, unknown or other
  misc_feature (636)..(636): n is a, c, g, or t
tcagagcgtcgtctcacgaccggtgctcgatttagctcgatatagttgggtttgaggtctcagagaggagccttagccctggactccaaggcctttccacttggtgatcagcacggancacagaggacccaccatggaactgggctgagcttgggttttcctgttgcttattttagaaggtgtccagtagtgaggtgcaactggtgattcgtggaggaggtgtggtccagcctggagaatccctgacgctctcctgtggacncgcctcgtgtattcctacgtttagagttatggattgngtcgtgggtccncagcctcgagggaggctggagttcgngacaacataaaccgagacgtaaggaaggtaaaacaaactgtagtacgtacttcgtagtaggggaaccgccgtattacccgaactagtacgtaccccgagaccgaaactaaaccgcccgtaaaaggtaccgtacctacgtacggttactacgttaacgaacgtaaacttgaaaccgacggtacacggaacggacggtacccggaaggtcccgacggttagtacgttacttacgaactgggtaccgaanaacgggtctacgttaccgggtaactaccttacgttacccgttacgttttcgntttacccgggg

SEQ ID NO: 45583 - DNA, 647 bp, Homo sapiens
  misc_feature: GYAE6OF01B2DLI.27.57.F02.1.454.CMB.1.raw
  modified_base (307)..(307): a, c, t, g, unknown or other
  misc_feature (307)..(307): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgtgctattttagaaggtgtccagtgtgaggtgcaactggtggattctgggaggaggtgtggtccagcctggagaatccctgagacctctcctgtgcacgcctcgtggattctacctttagtagttattggatgagcgtcgggtccnccgagactccgagggaagggcgtaggagttcgtggaccaaacaactaaaaccgaagaagtagggaaaggtaaaagaaaactagtaggtaggactcgttaggtaggtaacgggccgtaagttaccaaccgtacttctacccgaaggaacgaacgaaaccgaccgaaaacggaaacgttaccaacgttagtaacgttactagaacctaaagtacgaaacgacgtacctacggaaggaacggacccggaaggaaccgacggacgttacggttaactacctaacgttggtacgacggaaggacgtaacgtactacgttcactttcccgtcttttgtcttaccgg

SEQ ID NO: 45584 - DNA, 880 bp, Homo sapiens
  misc_feature: GYAE6OF01D3T8J.27.57.F02.1.454.CMB.1.raw
  modified_base (212)..(212): a, c, t, g, unknown or other
  misc_feature (212)..(212): n is a, c, g, or t
  modified_base (687)..(687): a, c, t, g, unknown or other
  misc_feature (687)..(687): n is a, c, g, or t
  modified_base (699)..(699): a, c, t, g, unknown or other
  misc_feature (699)..(699): n is a, c, g, or t
tcagagcgtcgtctcacgaccggtgctcgatttagctcgatatagttgggtttgaggtctcagagaggagccttagccctggactccaaggccctttccacttggtgatcagcacggagcacagacggacccaccatggaacgtgggctgagtcgttcgggtttttccttgttgtcttaatttttaagaaggttgtaccagttggtgaggtnactaacgtgggtggtattcgtgggaggtaggtgtcggtccgagtccgtggacgaactcccgtgacgactctccgtgtcgcacgtccctcgtacggtacttaccttactttaagttagttagttaggtatggtacggtccggtccggggtacccgaccgtacggtaccggtaccgggaacgggggaacgggtcgttagggtacggttccgggtacggaaccccaaaaccgtaacgtaaaaccggaaagtaaggtaacggggtaaaaagggttaaaaacgtaaacgttaaggtacgggttacggtaacccttacggtagggtaacggaaaccggggtacccttaacgttacccggaacccttaacgtccccgttaaccggaaacggaaccggaaaacccgtaaccggaaaccctaaaagggttaccggtaccctagtttacggttaaacttaccgtaacgggtaaaccgttaaaacnccgggtaaaacnccgggtacccggtaaagggaaccgggtaaccgggaccggggtaaccggtaaccggaccggtttacgttaacccttaaaagttacccgtacccgggtttaggaccggaaggttaacggtaacgttacccgttaccggtacgttactttaccgtttccgtttacgttttagcccggttacggg

SEQ ID NO: 45585 - DNA, 716 bp, Homo sapiens
  misc_feature: GYAE6OF01BP5NN.27.57.F02.1.454.CMB.1.raw
  modified_base (261)..(261): a, c, t, g, unknown or other
  misc_feature (261)..(261): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggactggggctgagctggtttcctgttgctattttagaaggtgtccagtgtgaggtgcaacgtggtggattctggaggaggtgtggtccagcctggagaatccctgagactctcctgttcagcctntggattcacctttagtagttatggatgagctgggtccncagctccgagggaagggctggagttcgnggaccaaacactaaaaccgaaggtacgtagggaaaagtaaaacgtaaactagtacggtacgtacgttcgtagggtacgggaacggtaccgttaactaccgaacgtctacccgtaacgaaggtaaccgaaaccgacccgaaaccggtaaagggtacctaaccgtagttacgtaaccgtcgtaggaaccttaaaggaacctaacgacgtaccgtaggaaggtcccgaacgggtaaccggacgacccgggttataacggttaacctacggtttacccgagggttaccgaacggttaaggaaccgtaccctttaaccggttaaccggttaccccttttaccggttaacccgtttttacggtttagttccccgtttaccgggttaaccgggggg

SEQ ID NO: 45586 - DNA, 707 bp, Homo sapiens
  misc_feature: GYAE6OF01EXN6Q.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaactgggtggattcgtggaggaggtgtggtccagcctggagaactccctgagactctcctgtgcagcctctggtattctacctttagtagtttattggatggtagcgtcgggtccgccgagcgtccggaggggaagggctagggtagtttcggacggtccaaacgaactaaaccaaggaacgtagggaaaggtaaaagaaaaacttagtaggtcgtaacgttcgtaggtacggaacggggtaccctaacttaccgaccctaacgttacctacccgaaggaacgaacccaaaacggtaccccaaaaggtaaccgtacctaaccgttagttaactaccgttacgaactaaaatcgaaacgacgtcccgtaggaacggaaccggaccggaacgggaaccacgggtcttaaggttactaaccgttaacgttcggtacggacggaaggtacgtaaccgtccgtttaaccgtccttaaccgtttcccggtttctttttacggtcgttccccggg

SEQ ID NO: 45587 - DNA, 924 bp, Homo sapiens
  misc_feature: GYAE6OF01B5L5P.27.57.F02.1.454.CMB.1.raw
  modified_base (259)..(259): a, c, t, g, unknown or other
  misc_feature (259)..(259): n is a, c, g, or t
tcagagcgtcgtctcacgaccggtgctcgatttagctcgatatagttgggtttgaggtctcggagaggagccttagccctggactccaaggcctttccacttggtgatcagcacggagcacagaggacccaccatggaactggggctgagctgggttttccttgttgctattttagaaggtgtccagtgtgaggtgcaacgtggtggattcgtggaggaggtgtggtccagcctggagaactccctgagactctcctgngcagcctctggattcacctttagtagttattggatgagcgttagggggtcccgaccgagtaccgtcccgaagggggtaacgggggtccgtaggggtaaggttttccgggtacgggtaccccaaaacgtaaacgttaaaaaaccccgaaaggtaaacgtacgggggtaaaacggggttaaaaaaacggtaaaaaaccgttaagttaagggttacggggtaaccctttcggttacgggtttaacggggaaaaccggggggtccccgggtaaacttttaccccgaaaccccgtaagttacccccgtttaacccgaaacgggtaacggtaaaccccgaaaaaccccgggtaaccccaaaaaagggtaaaaccggttaaccctaaccgttttacgggttaaacttacccgtaacgggtaacccttaaaaagttcggaaaaccgaacggtaccccgttaggggaaccgggaaacgggtaccccgggaaacggggtaaccgtaacccggggtaccgtttaaggttaaccgttaacccgtttaaccgtcgggttaaccgggtacgggaaacggtaacgggtaaccttccccggttaaaggttaccccgttaaacggttttccccggtttaccgttttttacgggaaccgttttccccggttaacccggggggg

SEQ ID NO: 45588 - DNA, 691 bp, Homo sapiens
  misc_feature: GYAE6OF01CNC1I.27.57.F02.1.454.CMB.1.raw
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (329)..(329): a, c, t, g, unknown or other
  misc_feature (329)..(329): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacagtggaactgggctgagcgttgggttttccttgttgctattttagaagtgtccaggtgtggaggtgacaacgtggtggattcgtgggaggnggtgnggtccagcctaggaacaactccgtgacgacctctccgtggtcgcacgtcctgtggattcttaaccgtttagttagttagtggagtgtacgcgtcgggtccncgacgacccgtacggaaggggtacgggcgtgggtacggtttcggacggaaccaaacgtaaacgaaaccgaaaggaagtaaggggaaaggtaaaaagaaacgtagtggacgtaacgtcgagggtacggtaacggtccagttccgaactacgtactaccgaagaaccgtaaacgaacgaacgtaaacgaactacgtactaggtactacgtagaaactaagtagaaaccgtcggaaccgtaggaaacgcggaaaccggtagaaccggacggtcgtacgtaacgtaaccgttgtacggacgggaacaggtaaacgtcgttaccggtatacccgttacgttcctttcgttttaagccctttaacggg

SEQ ID NO: 45589 - DNA, 672 bp, Homo sapiens
  misc_feature: GYAE6OF01A5WRK.27.57.F02.1.454.CMB.1.raw
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctcgtggattcacctttagtagtttattggatgagtcgtgggtcccnccagactccgaggggaacgggtctgggagttcggnggaccaaacgtactaaaccaagacgtagggaaaggtaaaagaaaactgtaggtaggacttcgtagtaggaacggccgtattccaacctattcccgtaccgaagacgaaaccgaaccgtaaccgaaagtaacgtccaagttagtactaccgtgaacctaaagtcgaaacgtacgcccgtaggaacgacgacccgggaaggaaccgtaccgggtcttaaggttaacctacgtaacgttcgggtacgaaccggtaacggtaagttaacccttacccgttaacggttacccgttaactttcccggttaactttttggaacccgtttaccggg

SEQ ID NO: 45590 - DNA, 727 bp, Homo sapiens
  misc_feature: GYAE6OF01AISE7.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattctacctttagtagttatggatgagcgtgggtccgtcagacgtccgaaggggaacgggcgtgggtagttcggtggaccaaacaactaaaaccgaagaagtagggaaaggtaaaagaaaactagtgtaggtactacgtaggtaggaaacgggccgtattaccgaaccctattacccgtaccaaggaacgaaacctaaaaccggaccgaaaacggtaaacgtaccgtaacttacgggttaactcccgttaagaacctaaaattaaccggaaaccgtaacggtaccccgtaagggaacgggaacgggaccccggtaaagggacccgtaacgggtccttaaggttaaccttaaacgttacccgttagggttacgaccgggtaaaggtaacggttaacccttaccggttaacgtaccccttaaacgttttcccccgtttcgtttttagggtaactttacccggg

SEQ ID NO: 45591 - DNA, 941 bp, Homo sapiens
  misc_feature: GYAE6OF01BTM8B.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaactggtggattctggaggaggtgtggtccagcctggagatccctgagaccttcctccgtgtcgcacgccttgtggactttcctaccttttagtaagtttagttggtatggtagcgtcggggtcccgccgaacggtaccgtccggaagggggaaggggtccgtgggtacgtttcggtacggacccctaaaacgaaccgtaaaaacccgaaaggtagtaacggggtaaaacggtaaaaacggtaaaaacttacgttaagggttacgggtaacctttacggttagggtacggggtaaacccgggggtacccgttaacgtttaccccgaaccccgtaacttacccgttacccaaacggggtaaccgtaaacccggaaaaacccggaaccccggtaaaaaacgggtaaacccggttaaccgtaaccgtttaacggtttaacctttacccggttaaccggtaaacctaaaaaccgtttacggaaaacccggtaacccgtaccccggttaaacgggaaaccggggtaacccgggtaacccccggggtaaacggggaaccccggtaaccggggttacccggtttaaacggttaaaccggtttaaaccccgttaaccggtttacgggttaccggggaacgggtaaacggggttaaacggttaaccggtttaaccccgtttaacccggtttaacctttacccggttttaccccggttttaaccgttttttccgaaccgttttacccccgggg

SEQ ID NO: 45592 - DNA, 742 bp, Homo sapiens
  misc_feature: GYAE6OF01CL6ZP.27.57.F02.1.454.CMB.1.raw
  modified_base (724)..(724): a, c, t, g, unknown or other
  misc_feature (724)..(724): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtgggctgagcgttgggttttccttgttgtcttagttttagaaggtcgtccagtgtggaggtgactaacgtggtggtattcgtgggagggtaggttggtcggtccaggtccgtagggaagtaacctcccgtaggacgtaccttccgtcctggtcgccgacgtcctcgtggtacttccgttaaccgtttagttagttagttggataggcgtcggttcgggtcccaccgacggtaccgtacggaaggggggaacggtcgtgggtacgttcggacgaccaaacgtaactaaacgagagtaaagggtaaaggtaaaactaaagtagtacggagtactgtaggaggtaaccggcgtactaccgaactctacgtaccgaagacgaaaccgaaccggaccgtaaaagtaccgtactacggtttacgtactcgtataaacgtaaataccggaacgaccgtaccgtaagggaaccgggaccgaaccggggacggtaacccggacgtaacgttacgttaaagttaccgtcggtaaggtcccggtagtaaggtacctacggtttacccaggttacttacccgtttacccgttttnttaccgtacgttacccgg

SEQ ID NO: 45593 - DNA, 629 bp, Homo sapiens
  misc_feature: GYAE6OF01A2OUM.27.57.F02.1.454.CMB.1.raw
  modified_base (494)..(494): a, c, t, g, unknown or other
  misc_feature (494)..(494): n is a, c, g, or t
  modified_base (611)..(611): a, c, t, g, unknown or other
  misc_feature (611)..(611): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgaggggaagggctgggagttcggtggccaacataaaccaagactaggaagtaaaagaaactatgtaggactcgtaggtagaagggccattccaacctattccctaccgaaggtaacgaaccaaaccggtacccaaaaggtaacgtaccaacgttagtaactcgtacgacaaaagttcgaaacgngtaccctaggaacggacggacccggaaggaccgaaccgggtacttacggtaaactacgtaaccgtggttcgaccgaaggacgtactacccgttaacggtctaacgtttaccccgttntttttcgaagtttcccgg

SEQ ID NO: 45594 - DNA, 807 bp, Homo sapiens
  misc_feature: GYAE6OF01EZTTK.27.57.F02.1.454.CMB.1.raw
  modified_base (246)..(246): a, c, t, g, unknown or other
  misc_feature (246)..(246): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaacgtggggctgagcttgggttttccttgttgcttattttagaaggtgtccagtgtgaggtgctaacgtggtggtattcgtgggaggtaggtgtggtccagccgtggaanaactccccgtgacgaccttctccgtgtcgcacgtcccttcgtaggtacttaccttaaccgttttaagttagtttagttggatggacggtcgtcgggtcccacgacgtacctaccgggaaggggacgggtctgggtacggttcggtacggaccaaacgtaaacgtaaaccgaagaggtaagggaaaggtaaaaacgtaaacgtagttaggtacggtaccttagtagggtaaggaaccgggtcccttaacgttaccgaacccgtacttacccgtaccgaacggtaaacgaaacccgtaaaccggaacctaaaaggtaacggtacctaacgttacgtttaactaccgtacgaaactaaacgtaccggtaaacctacgggtaccgtaaggaaaccgggaccgtaacccgggaacgggaaccccgtacgggtacttaaacggttacgttaacccgttaaggttcgggtaacgaaccgggtaacggtaaacgttaccgtttaacccgttaagtaccccggttttaacctttaccccggttttagttttccggccgtttaacccgggg

SEQ ID NO: 45595 - DNA, 770 bp, Homo sapiens
  misc_feature: GYAE6OF01BJ38L.27.57.F02.1.454.CMB.1.raw
  modified_base (226)..(226): a, c, t, g, unknown or other
  misc_feature (226)..(226): n is a, c, g, or t
tcagagcgtcgtctcacgaccggtgctcgatttagctcgatatagttgggtttgaggtctcagagaggagccttagccctggactccaaggcctttccacttggtgatccagcacggagcacagacggaccccacatggaactggggctgagcgttgggttttccttagttgctattttacgagtgtccagtgtgaggtgcaacgtggtggtactcgtagggaggnggtgtcggtaccagccgtaggacgtaactcccgtaggacgtccttactccgtaggttcacgtacgtccctttgacggttactttaccgtaaccgtttagttacgttaggttcggtattcggaacgtccggtcgggtcccacgtacggtacccgttaaccgggagggggaccgggtcttagggtaacgttccggaccgggaacctaaaacgaacgttaaaacccgaaggtaggtaacggggtaaaacgtaaaacggtaacgttgtacggttaaggaaccgttgtaccgggtaagaaccgggtcctattacccgacctaacgttaccaccggacgaacgaccgaaacgcgaaacgtacgtacctacggtacttccgtacaagtacccttaagggaaccaccgtaagttaccgaggtaacccggtaccggaaccgggaccgacgtacgggttaccctagggttaactaccggttacgcggtgtaaccgtgaaacgtcccgtacttaagggtccctacgggtttactccgtttagcgttaccccgggg

SEQ ID NO: 45596 - DNA, 667 bp, Homo sapiens
  misc_feature: GYAE6OF01DA5KK.27.57.F02.1.454.CMB.1.raw
  modified_base (174)..(174): a, c, t, g, unknown or other
  misc_feature (174)..(174): n is a, c, g, or t
  modified_base (186)..(187): a, c, t, g, unknown or other
  misc_feature (186)..(187): n is a, c, g, or t
  modified_base (331)..(331): a, c, t, g, unknown or other
  misc_feature (331)..(331): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgttggtttctgtgctatttagagtntcagtgtgagtnnagtggtgatgtggaggagtgtgtccagcctggagactcctgaagcctctctgtcgcacgtcctgtaggtacttctaaccgttttaagtagtttagtaggtataggacgtcgtcgggcccacacgacctacggaagggggacggngttagggacgttgacggaaccaaacgtaactaaaaccgaaagtaggtaagggtaaaaggtaaaaagtaaaactagtggtacggacttcgtaggtaacgggacgggtacctagttaccgaacctagtacctacgaaggaaccgaacgaaaccggaactaaaggtacgtacctaactagacttacgagaactaaagtacgaaacgtcggcgtaacggaacgtaccgaccggaacggtaaccgaccggttacgtaacgttaactacgtaacgtgggtacgtacgaaggacgttactacggttacgtacttacgtttaccggttacttttgacgtttcgg

SEQ ID NO: 45597 - DNA, 740 bp, Homo sapiens
  misc_feature: GYAE6OF01D4V9D.27.57.F02.1.454.CMB.1.raw
  modified_base (219)..(219): a, c, t, g, unknown or other
  misc_feature (219)..(219): n is a, c, g, or t
tcagagcgtcgtctcacgaccggtgctcgatttagctcgatatagttgggtttgaggtctcagagaggagccttagccctggactccaaggtcctttccacttggtgatcagcacggagcacagacggacccaccatggaacgtgggctgagcttgggtttttccttgttgcttattttaggaaggtgtccagtgtgaggtgcacgtggtggtattcgnggaggaggttgtcggtccagccgtggagaactcccgtgacgactctcctgtgcagcctgtgtacttcctacctttagtagtttatggatgaggtcgtcgggtcccgaccgagaccgtaccggaaggggaggggtccgttagggtaacgttccggtcggaacccaaacgtaaactaaaaaccgaagtaacgtaaggggaaaaacggttaaaaaacggtaaaacttagtacgggtacggaccttcgtaggtaggaaaccgggtccgtaacttcccgaaccgtactccgtaaccgaaggaaaccgtaacccgaaaccgaaccgtaaaaaggtaaccgttaccgtaacgttacggttaaccttcgttaacggaaacctaaaaggtccgaaactacggtaccgtaaggaacggtaccggaccggaacggaaccgacgggtacttaacgtaactaccgtagtcggtacgacggaagtacgtacgtaccgttaactccgttacgttcccgttcgtttgtcgttaccgg

SEQ ID NO: 45598 - DNA, 894 bp, Homo sapiens
  misc_feature: GYAE6OF01BVS9Z.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttccttgttgcttattttagaaggtgtccagtgtgaggtgcaacgtggtggattcgtgggaggaggtgtggtccagccgtggagaactcccgtgacgacttcctcctgtcgcacgtcctcgtggtactttcctaaccgttttagttagtttagttggtattggacgtcggtcggggtcccgaccgaacggtaccgtaccgggaagggggtaacggggtcgttaggggtaacggttccgggtacggaaccctaaaaacgtaaacgtaaaaacccgaaaggtaaggtaaggggtaaaaacgggttaaaaaacgtaaaaacgtttaggtaacgggttacgggtaacccgtttacggttacggggtaaacggtaaaccgggggtaccccttaacgtttaccccgaaacccgttacgttaccccttaaccggaaacggtaaaccggaaaaccccgtaaaaccggaacccgtaaaaaagggtaaaccgttacccgtaaacgttacgggttaaacttacccggtaagttaaaaccgtaaaacgttaaccgggaaaccgtaaccggtaccggtaagggaacggaaccgggtacccgggaaacgggtaacccgacggttacgttaacggttaaaccttaaccgttaaccggttggtaaccgggaagtaacggtaacgttaccgttaacccggttacgttaccgttaaccgttttccccgtttacgttttcgtacccggtttaaccgg

SEQ ID NO: 45599 - DNA, 536 bp, Homo sapiens
  misc_feature: GYAE6OF01BAFZE.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatcccctgagactctcctgtgcagcctctggattcacctttagtagttattggatgagctgggtccgccagacctccgagggaggggctgggagttcgtggccaacataaaccaagatggaaggtaaagaaactatggtggactctgtgaaggccgattcacatctccagacgacaacgccaagaatcactgtatctgacaatgaacacgactggagtacgccgaggacacggctagtactactacgtcggtgcgaaggacgtactccgttagtcctacgttccctcttttgcttccgg

SEQ ID NO: 45600 - DNA, 717 bp, Homo sapiens
  misc_feature: GYAE6OF01BX5XL.27.57.F02.1.454.CMB.1.raw
  modified_base (490)..(490): a, c, t, g, unknown or other
  misc_feature (490)..(490): n is a, c, g, or t
  modified_base (708)..(708): a, c, t, g, unknown or other
  misc_feature (708)..(708): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttccttgttgcttattttagaaggtgtccagtgtgaggtgacaacgtggtggattcgtgggaggaggtgtggtccagccgtggagtaactcccgtgacgactctccgtgtgcagcctcgtggtacttctaacctttagtagttagttggatgacgtcgtcgggtcccaccagtacctacgggaaggggaacggggtcgtgggacgtttcggtacggaaccaaacgtaactaaaacccgaaagtaaggttaagggaaaagggttaaaaacgaaaacgttgtagggtacgtacgttacgtagggtaggaacgggtaccgtaacttacccgaactnttacccgaccgaagaaccgtaaacccaaaccggaccgaaaaggtactaccacttaggtaactctaaggaactaaagtacgaaaccgcgtacccggaggaaccggacggtaacccgggaaggaacccgtacggcttaacgtaaacgtaccgttacggtggtacgacggtaaggccgtacgttccgtaagttccgttactttccccgttagtttaccggnttacccggg

SEQ ID NO: 45601 - DNA, 647 bp, Homo sapiens
  misc_feature: GYAE6OF01CEWUK.27.57.F02.1.454.CMB.1.raw
  modified_base (238)..(238): a, c, t, g, unknown or other
  misc_feature (238)..(238): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (503)..(503): a, c, t, g, unknown or other
  misc_feature (503)..(503): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgctattttagaaggtgtccagtgtgaggtgcaactggtggattctgggaggaggtgtggtccagcctggganaactcccgtgagctctcctgtgcagcctgtggattccaccgtttagtagtttagtggatggagcgtgggcccacaggactccggaaggggacgggntgggagttcgnggacaanaactaaaccagagtagggaaagtaaataaactgtggtgactgtaggtaggaagggtccagttaccacgtactacctaccgaaggtacgaaccgaaccgaccgaaaggaacggtcctaagttcgtaacgtcctagaactaaacgtcgaaacncggaccgttagggaacggtaacggacccggaaggtaccgtacgggtcttacggttacctaacggttccgtagggttcgaaccgggtaagtactaccgtttacctcgttacttaccctttccggttgttttagaaccgttccggg

SEQ ID NO: 45602 - DNA, 777 bp, Homo sapiens
  misc_feature: GYAE6OF01BMXLB.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacagaggacccaccatggaactgggctgagcttgggttttccttgttgcttattttagaggtgtccagtgtgaggtgcaacgtggtggattcgtgggaggtaggtgtggtccagtccgtagggaacgtaactcccgtgacgtaccttctccgtgtcgctacgtccttacgtggtacttcctaaccgttttagtagtttagttggatggacgtcggtcgggtcccgaccgaacgtaccgtaccggaagggggtaacgggtcgttagggtaacggtttccggtacgggaaccccaaaacgtaaacgttaaaaacccgaaggtaaggttaaacggggaaaaagggttaaaaaacgtaaaaaaccgtttaggttaacgggttacggtaacccgtttacggttacgggttaacggggaaaccggggtaccccgttaacgtttaacccgaacccgttacgtttaccccgtaccgaaggaaacgtaaccccgaaaaccggaaccgaaaaggtaaccgttacaaccgtttagtaacttacgtacgaacctaaagtacgaacgacggtaccaggaacgacggacccgagacccgagtcgtagtactacgtaacgtggacgtagagtgtacttccgtagtcctacgttccgttctttagcgttccgg

SEQ ID NO: 45603 - DNA, 668 bp, Homo sapiens
  misc_feature: GYAE6OF01AUSGF.27.57.F02.1.454.CMB.1.raw
  modified_base (302)..(302): a, c, t, g, unknown or other
  misc_feature (302)..(302): n is a, c, g, or t
  modified_base (644)..(644): a, c, t, g, unknown or other
  misc_feature (644)..(644): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctattttagaaggtgtccagtgtgaggtgcaactggtggattcgtggaggaggtgtggtccagcctggagaatccctgagactctcctgtgcagcctctggattctacctttagtagttatggatgagcgtggtccncagctccgagggagggctgggattcggtggaccaacgaataaaccaagtatagggtaaggtaaaagaaaacgtagtggtacggatcgtggtaggaaacggggcccgtagttcccaactactccttaccgaggtaacgaacccgaaacgacccgaaaggtaacctcgtaaccgtgttaaactcgttacgactaaaacgttcgaaacgtcggtaccgttaggaacggaccggaccgggtaacgggaacccgtaccggtcgttaggtaacttaaccgacccggttggtacggacggaaggtaacggtacgttacccgttaaacgggtctaaccggtttcccgttntttttaccggagttttaccccggg

SEQ ID NO: 45604 - DNA, 915 bp, Homo sapiens
  misc_feature: GYAE6OF01CSQ4A.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttcctgttgcttatttagaggtgtccagtgtgaggtgcaacgtggtggattcgtgggaggtaggttgtggtccagccgtagggagaactccccgtggacgtacctctaccgtggtgactacgtcccttcgtggtactttaccgtaacccgtttttaaggttagtttaagtttagggtagttacggaacggtccgggtttaccggggtccccgacccgtaacggtaacccgttacccggggaagggggggtaaacggggtccgttaggggttaacgggttttccgggtaccggaaccccgtaaaaacgtaaaaccgtaaaaaccccgtaaaggtaacggttaaaggggtaaaaacggggttaaaaaacggtaaaaaacctttaaggttagggtaacggtaaccgtttcggtaacgggttaacgggaaaaccggggtacccgttaaacttacccgtaaaccccgtaacttttaccccggaaaccccgtaaggaaacccggtaaaaccccgaaaccggtaaccccgtaaaaaaggggtaccctaaccgttaaacccggtttacggttaaacgttacccgtttaagaaaccgttaaaacgtacggtaaacccgaacggtaccccgttaaggaaaccggtccgggaacccgggtaaacggaccgaaccggttcgtaagttaactacccgttagtacggtcggagtacggaacgttacttaccgtaacgtcgttaacgttcccgtttactttcgtacttccggg

SEQ ID NO: 45605 - DNA, 906 bp, Homo sapiens
  misc_feature: GYAE6OF01AJJBW.27.57.F02.1.454.CMB.1.raw
  modified_base (769)..(769): a, c, t, g, unknown or other
  misc_feature (769)..(769): n is a, c, g, or t
  modified_base (889)..(889): a, c, t, g, unknown or other
  misc_feature (889)..(889): n is a, c, g, or t
tcagagcgtcgtctcacgaccggtgctcgatttagctcgatatagttgggtttgaggtctcagagaggagccttagccctggactccaaggtcctttccacttggtgatcagcacggagcacagaggacccacagtggacgtggggctggagcgttggttttccttgttgtcttatttagaagtgtccagtgtggaggtgacgtaacgtggtggtagttcgtagggagggtaggttggtcggtccgacgtccgtagggaacgtaacctcccgtaggacgtaccttccgttccgtggtcgacctaccggtcccttcgtacggtactttaccgttaaccgtttttaaggttagttttaggttaggtagttacggacggttccgggtttcgggtaccccggtaccgaaccggtacccggtaacccggggtaaggggggtaaccgggttcggtacggggtttccggttaccgggtaccggaacccgtaaaacgtaaaaccgtaaaacccggtaaggtaaagggttaaacggggtaaaaacgggtaaaaacggtaaaacgtttacggttacgggttaacggtacgtttaccgggttaagggtaccgggttaaaccggggtaccgttaacgttaccccgtaaccgtacttacccccggtaaacggaaggaaacccgtaaaacccccggaaacggtaaacccgttaaaagtaaacccgggttacttaacgtaccttaccgttaccgaaagaaacccgttaaataaccccgggtaanaccggttacggaacgggacggttaacccgggacggaccggtaacgtaccgttggtaactagttcccaaggtcggtagagttacggatttaccgcttaccgtaactttcgttacccgtttnttgggtaacgttcccgg

SEQ ID NO: 45606 - DNA, 704 bp, Homo sapiens
  misc_feature: GYAE6OF01CSIFD.27.57.F02.1.454.CMB.1.raw
  modified_base (258)..(258): a, c, t, g, unknown or other
  misc_feature (258)..(258): n is a, c, g, or t
  modified_base (315)..(315): a, c, t, g, unknown or other
  misc_feature (315)..(315): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttcctgttgctattttagaggtgtccagtgtgaggtgcaacgtggtggattcgtggaggaggtgtggtccagcctggagaactcccgtgacgcctctcctgngcacgcctcgtggtacttctaccgtttagtagttattggatggagtcgtcgggtccnccgagacctccggaaggggaacgggcgtggtacggttcggtacggacccaaacaacgtaaaaccgaagtaacgtaaggggaaacggtaaaaaacgaaaacgtagttagggtacggtaacgtcggtagggtacgggtaaaccgggtaccgtaacgttaccgaacccgtacttcccgtaccgaacggtaacggaaaccaaaccggaacctaaaacgggtaacgtacctaacgttacgttaactacgtagaactaaagtaacgaacgacgtccgaggacggtacgaccgggaacggaaccgtacggtctaagtacgtacctagtacggtcgagtaacggacgtacctaccgttaacgtcgttacttacccgttacgttttcgcggttaccgg

SEQ ID NO: 45607 - DNA, 651 bp, Homo sapiens
  misc_feature: GYAE6OF01EYDOE.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtgggaggaggtgtggtccaggcctggagaatccctgagctctcctgtgcagcctctggattcacctttagtagttattggatgagtctgggtccgcagactccgagggagggctggagttcgtggaccaacgaactaaaccgaaggtactagggaaggtaaaaacgtaaaacgtagtaggtaggaaccttcgtaggtacggaacgggtaccgtattacctaccacttcctaccgaagaacgtaacaaaccggacaaaggtaactccaacgttgtaatctagaacctaaagtcgaaactacggacgtaggaagtaccggaccggaagaacccgtacggtctaggtacttaactacggttgtacggtacgaaggtacgtaacgttcccgttaaacgttaccgttaccttttaccccggtttcgtttttagcgtttaccccgg

SEQ ID NO: 45608 - DNA, 669 bp, Homo sapiens
  misc_feature: GYAE6OF01CS9BF.27.57.F02.1.454.CMB.1.raw
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
tcagagcgtcgtctcacgaccggtgctcgatttagctcgatatagttgggttttgaggtctcagagaggagccttagccctggactccaaggccctttccacttggtgatcagcacggagcacagaggacccacatggaactgggctgagcgtggtttctgtgctatttagagtgtcagtgtgaggtgcagtggtgattcgnggaggnggttgnggtccagccgtagganaatcccgtgaatactcgtccgttgagcagcctcgtgacttcttaccttagtagttatggtangtacgcgtggtccnccgagaccncgaggggaggtcgtaggtcgttcgcggaccaacgaataaaccgaagtaaggtaggaaacggtaaaagtaaaacctagtacgggtacgacgtttcgaggttaacggaaacgggtcctaacttccgaacgtccgttacctaccgaagaaccggaaacccaaccgggttaaccaaagtaccggtaactccgtaagtacttacgtacaaccgtaaacgagttaacaacgaccgtaggaacggacggtacccggaggaacgtcccgtagtaccgttaaactcgtaaccgttggaccgacggagtaactaccgtttctaccgtctttaaccgttcggtttaaccctgttcccgttacggg

SEQ ID NO: 45609 - DNA, 748 bp, Homo sapiens
  misc_feature: GYAE6OF01EL4RE.27.57.F02.1.454.CMB.1.raw
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttattttagaaggtgtccagtgtgaggtgcaacgtggtggattcgtgggaggaggtgtggtccagcctggagaactccctgagacctctcctgtgcacgcctgtgtacttctacctttagtagttatggatgngcgtcgggtccnccgtagaccgtccggaaggggacggggtctacgggtacgttcggacggaccaaacaacgtaaaccgaagtaagtaagggaaaggtaaaaagtaaaacgtagtacggtacggtacttacgtaggtacggaacgggtcctacgtaccaaccctacgtcccacgtaacgaacgaacccgaaaccgaccaaaggtaacgttaccgtaacgttagttaactacgtcgaaaacgtaaacgttaggaaacccgtacggtaccgtaacgggaacgggaacccggtacccgggaacggtaaccctaacggggaccgtttaaagtaaccgttaccgtaacccgggttaggtaccgggaacgtaaggaccggttaacctttacccgggtaagtttaacccttacccggtttcccggttttaaccgtttttgcccgtttaaccgggg

SEQ ID NO: 45610 - DNA, 804 bp, Homo sapiens
  misc_feature: GYAE6OF01CI2K4.27.57.F02.1.454.CMB.1.raw
  modified_base (193)..(193): a, c, t, g, unknown or other
  misc_feature (193)..(193): n is a, c, g, or t
tcagagcgtcgtctcacgaccggtgctcgatttagctcgatatagttgggtttgaggtctcagagagagccttagccctggactccaaggcctttccacttggtgatcagcacggagcacgagacggacccacatggaactgggctgagtcttgggtttcctgttgctatttagaagtgtccagtgtgaggtncaacgtggtggattcgtaggaggaggtgtcggtccaggcccgtggagtaactcccgtagaacgtcctcgtccgttggcgacgtacggtcccttgtcggtaatttcccgtaacctttttaaggtagtttatttagggaactaggtacgtcggtaccgggttaccccgccgtaagtacccgtaccgggaaagggggacgggtcgttagggtacggtttacggcggaacccctaaaacgtaacgtaaaccggaaaggttaaccggtaaaggggtaaaagggtaaaaaactaaaccgtttaggtacggttacggtaaaccttacgggttaaggtaacggggtaaacgggacccttaacggtttaccaaacccggtacttacccgaaccgtaacgggaaccgtaaaacccgaaccggtaaccgaaaacggttacggtaccctaggttaactacgtacgttacgaaaccgtaaacgtacgaaacgtcgacccggtaaggaaccggacggaccgaacggtaaccgcgttaactaggttaaccctacgttacgcggtacggaacgtaagtaccgtatacgtaaccgtactttaccgttcgtacttttcgctttaccggg

SEQ ID NO: 45611 - DNA, 796 bp, Homo sapiens
  misc_feature: GYAE6OF01EXNLO.27.57.F02.1.454.CMB.1.raw
  modified_base (195)..(195): a, c, t, g, unknown or other
  misc_feature (195)..(195): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttattttagaggtgtcagtgtgaggtncacgtggtgattcgtgggaggaggtgtggtccagccgtaggagactcccgtgacgacctctccgtgtcgcacgtcctcgtggtacttccttaccttttagttagtttagttggattggacgtcggttacggggtcccgaccgaacgaccgtaccggaagggggacgggtcgttgggtacggtttccggtaccggaaccctaaaaccgaaacgttaaaacccgaaaggtaacggttaaaggggtaaaaggttaaaaaacgaaaacgtttagtacgggttacggtaaccgttacgttagggtaacgggaacggggtacccgttaactttacccaaacctaccgtttacctaacccgaaggtaaccgaaaccccgtaaacccggaaccgaaaagtaacggtccctaagtacggttactacgtaagaaacctaaacgtacgaaaccgtagtacccgtagggaacgtacccgggtaaccggaacggacccgtacgggtacctttaggtaacttaaccggtacgttaggaccgtacggacggtaaacgttaccgtaccgttaacgttactttaccgttcccgttttaacgtttcgacgtttcccggg

SEQ ID NO: 45612 - DNA, 646 bp, Homo sapiens
  misc_feature: GYAE6OF01AEZ7U.27.57.F02.1.454.CMB.1.raw
  modified_base (600)..(600): a, c, t, g, unknown or other
  misc_feature (600)..(600): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaagtgtccagtgtgaggtgcaacgtgggtggattcgtgggagggaggtggtcggtccagcctggagaactccctgagaccttctcctgtgcacgcctgtggacttactacctttagtagttatggatgagtcggtcgggtcccgcgacgacgtccggaagggggtacgggcgtagggtacgttcggtacggaccaaacgaactaaaccgaagtaagtacgggaaaggtaaaacgaaaacttagtacggtaggtactcgtaggtaggaacgggcgtacttaccactactcctacgaacgacgaaccgaaccgacgaaagtacgtacattagtctactacgaactaagtcgaacgcgtaccgtagacgggtacgaccggaagaccgacgtcgtacgtaacttacgtacgtggtacgaggaacgngtacctacgttacgtaccttacgtttcccgttgtttcgtcgtccgg

SEQ ID NO: 45613 - DNA, 645 bp, Homo sapiens
  misc_feature: GYAE6OF01AUNB0.27.57.F02.1.454.CMB.1.raw
  modified_base (631)..(631): a, c, t, g, unknown or other
  misc_feature (631)..(631): n is a, c, g, or t
  modified_base (639)..(639): a, c, t, g, unknown or other
  misc_feature (639)..(639): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcacgcctctggtattcctacctttagtagttagttggatgacgcgtcgggtccgccagacctccggaaggggaacggggtcgtgggtaggttcggtcggaccaaacaactaaaaccgaagtaacgtaggggaaaggtaaaaagtaaaactagtaggtacggtactacgtaggtacggaacgggtccgtacttaccacctacttccgtaccgaaggaacgaacccaaaccggaccgaaaggtaaaccgtacctaacgttagtactcgtacgaactaaatcgaactacggaccgtaggacgacggaccggaggaccgacggtctagtactacgtgtggtcgagagcgtactaccgtagtccttacgttcccgttntttcggtnttccgg

SEQ ID NO: 45614 - DNA, 695 bp, Homo sapiens
  misc_feature: GYAE6OF01CPB1W.27.57.F02.1.454.CMB.1.raw
  modified_base (315)..(315): a, c, t, g, unknown or other
  misc_feature (315)..(315): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaagtgtccagtgtgaggtgcaactggtggattctgggaggaggtgtggtccagcctggagaatccctgagactctcctgtgcacgcctcgtggtacttctaccttttagtagttattggatggagtcgtacggggtccnccgaaggacctccgaagggggaacgggcgttgggacggttcggtcggacccaaacaacgtaaaaaccaaggaagtaaggggaaggtaaaaagaaaactagttaggaggtaacctgtacggtacggaacgggtccgtagttccaacctatcctaaccgaagacgaaccaacgacctaaaaggacgtcaacttgttactcctacgtaacaaagtacgaaacgacgtccgtaagggaacggacggaccggaacggaaccgacgggtaccttaggtaactaaccgttaggtaggtacggaacggtaaggtaacggtacctttaacccggttacgtaccctttaacgtttccccggttttacgtttttaggaccgtttaaccggg

SEQ ID NO: 45615 - DNA, 646 bp, Homo sapiens
  misc_feature: GYAE6OF01DAX1V.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaggtgtccagtgtgaggtgcaacgtggtggattcgtgggaggaggtgtggtccagtcctggagaactccctagagtactcgtcctgtcgcacgccctcgtggtacttctaacctttaagttagttagttggatgagtcgtcggtccgccagacctccgaggggagggctagggtagttcggcggaccaacataaaccaagatagggaaagtaaagaaaactagtagaggtactgtaggaggaacggtccgtaattccaactactccgtaccaaggacgaacgaaccgaaccaaagacgtacacttagtactcgtagacaaagtcaacgtacgccgtaaggaacgcgaaccggacggaaccgtacggcgttaacgttaactaacgttaccgtagtcgggtaacgtaaggtaacgtaacgttaccgtaaccgttactaacccgttttccgtactttttggactttcccggg

SEQ ID NO: 45616 - DNA, 794 bp, Homo sapiens
  misc_feature: GYAE6OF01BQG4Q.27.57.F02.1.454.CMB.1.raw
  modified_base (323)..(323): a, c, t, g, unknown or other
  misc_feature (323)..(323): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcttgggttttccttgttgctattttagaaggtgtccagtgtgaggtgcaactggtggattctggaggaggtgtcggtccagcctaggagaactcccgtgacgactcctcctgtcgcacgcctcgtggtacttctacctttagtacgttagtgtatgacgtcgtcggggtccncgacgtaccgtacggaaggggaggcgtaggtacggttcgtacggaccaaacaaacgtaaaccgaaggtagtaagggaaaacgtaaaaagtaaaccgttagtaggtacggtaactacggtagggtaacgggtaaaccgggccgtttaacttacccgaacccgttaagttcccccgtaacgtaacggaaacgtaaacccgaaacccggtaacctaaaaacggtaccgttacccgtaacgttactaacgtttaccgtagtaaaccgtaaaagtacgaaaccgtcgaacccggaggtaaaccgggaccggtaccgggaacggaaccgtaaccggtccgttaaggttaaacctacccgggttaaacgttcgggtaaacggacgggtaaacggttacgttaacccgttccccttaacgggtttaccctaacccgtttttccccgggttttctttaaggtaccccgtttacccggggg

SEQ ID NO: 45617 - DNA, 645 bp, Homo sapiens
  misc_feature: GYAE6OF01EP1OL.27.57.F02.1.454.CMB.1.raw
  modified_base (216)..(216): a, c, t, g, unknown or other
  misc_feature (216)..(216): n is a, c, g, or t
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggnggtgtggtccagcctggagaatccctgagactctcctgtgcagcctcgtggattcacctttagtagttattggatgagctggggtccnccgagcgtccgaggggaaggggctggagttcggnggaccaacaactaaaccaagagtagggaaaggtaaaagaaaactataggtaggaactcgtaggtaggaaacgggccctaatttcgacctactacctccaaggaacgaacgaaaccggaccaaagaacgtacaacgttagtactctgactaaatcgaaacacgaccgtagagggaacgccggaacgggaccgaccgggtcttaggttaacttaccgtaaccgttaggtacggtacggtaaggaacgtaacgtcccgttaaacgtcgttaaccttttcccggtacgttttttcggaacgtttacccggg

SEQ ID NO: 45618 - DNA, 856 bp, Homo sapiens
  misc_feature: GYAE6OF01AQQ65.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggagggtgtcggtccagcccgtggagtaactccctgacgactcgtcctggtgcacgcccttcgtggtacttcctaccttttaagtacgttttaattgggtattggaggtcgttaccggggtcccgtaccaacgtaccgttcccggaagggggtaaggggccgttaggggtaacggtttcggtcgggaccctaaacgtaacgtaaaacccgaaagagttacgggaaagggtaaaaacgaaaacttaggtcggtaggtacttacgtagggtacggtaaggggccgtactttccgaaccgttacacccgtaccgaacggtacgaaccgaaaacccggtacccgaaaaggtaccggttaaccctaacgttacgttacttaccgtacgaaaccgtaaaggttaccgaaaaacccgtttcgacccggttaacgggaacgggaacccggtacccggggaaaacgggtcccgaaacccgggggtttactttaccgggttaaaacgttacccgtttaaacgggttccgggggttaacgacccggggtaaaccgggtaacctttaacccggggttctttaaacccgggggttacctttaaaccccggtttttccggtttaacccttttttaacgggccccgttttaccgggg

SEQ ID NO: 45619 - DNA, 1010 bp, Homo sapiens
  misc_feature: GYAE6OF01ECVJY.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctggagcgttgggttttccttgttgctattttagaggtgtcagtgtgaggtgctaacgtggtggtattcgtagggaggtaggtgtcgggtacccaggtccgtaggacgaacttccccgtaggaacgtaccttccttaccgtggtcgaccgacggtccccttcggttacggtaacttttacccgttaaacccggttttttaaggttaacggtttttaagttaggggaacgtttagggtaacggttcccggtttccggggggttacccccgaccggtaaaccgggtacccgtttaacccggggaaaggggggggtaaaccgggggtcttaacggggggttaacggtttttccgggaaccggggtaaaccccctaaaaaccggtaaaaccttaaaaaacccggtaaagggtaacggtttaaagggggaaaaaaccggggttaaaaaaggtaaaaaaccgtttagggtttaaggggtaaccggtaaccgtttaccgggttaagggttaacgggggtaaaaccgggggtaccctttaaaccggtttacccctaaaccggttaacctttaaccccggtaacccgggaaacggtaaccgggaaaacccggtaaacccggtaaccgtaaaacggtaaacccggtttaactaacccggtttagttaaaccgttacgttaaccgtaaacgtaaaacgttaccggaaacctacgggtccttaaacgggacgggaaaccggtacccgggagggaacccgtaacgtcgttaacggttaacttaccggttacgtacggtaccggtaggtaacggtaactacgttacccgtagtttacccttaacggtttcccggtttaacgttttgaacggtttaccgg

SEQ ID NO: 45620 - DNA, 809 bp, Homo sapiens
  misc_feature: GYAE6OF01E10G3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaacgtggtggtattcgtgggaggaggtgtggtccagcctggagaactccctgagactctcctgtgccacgtcctcgtggtacttcctacctttagtagtttattggatgagtcgtcggggtcccgaccgacgaccgtccggaagggggaacggggtccgtgggtacgtttcggtacggaccctaaacgaaataaaacccgaaaggtaagtaagggtaaaaggtaaaaaacgaaaaagtttacgtagggttaacggaccgtttacgtagggttaaggaaacggggtaccgtaactttacccgaaccctacgttaccctacccgaaggaacgtaaacccgtaaacccggacctaaaacggtaacgttacccgtaattacggttaacttaccgtaacggtaaacctaaaacggttacgaaaaccgtcggaacccgtaagggaacggaaccggaacccgggtaacggaaccggtaacccggtacggtttaacgtaaaccgtttaaccgttaccggttaggtccggtaacgggaaggtaaaccggttacccgttaaccggttacgttaccctttaccgttttacccgggttttctttttaggaacccgttttcccggg

SEQ ID NO: 45621 - DNA, 762 bp, Homo sapiens
  misc_feature: GYAE6OF01CQOZ2.27.57.F02.1.454.CMB.1.raw
tcagagcgtcgtctcacgaccggtgctcgatttagctcgatatagttgggtttgaggtctcagagaggagccttagccctggacctccaaggtccctttccacttggtgatcagcacggagcacagaggacccacatggaacgtgggctgagtcgttgggttttccctgtgcttattttagaggtgtccagtgtgagtgcaacgtggtgattcgtggaggacggtgtggtccagccgtaggaagaactcccgtagacgtcctcgtcctgcgcgacgtcctcgtggtacttctaaccgtttagtagtttatggtatgcggtgtcggccacgtacgacgtaccggaggggaggtcgtagggtacgttccgtacggaccaaactaaacgtaaaccgagtaacggtaggaaagtaaaacgtaaagtgtaggtacgaaccgttgtacggtaaggaccgggtaccattacccgacctagtaccgtaccaggtaaccgacgaaaccgtacgaaacgtaagtaccctaagttactaacgtaccgaacgtaacctaaagtaccgaaacgtacgaccccgttaaggaaccgtacccggaaaccgggaggttaaaccccgaggttaaccgttacgtaaacgttaaccccggtttagtacggtaaccgggaaacccgttaagggtaacccttaaaccggttccctttaaaggggttacccccttaacggttttcccccggtttaacttttacggacccggttttaaccccgggg

SEQ ID NO: 45622 - DNA, 787 bp, Homo sapiens
  misc_feature: GYAE6OF01DJ7I3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggtttcctgtgctatttagaggtgtccagtgtgaggtgcaactggtaggtattcgtgggaggaggtggtcggtccagccgtggagtaactcccgtgacgtacctctcctgtgcacgtcctcgtggtattcctacctttagtagttagttggatggacgcgttcgggtcccaccgacgacctccggaagggggacgggtcgtagggtacgttccggtacggtaccaaaacgtaagtaaaaccgaagtaggtaacgggtaaagtaaaaacgtaaaacgtagtggtacgtacttcgtaggtacggaacgggtcccgtaactcccgaaccctagttacccgtaaccggaagtaacgaacccgaaaccggaacccgaaaaggtaaccgttacccgaaacgtttacgtaacgttcgtaagaacctaaaagtcgaaaccgtcgaaccgttaggaacggaccgggaacccggaaggtaaccccggtacgggttaccgttaacgttaacgttaaacccgttacggttacgggtacggtaaccgggacggtaacgttaacccggttaacccgtaacccgggtttaccttttaacccgggtttacccccggttttcgtttttaaacgggtcccgtttaaccccgggg

SEQ ID NO: 45623 - DNA, 604 bp, Homo sapiens
  misc_feature: GYAE6OF01EPBEB.27.57.F02.1.454.CMB.1.raw
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (374)..(374): a, c, t, g, unknown or other
  misc_feature (374)..(374): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattcgtggaggaggtgtggtccagccgtggagaatccctgagactctcctgtgcagcctctggattcactttagtagttatggatgagcgtcgggtccgcagacgtccggaggggacgggctgggagttcggnggaccaaanactaaaccaagagtaggaaggtaaaanaaacgtagtagtacggactcgtgtaggaacgggtcctagttaccaacgtactcctaccgaagacgtaacaacgaccaaagtaacgtctaacgtgtatactagaacaaatgaacacgtaccgtagacggtacgaccggaagaccgacggctacgtacttaactacgtaggtacggacaggtaacgtactaccgtacgtaccttacgttcccgttattttcgattacccggg

SEQ ID NO: 45624 - DNA, 813 bp, Homo sapiens
  misc_feature: GYAE6OF01B00AS.27.57.F02.1.454.CMB.1.raw
  modified_base (327)..(327): a, c, t, g, unknown or other
  misc_feature (327)..(327): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgttgctattttagaaggtgtccagtgtgaggtgcaacgtggtggattcgtggaggaggtgtggtccagccgtggaagaactcccgtgagtacctcctcctggtcgcacgtcctcgtggtattcctaaccttttagtagttagttggatggacgtcgtcgggtcccncgacgtaccgtccggaagggggaacggggtctagggtacggttccgggtacggaaccctaaaacgtaaacgtaaaaacccgaaggtaacgttaaggggaaaacgggttaaaaaacgtaaaaacgtttagtagggttacggtaaccttcggttagggttaacggggaaaccggggtaccttaacgttacccgaaaccttacgttaccctaaccgaaaggtaaccgaaacccgaaaccgtaacccgaaaagtaaccgttaccgtaacgttaacggttactaccgtagtaaaccaaagttacgaaaccgcggtaccgtaaggaacggtaacggacccgggaaacggtacccgaccgggttacgttacggttaaaccgttaccgttaacggtcggttaacgggacggaaggttaaaccgtaccgtttacccgttaaacggttacccttaccggttttcccgttaccgtttttaggcccttttacccgggg

SEQ ID NO: 45625 - DNA, 903 bp, Homo sapiens
  misc_feature: GYAE6OF01D8M9F.27.57.F02.1.454.CMB.1.raw
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
tcagagcgtcgtctcacgaccggtgctcgatttagctcgatatagttgggtttgaggtctcagagaggagccttagccctggactccaaggtccctttccacttggtgatcagcacggagcacagacggacccaccatggaacgtgggctgagtcgttgggttttccttgttgcttagttttagaaggtgtcagtgtgaggtgcaacgtggtgattcgnggaggnggtgtcggtccagtccgtaggagtaactcccgtgacgaccttcctcctgtcgcacgtccttcgtacgtacttccgtaacctttttagtaagtttagttggaattggacgtcggttcgggtcccgaccgtaacggaccgtcccggaagggggaacgggggtcttagggtacggtttcggtacggaacctaaaccgtaaacgttaaaaacccgaaaggaacggttaaaggggtaaaaacggggttaaaaaaaagtaaaaaccgtttagttaacgggtacggttaaaccgtttcgttaggggttaggggaaaaccggggtacccgtttaacgtttacccgaaaccccttaacgttccccgttaaccccggtaaacggaaccgtaaaacccgaaaacccggaacccgtaaaaagggtaaacccgttaccctaaaccggttttagttaaccgtttaccgtaaacgggtaaacctaaaagttaaccggaaactacccggtaaccgttaaggaaccgggaaacgggaccccgggaaacggaacccggtaccggttacgtttaacggtaacctttaaaccggttacgttacggtacgggtacccgaaagggtcgttaaacccgttccctttaaaggtcccctttaagtttccccggttttcctttttaaggacgttttcccccggg

SEQ ID NO: 45626 - DNA, 690 bp, Homo sapiens
  misc_feature: GYAE6OF01C51YH.27.57.F02.1.454.CMB.1.raw
  modified_base (480)..(480): a, c, t, g, unknown or other
  misc_feature (480)..(480): n is a, c, g, or t
tcagagcgtcgtctcacgaccggtgctcgatttagctcgatatagttgggtttgacggtctcagagaggagccttagccctggactccaaggcctttccacttggtgatcagcacggagcacagacggacccaccagtgggaacgtcggggctgacgcgttgggttttccttgttgacttattttaagagtgtacagtgtgaggtgacaacgtggtagtattcgtgggaggaggtgtcggtccagtcgtcggaagtaactcccgtagacgtaccttcgtccgtgtcgtcgtacgtcctcgtaggtattccttacgtttagtagttatggatgtacgcgtgggtccgacctaggtaccgtaccggagggacgggtctagggagttaccggacgaacctaacaactaaacgaagtagtaaggaagtaaacgaaactggtcgtacggactcgtggtaaggaaccggtactaacctaccaactntacccgtacgaagaacgaaccaaaccggactaaggtaacctacgtacgtacgtatcgaaagactaaacgcgaacgacgtaccgtaggactaacgggccctaagggcctagggtacctaggtaaccttacgtacgttcggaacggtacggtagtaacctacgttccggaacgttccgtacggtttacccgtttggttacctgggtacccgg

SEQ ID NO: 45627 - DNA, 828 bp, Homo sapiens
  misc_feature: GYAE6OF01C647W.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaacgtggggctgagcttgggttttccttgttgcttattttagaaggtgtccagtgtgaggtgctaacgtggtggattcgtgggaggtaggtgtggtccagcctggagaactccctagacgtacctcttcctgtagccacggtcccttcgtggtacttcctaaccgttttaagttagtttattggatggtacgtcggtcgggtcccgccagacccgttaccggagggggaacggggtccgtaggggtcggttccgggtacggacccctaaaacgtaacgttaaaaacccgaaggtaacggtaagggggtaaaacgggttaaaaaaacgtaaaacgttaaggttacgggtacggtaaccgttcggtagggttaacgggaacgggtacccgtattacccgaacctagtccctaaccgagtaaccgaaaccgaaccgaaccgaaaaggtaacgtacctaacgttacgttaacgtccgttaaggaacctaaaacgtcgtaaaccgtccggttaaccgtaacgggtacgggtaaccggaaccgggaaaccgggtacccgacgggttaccgtacggttaacctaacccggttaaggtcgggtaaccgggacggtaaccggtaacgttaccggttaacccgttaggttaccccgtttaacgtttcccggtttaacgttttcggtaccggtttacccgggg

SEQ ID NO: 45628 - DNA, 704 bp, Homo sapiens
  misc_feature: GYAE6OF01DKK7W.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggaaccacatggaactgggctgagctgggttttccttgttgctattttagaagtgtccagtgtgaggtgcaactggtggattctggaggaggtgtcggtccagcctggagaactcctgagtactctctgtgctacgcctcgtggtacttctacctttagtagttattggataggagtcgtcgggtcccgacgaggaccgtcggaggggaacgggcgtaggtacgttcggtcgaacctaaactaagtaaaaccgaagtagtaagggaaagtaaaaacgaaaacgtagttaggtacggtacctacgtttagggaaggtaaacgggtaccggtaactttaccgaacccgtaattcccgtaaaccgaagaaacggtaacccgaaaccgaacgtaaaacgacgtttaacaaccgttagttaactcgttaagaacctaaaagtcggaaacacgtacccggtaaggaaccgggtacggacccggaaaggaacccggtgtaaccgttaggttaaccttacgttagcggttaggacggtagaactcgttacgttcgttactaccgtttccgttacgtttgtcgttccgg

SEQ ID NO: 45629 - DNA, 625 bp, Homo sapiens
  misc_feature: GYAE6OF01C0XDY.27.57.F02.1.454.CMB.1.raw
  modified_base (491)..(491): a, c, t, g, unknown or other
  misc_feature (491)..(491): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctatttagaggtgtccagtgtgaggtgcaactggtggattctgggaggagggtgtgggtccagcctgggagaatccctgacgactctcctgtcgcacgcctcgtggtacttcctaccttttaagttagtttattggatggagtcgtcgggtccgccagacctccggaaggggaacggggctgggtagttcgtggaccaacataaaccagagtagggaaagtaaaagaaaactagtggtacggtactcgttagacggaaggggtcccattccaaccgtatccgtccaaggacgaaccaacgtaccaaagtacgtacagtacgttanccgtagaactaaagtacgaacgtacgaccgtaggagacggaccggaaggaccgtacggtgtacgttaatacgtactagggtcgacgtaaggtacgaacttccgattccgtactttcgttactttgtactccggg

SEQ ID NO: 45630 - DNA, 571 bp, Homo sapiens
  misc_feature: GYAE6OF01BZTQ4.27.57.F02.1.454.CMB.1.raw
  modified_base (308)..(308): a, c, t, g, unknown or other
  misc_feature (308)..(308): n is a, c, g, or t
  modified_base (483)..(483): a, c, t, g, unknown or other
  misc_feature (483)..(483): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccccaccatggaactggggctgagctgggttttccttgttgctattttagaaggtgtccagtgtgaggtgcaacgtggtggattctgggaggaggtgtgggtccagcctggagaatccctgagactctcctgtgcagcctctggattctacctttagtagttattggatgagctgggtccnccagactccgaggggaagggctgggagttcgtggaccaacaataaaccgaagtagtagggaaaggttaaagaaaactagtggtaggactgtggtaggaacgggcctaattccacctatcctaccaagacgacaacgaccaaagaacgtcaacgttgtactctagacaaatgaacngacctagagacgacgagacgacggctagtactactacgtggtcgacggagagtacgtaccttagtctagttcccgtattttgattccg

SEQ ID NO: 45631 - DNA, 733 bp, Homo sapiens
  misc_feature: GYAE6OF01CP53N.27.57.F02.1.454.CMB.1.raw
  modified_base (672)..(672): a, c, t, g, unknown or other
  misc_feature (672)..(672): n is a, c, g, or t
tcagagcgtcgtctcacgaccggtgctcgatttagctcgatatagttgggtttgaggtctcagagaggagccttagccctggacctccaaggtcctttccacttggtgatcagcacggagcacagacggacccacatggaactgggctgagtcgttgggttttccttgttgtcttagttttagaaggtcgtccagtgtgaggtgacaacgtggtagtacttgtagggaggtaggtgtcggtaccaggccgtaggaacgtaacctccgtaggacgtactcctcgtgtcgccacgtccctgtcggtaacttaccgttaccgtttagtagtttagttaggagtgacgtcggtcggtcccacgacgtacgtaccgggaaggggtacggtcgtagggtacgttccggacgaacccaaataaacgtaaaccgaaggtaggtaaacgggaaacggtaaaaaataaacgtaggttacggtacgtaaccgttgtacgggtaacggaaacgggtcctaacttacccgaaccgtatacccgaaccgaaggaacccgaaaccgtaaccgaaccgtaaaaggtactttaacccgaagtttcggtaacctacgtaacgaactaaagtaccgaaacgcgtacgagaacggaccggacgacgaacgtcgtacgtagtacacgttacgnggtacaggtacaagttaccgtctaagttcccgttacttccgttgttaagtcccgttacggg

SEQ ID NO: 45632 - DNA, 727 bp, Homo sapiens
  misc_feature: GYAE6OF01CJWEH.27.57.F02.1.454.CMB.1.raw
  modified_base (178)..(178): a, c, t, g, unknown or other
  misc_feature (178)..(178): n is a, c, g, or t
  modified_base (190)..(190): a, c, t, g, unknown or other
  misc_feature (190)..(190): n is a, c, g, or t
  modified_base (208)..(208): a, c, t, g, unknown or other
  misc_feature (208)..(208): n is a, c, g, or t
  modified_base (577)..(577): a, c, t, g, unknown or other
  misc_feature (577)..(577): n is a, c, g, or t
  modified_base (633)..(633): a, c, t, g, unknown or other
  misc_feature (633)..(633): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcggtgttcgtgtagcgtattagaggtntcagtgtgcgtncaacgtggtgacttcggnggaggtaggtgtcggtaccaggtcctaggactaccgtcccgtaggtacgtccttccgtcgtaggtcgaccgtacgtcccttcggtaacgtaccttaccgttaacgttttaggtagttttaggttacggtatccgggtccggtacgggttccgggacccctaccgtaaacggtaccggtacgggaaagggggtaccggtcggttcggtaaggttccggaactaaccgtaacgaacgtaaacggagtaacggtaagggtaaacgtaaacgagttcgtgtacgtacgtgtacggaggtacgtaactctaaccgtacctacgtcgtacacggaactacgaacgaacgtaagtacgtacacttgtacacgtaanaactaacgtacgaccgtgaaccgtaggacggtaccgggacgtaacgggaccgtacncggttaggtttaaccacggtaacggtcggttaccggagtaagtccttcttacgttacgttacccgtacgttacgtttccgttagtcccggtagg

SEQ ID NO: 45633 - DNA, 716 bp, Homo sapiens
  misc_feature: GYAE6OF01C64N7.27.57.F02.1.454.CMB.1.raw
  modified_base (321)..(321): a, c, t, g, unknown or other
  misc_feature (321)..(321): n is a, c, g, or t
  modified_base (614)..(614): a, c, t, g, unknown or other
  misc_feature (614)..(614): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagtcttgggtttttccttgttgtcttattttagaaggtgtccagtgtgaggtgcaacgtggtggattcgtgggaggaggtgtggtccagccgtaggagaactcccgtgacgactctctgtgcacgcctgtgtattctactttagtagttagttcgagtgagtcgtcggtccncaaggcctacggaaggggaacggtctagggtagtttcggacggaccaaactaaactaaaccgaagtaaggtaagggaaaaggtaaaaacaaaacgtttagtagggtaggtaaccttgtaagggtaaggaaacgggtacctaagttacccaacccagttaccctaaccgaacggaaacgaacccgtaaaaccccgagaaaaaccggtaaggtaccctaacgtagtaacgtcctaacggaactaaaagtacgaaacctacgacccgtagggaaacgccggaacgacgggtaaccncggtaactttaacgacttaacccgtatcggtaaggaggtaacgtacggtaactttcccgaagttcctttaacggtaccccttttgttagccgtttaaccggg

SEQ ID NO: 45634 - DNA, 797 bp, Homo sapiens
  misc_feature: GYAE6OF01DEHSW.27.57.F02.1.454.CMB.1.raw
  modified_base (340)..(340): a, c, t, g, unknown or other
  misc_feature (340)..(340): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttggtttcctgtgctatttagagtgtcagtgtgaggtgcaacgtggtggattcgtgggaggaggtgtcggtccagccgtaggacgaactcccgtagaacgtcctccgttcctggtcgacctacgtccttcgtaggtacttacctaaccgtttttagttagttagttaggatggtacgcggttcgggtcccncgaacggtacctaccggaaggggaacggggtctagggtaacggttccggtacggaccaaaacgtaacgttaaaaccgaaggtaacggtaagggtaaaacggtaaaaagtaaaacgttaagtcgggtaaggtacctttacgtagggttaagggaaccgggtaccgtaacgtttaacccgaacccgtaacgttaccgtaacccgaaaggtaaccgaaacccgtaaaaccgaaccgaaaacggtaacgtaaccgtaacgttaacgtaacttaccggaacgtaaacgtaaacgttaacggaaacgtcggtaaccgtaacggaacgggtacgggaaccggaaccgggtaacccggtaccggtacgttacgtaaacttaccgtaacgttggtacgtaacggaagtacgtacttaccggttacgttaccttacgtttacggttcgttttacgcgtttacccggg

SEQ ID NO: 45635 - DNA, 672 bp, Homo sapiens
  misc_feature: GYAE6OF01AH8UE.27.57.F02.1.454.CMB.1.raw
  modified_base (517)..(517): a, c, t, g, unknown or other
  misc_feature (517)..(517): n is a, c, g, or t
  modified_base (528)..(528): a, c, t, g, unknown or other
  misc_feature (528)..(528): n is a, c, g, or t
  modified_base (544)..(544): a, c, t, g, unknown or other
  misc_feature (544)..(544): n is a, c, g, or t
  modified_base (652)..(652): a, c, t, g, unknown or other
  misc_feature (652)..(652): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtcagtgtgaggtgcaacgtggtggattcgtgggaggtagggtgtcggtccagccgtggagaatccccgtgagacctctcctgtgcacgcctcgtggtattcctacctttagtagtttattggatgagtcgtcgggtcccgccagaccgtccggaagggggaacggggtcgtagggtagttcggtaggacccaaacgtaataaaccgaagtagtaggggtaaaggtaaaagtaaaacgttagtggtacggtaactcgtggaacggtacgggaccgtattaccgacctactcctaccaaggtacaaacccgaccgaaccgaaaagtacgtacaacgtnttactaccgtnaactaagtaccgaacncggtcgagaacgaccggacggaacggacgaccggacttagtaacgtaccgttagtagggccgaggtaagactacgttacccttaggtccctttagtttaccccggttnttttacgccgtttaccgggg

SEQ ID NO: 45636 - DNA, 803 bp, Homo sapiens
  misc_feature: GYAE6OF01C7ZYB.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccacatggaactgggctgagcttgggttttccttgttgcttattttagaaggtgtcagtgtgaggtgcagtggtgattcgtggaggaggtgtggtccagccgtggagtactccgtgacgtacctctcctgtcgcacgtcttcgtaggtacttactacgttttagtagttagttggattggacgtcgtcgggtccgacacgtaccgtcggaagggggacggtcgtgggtagttccggtacggaaccaaagtaaactaaacgaacgtaaggttaacgggaaaaaggtaaaaacggtaaaacctaggttacggtacggtaactttacggtaggtaacgggaaccgggtactaacgttaacccaccgtaacgtacccgttaacccgaaggtaaccgaaaccggtaaacccgaaccgtaaaaggtaaacggttaccctaaacggtttggttaaaccgttccgtaacggtaaacgtaaggtaaccgaaacgacgtaaccggtaggaaaccgggaacggaccgggacgggtaaccgtaccgggacgtttaacggtaaccgtaaacccgttcgggtttaacggacgggtaaccggaaaggttaccggtacccgtttacccgttaaacgttaccttacccggttttaacccggttttacgttttaggacccggttttcccggg

SEQ ID NO: 45637 - DNA, 711 bp, Homo sapiens
  misc_feature: GYAE6OF01DW2IQ.27.57.F02.1.454.CMB.1.raw
  modified_base (307)..(307): a, c, t, g, unknown or other
  misc_feature (307)..(307): n is a, c, g, or t
tcagagcgtcgtctcacgaccggtgctcgatttagctcgatatagttgggtttgaggtctcagagaggagccttagccctggactccaaggcctttccacttggtgatcagcacggagccacagaggacccaccatggaactggggctgagcttgggttttccttgttgctattttagaggtgtccagtgtgaggtgcaactggtggattctggaggaggtgtggtccagcctggagatccctgagactctcctgtgcagcctctggacttctacctttagtagttattggatgagtctcgggtccncagactccgaggggaagggctggtagttcgtggaccaacataaaccaagagtgggaaaggtaaaagaaaactagtaggtaggtaactcgtaggtaggaaacgggtccgtaatttaccgaacccgtaacttcccttaacccgaaggaaaccggtaaacccaaacccggaacccaaaaggtaaaccgttcctaaccgttaggttaacttccgttaggaaacctaaaagttcggaaaaccgacgtacccgtaagggaaccgggtacggacccgggaaacgggtaaccgacgggtaccttacgggtaacttaaccgttacgttcggtacggaccggtaagggtaacgtaccgttacccttaacggtacttaacccggtttccccgtttaagtttttcgctttacccgg

SEQ ID NO: 45638 - DNA, 655 bp, Homo sapiens
  misc_feature: GYAE6OF01BBUD4.27.57.F02.1.454.CMB.1.raw
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattctacctttagtagtttatggatgagtcgtgggtcccnccgagacctccgaaggggtaggggctgggtacgttcggnggaccaanaactaaaaccgaagagtacgggaaaggtaaaagtaaactagtggtaggaacttcgtaggtaggaacggggcctaagttccaaccacttctaccgagaacgaaccgaaccgaccaaaggaacgtacaacgttagtactacgtagaactaaagtacgaacgacgtacctagaacggtacgaccggaacgaccggtaccggtacgttagttaacgtacccgttaacgttcggtacgaggaggactaacgttacccgttaacgttaccgttaacgttttcccggtcgtttttcgaagtttcccgg

SEQ ID NO: 45639 - DNA, 687 bp, Homo sapiens
  misc_feature: GYAE6OF01DS3K0.27.57.F02.1.454.CMB.1.raw
  modified_base (265)..(265): a, c, t, g, unknown or other
  misc_feature (265)..(265): n is a, c, g, or t
  modified_base (323)..(323): a, c, t, g, unknown or other
  misc_feature (323)..(323): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaactgggtggattcgtgggaggaggtgtgggtccagcctggagaactcccgtgagactctcctgtcncagccctctggattccaccttttagtagtttattggattggacgtcgtcggggtcccnccagactccggaggggaaggggctgggagttcgtggccaacaataaaccaagagtaggaaaggtaaaagaaaactagtgtaggtaactcgtagtacggaaggggtcccgtaatttccgaaccctagtacccttccgaaggtaacgaaacccgaaccgaaccctaaaaggaacgtctaacgttgtataccgttgaactaaagttacgaacagcccctaggaacgtacggacccggaaagggacctacgggaccttaggtaaacttaaccgttacgtcggtcgaacgggacggaaaggttacccgtccgttaaacggttcccttaaacgttttccccggttcgttttttaggacgttttcccgggg

SEQ ID NO: 45640 - DNA, 718 bp, Homo sapiens
  misc_feature: GYAE6OF01CHGT3.27.57.F02.1.454.CMB.1.raw
  modified_base (177)..(177): a, c, t, g, unknown or other
  misc_feature (177)..(177): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgtgctatttagaggtntcagtgtgaggtgcaacgtggtggtattcgtggagggtaggtgtggtccagccgtaggagaactccctgagactcctcctgtgcacgtcctcgtagtacttctactttagtagttatggatgacgtcggtcgggtccgccacgaccgtccggaaggggacgggtcgtagggtacgttcggcggaaccaaacgtaactaaaaccgaggaacgtaggggtaaaaggtaaaaagaaaacttaggtacggtaggtacttgtaggtaggtaacgggacccgtaattacccgaaccgtattacccgtacccgaaaggtaaccgaaacccgaaacccgtaaccgtaaaaggtaccgttacccaacgtttcggtaaaccttccggtaacgaaacgtaaagtaccgaaacgacgtacccgtagggacgtaaccggcggaacggaccggtaccgtacgttaacgtaacgtacctaggtcggtaacggaggtaagacgtcttaacccttcggtacccttacgtttcccgtttagtttcgaccgtttaccggg

SEQ ID NO: 45641 - DNA, 804 bp, Homo sapiens
  misc_feature: GYAE6OF01D2WC4.27.57.F02.1.454.CMB.1.raw
  modified_base (188)..(188): a, c, t, g, unknown or other
  misc_feature (188)..(188): n is a, c, g, or t
  modified_base (395)..(395): a, c, t, g, unknown or other
  misc_feature (395)..(395): n is a, c, g, or t
  modified_base (641)..(641): a, c, t, g, unknown or other
  misc_feature (641)..(641): n is a, c, g, or t
  modified_base (767)..(767): a, c, t, g, unknown or other
  misc_feature (767)..(767): n is a, c, g, or t
  modified_base (787)..(787): a, c, t, g, unknown or other
  misc_feature (787)..(787): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcgtggtttctgtgctatttagaggtgtcagtgtgaggtncaacgtggtggattcggtaggaggtaggtgtcggtcccgagtccggtagggacgtaacgtcccgtagtacgtaccttccgtccgtgtacgcctccggtccttcgtcggtacttacgttaccgtttaggtaggttttagtggtagtcggtagtccggtacgggtacccgtacgtacggtaccgtacgggaaggggtacggggttacgngggttacgggttccgtaccggaacctaaaacgtaaactaaaacgtaaggtacgtaaaggggtaaagtaaaacgtaaacgtaggttacggtacggttaccttaggtaggtaacggtaacccgggttacctacgtttaaccaaccctactttacccgaaccgtaagggtaaccaaacccggtaaaacgtaccggtaaagtaaccggttcctaacgtttcggtaacttacggtacgtaacctaaacggngaaccggtcgtaaccgaggacggtaccggaacgggtacggtacggaacccgttgttaaccggaagttaccgtaggttacggcgaccgggtagttacccaccggtttagtacggttaccccgttttntaacccgggtttttcgtttnaccggggtttaacccgg

SEQ ID NO: 45642 - DNA, 630 bp, Homo sapiens
  misc_feature: GYAE6OF01DAIMN.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtgggtccagcctggagaatccctgagactctcctgtgcagcctctggattctaccttagtagttattaggatgagcgtgggtccgccagactccgaggggaagggcgtggtagttcgtggaccaaacaataaaaccaagatagggaaaggtaaaaagaaaacgtaatacggtaggactcgtagtggaaacggggtccgtaattccgaaccagtccctaccaaggacgaaaccaacgaacccgaaaagacgtactacgtgtatcgtgacaaatcgaacaacggcctaggacgaacggccggaaacgggtaccgacgggacgttcgtaaactaccgtacgtaggtcggacggtaaggaaacgtacttaccgttaacgtactagtttcccgttacgttttgtaagttcccgg

SEQ ID NO: 45643 - DNA, 735 bp, Homo sapiens
  misc_feature: GYAE6OF01CC2G6.27.57.F02.1.454.CMB.1.raw
  modified_base (727)..(727): a, c, t, g, unknown or other
  misc_feature (727)..(727): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttccttgttgctattttagaaggtgtccagtgtgaggtgacaacgtggtggattcgtgggaggaggtgtggtccagtccgtaggagaactcccgtagacgtacctctcctggtcgcacggccttcgtaggtacttccgttacctttaggttaacgtttagttcggattggacgtcggttccgggtcccgaccgaaggaccgtaccggaagggggacgggtcgttagggtcgttcggtacggacctaaaacgaacgtaaaaccgaaggtaacgtaaggggtaaaacggtaaaaacgtaaacttgttacgggtacggtaaccttacggtaggtaacgggaaccggggtacctaacgtttacccgaaccgttacttaccccgtaacgaaagtaaccggaaaccgaaaccggaacctaaaaggtaaaccgttacctaacgttacggttaactcgtaaggaactaaagtacgaaacgtcgacgtaggacgtacgaccggacgacgacgtcttagactacgtagtcgtacggaacgagtacgacttccgtatacctacgtttccgttgtttaccgngttaccgg

SEQ ID NO: 45644 - DNA, 673 bp, Homo sapiens
  misc_feature: GYAE6OF01A4AND.27.57.F02.1.454.CMB.1.raw
  modified_base (271)..(271): a, c, t, g, unknown or other
  misc_feature (271)..(271): n is a, c, g, or t
  modified_base (592)..(592): a, c, t, g, unknown or other
  misc_feature (592)..(592): n is a, c, g, or t
  modified_base (665)..(665): a, c, t, g, unknown or other
  misc_feature (665)..(665): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatgggaactggggctgagcttgggttttccttgttgcttattttagaggtgtccagtgtgaggtgcaacgtggtggattctgggaggaggtgtggtccaggcctggagactccctgacgactcctcctgtgcagcctntgtacttactacctttagtagttagttggatgagtcgtcggggtccacgacgacctccggaggggaacgggtctgggacgtttcggacggacctaaacaactaaaccgaagaagtaaggaaaggtaaaacgaaaactgtaggtacggtactgtaggtaggaacgggcctacgttaccaacctactaccctaaccgaggtaacgaaacccgtaaccgaaccgtaaaagaaaccgttcaaaccgtttagtaacttccgtaagaacgtaaagtacgaaacgacgtacccgtaggtaacggacggaccggaacggtacgaccgtnttacgaacttacctacgttggacgtacggagtacgtaccgtccttacgtacttaccgtttacgttcttttcgnttacccgg

SEQ ID NO: 45645 - DNA, 716 bp, Homo sapiens
  misc_feature: GYAE6OF01DD4DN.27.57.F02.1.454.CMB.1.raw
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctcgtggtattcctacctttagtagttattaggatggagtcgtcgggtccnccaggacctccggagggggaaggggtctaggggtacgttccgnggaacccaanaacgtaaaaccaagagtacggggaaaaggtaaaaacgaaaacgttagtaggtcggtaacctcgtagggtacggaaacggggtccctaagtttaccaacccgtaatcccttaaccgaggaaacgaacccgaaaccggaaccaaaaggaacgttaccaacgttacgtatccgtagaacgtaaatacggaacacggtccctaaggaacggaccgaccgggaagaccgtacgggacttacgttaactaaccggttacgtagggtacggaccgtaaaggtagttaaacccgttacggttaaccgttacctttaacgtttaccccgttttacgggttttacacccgttttacccgggg

SEQ ID NO: 45646 - DNA, 836 bp, Homo sapiens
  misc_feature: GYAE6OF01ARLX4.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttccttgttgctattttagaagtgtccagtgtgaggtgacaacgtggtgtattcgtgggaggaggttggtcggtccaggtccgtaggaacgtaactcccgtgacgaccttcgtccgtgtacgccacgtccttcgtggtacttccgtaacctttttagtacgtttagttggaattggacgtcggttcggggttccccaccgtaggtacccggtccgggaaggggggtaacggggtccttaggggtacgtttccgggtccggaaccctaaacgtaaacctaaaaccgaaaggtaacgtaaggggtaaaacggttaaaaacgtaaaacgtaggttcggtaacggtacctacggtaggttaacgggaacggggtacccttaagtttacccaaccgttacttccgtaaccgaaggaaccgtaaacccgtaaaccgacccgtaaaagttaaaccgtccgtaacgtttacggtaaccttaaccggttagaaaccgttaaactaccggaaacgtccgtaaccggtaggaacggtaccccggaacgggtaacggaactacccgggtacgtttacggtaaacttacccggaggtttacggccggtaaaggtaacgaaccgggtttctttaaacccggtacgttaccttaaccgtttcccggtttacgttttaagacccgtttacccgggg

SEQ ID NO: 45647 - DNA, 599 bp, Homo sapiens
  misc_feature: GYAE6OF01CD4HI.27.57.F02.1.454.CMB.1.raw
  modified_base (307)..(307): a, c, t, g, unknown or other
  misc_feature (307)..(307): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctcgtggattctacctttagtagttatggatggagcgtgggtccnccagacctccgaggggaagggctgggaggttcgtggccaacaataaaccaagagtagggaaggtaaaagaaactagtggtagactcgtagtaggacgggccgtaattcacctatcctaccgagaacgaaccaacgaccaaagaacgtcaactagtacttacgttacaaagtcgaaacacgtcctagacggacggaccggaaggaccgacggctaggtactacgtacgtggtcgacggagtacgtactccgtaagtcctaacgtttccgtacttttgacttccggttaccggg

SEQ ID NO: 45648 - DNA, 644 bp, Homo sapiens
  misc_feature: GYAE6OF01EL6RK.27.57.F02.1.454.CMB.1.raw
  modified_base (587)..(587): a, c, t, g, unknown or other
  misc_feature (587)..(587): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggtttccttgttgcttattttagaggtgtccagtgtgaggtgcaactggtggattcgtggaggaggtgtggtccagccgtggagaatccctgagacttctcctgtgcagcctctggattctacctttagtagttattggatgaggcgtcgggtccaccgagactccgaaggggacgggctgggagttcggcggacctaaacacgtaaaaccaagaagtaggggaaaggtaaaagaaaactataggtggacttcgtaggtaggaaacgggcctaagttaccgacctaatccctaaccgagtaacgactaaaccggacaaaggaactacgtatacgtatcgtagaactaactacgaaacgacgcgacgtaggaacggccggaacggaccgaacggtagttacgttaactacgtaaccgttgggcgtaaccggaanacggtacctaccgttaacgtccttaacgtttcccggttcgttttgtaccgttaccgg

SEQ ID NO: 45649 - DNA, 739 bp, Homo sapiens
  misc_feature: GYAE6OF01A6P4O.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtggattcgtgggaggagggttggtcggtccgagccgtgggagaactcccctgacgacctctcctgtgcacgcctgtgtacttctactttagttacttatggatgacgtcgtcgggtcctcgacgtacgtaccgaggggacgggtctagggtacgttcgtacggaccaaacgtaacgtaaaccgaaaggtacgtaagggtaaaacggtaaaaagtaaacgtagtagggtacggtaccgttacgtaggtacgggtaaacgggtcccgtaacttaccacccgttaacgtacccgtaaccgtaaggaaccggaaacccgaaaccgggtaacccaaaaggtaaaccggttaccgtaaccgtttaggtaacccgttacgttaaccggaacttaaaacggtaacgaaaccgtacggtaacccgtaagggaaccgacgggtaaccggaaccggaacggaccgggtacttacggtaactaccgttacgtggacgtacggaagacggtactcgtacgtacgtctttccgtatttgcgttccgg

SEQ ID NO: 45650 - DNA, 747 bp, Homo sapiens
  misc_feature: GYAE6OF01AQHR2.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaacgtggtggtattcgtgggaggtaggtgtggtccaggccgtggagactccctgagacctctcctgtcgcacggccctcgtcggtacttccgtacccgtttagttagttttagttgggatggacggtccgttcggggtccccgaccgaacgtacccgtaccggagggggaacggggtctaggggtacggtttccggtacggacccaaaacgtaacgtaaaccgaaaggtacgtaagggaaaaggttaaaacgaaaacgttagttacggtaggtaccttacgtagggtagggaaccgggtaccgtaacgttaccaccgtacgtaccctaccgaaggtaaccgaacgaaacccggaccaaacgtaacgtccctaacgttacgttaactacgtacgaaactaatacgaactcggacctaggaacggtacggccggtaacgacgaccggtactagtaaccgttacgttaccgtaggtacgaccggtaaggtacgttaccgttaccgttacggttaaccctttaccggtttccttaccgtttggtccgttaccggg

SEQ ID NO: 45651 - DNA, 781 bp, Homo sapiens
  misc_feature: GYAE6OF01DK66D.27.57.F02.1.454.CMB.1.raw
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaactggtgattcgtgggaggaggtgtggtccagcctggagaactccctgagactctcctgngcagcctntgtacttctacctttagtagttattggatgacgtcgtcgggtccgccgagaccgtaccggaagggggaacggggtccgttaggggtacgtttcgggtacggaacccaaacgtaaacttaaaacccgaaaggtaaggtacggggaaaacggttaaaaaacgtaaaaaccgttaagttacgggttaacgggtaaccttacggttacgggtaacgggtaaacgggggtacccgttaacgtttacccgaacctacttcctaccccgaaagaaccgaaacccgaaaccgacccgtaaaaggtaaaccgttacgtaacttacggttaacttacgtcgtaaacctaaaagttacgaaacgtaaccgtacccgttaaggaacggaccgggaacccgggtaaggaaccggtaccgggactttaacggttaactaacgttaaccgtggtaccgtagggaaacgtaggtaacccttacccgttagttacccttaacgtttcccgtttcggttttagaccgtttaccg

SEQ ID NO: 45652 - DNA, 860 bp, Homo sapiens
  misc_feature: GYAE6OF01AXCBJ.27.57.F02.1.454.CMB.1.raw
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtggattcgtggaggaggtgtggtccagcctgganactccngagctctctgtgcacgcctcgtggattcctaacctttagtagttagttggatggacgcgtcgggtcccgccgagaccgtcggaggggaacgggcgttagggtagtttccggtacggaacccaaactaacgttaaaacccgaaggtacgtaaggggaaagggttaaaaacgtaaaacgttagtacgggtacggtaacttaccgttagggtaacgggtaaaccggggtacccgtaacgtttacccgaacccgtacgtttacccgtaaccccggaacggaaaccggaaaccccgaaaacccggtacccgtaaaaacggtaaccggttacccgtaaaccggtttacgtaaccgtttaccgtacgtaaacctaaaaggttaccgaaaccgtaaccgtacccggttaacgggaaaccgggtaccggtaaccccgggaaacggtaacccggtacccggggtaccgtttaaccgttaaaccgttaacccgttaaacgggtttacggtccggaacgggttaaacgggtaaccgttacccgttaccccggtttaaccggttaaccgttaaccccgttttccccggttttaacgtttttcggtaaacccggttttacccccgggg

SEQ ID NO: 45653 - DNA, 761 bp, Homo sapiens
  misc_feature: GYAE6OF01DOFV0.27.57.F02.1.454.CMB.1.raw
  modified_base (199)..(199): a, c, t, g, unknown or other
  misc_feature (199)..(199): n is a, c, g, or t
  modified_base (609)..(609): a, c, t, g, unknown or other
  misc_feature (609)..(609): n is a, c, g, or t
  modified_base (657)..(657): a, c, t, g, unknown or other
  misc_feature (657)..(657): n is a, c, g, or t
  modified_base (750)..(750): a, c, t, g, unknown or other
  misc_feature (750)..(750): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactggggctgagtcttgggttttccttgttgcttattttagaaggtgtccagtgtgaggtncaactggtggtattcgtggaggaggtgtggtccagcctaggacgaactccctagagactctcctgtgcacgcctcgtggtacttcctacctttagtagttattcggattggatcgtcggggtaccaccaggtacctaccggaaggggaaggggctgggtagttccggtggaccccaaagtaactaaaaccgaagtagtaagggtaaacgggtaaaaagtaaaacgttagttacgggtccggtaacttaccgttaggggtaacggtaaacggggggacccttaggttaccctaacccgttactaccgtaccccgaaggtaaccggaaccgaaaaccggacccaaaaggtaaaccggtccctaaacgttcggttaaactccgttaaggtaactaaaacggttgaaaaacccncgtaccgtaggaaacgggtaccgaccgggtaaacggactacccggggnttaaccggttaacaaccgttagtcggttacgaccgggtaagtacgggacctttaccgtaacggtacccttaagttccccgtttacttttacgnggtttaccccg

SEQ ID NO: 45654 - DNA, 929 bp, Homo sapiens
  misc_feature: GYAE6OF01C7173.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccacatggaacgtgggctggagtcgttggggtttttccttgttgtctttaatttttaaggaaggttcgtccaggttggtgaacgggtgaccaacgttgggtgtattcgtgggagggagggtgtcggtccagtccgtaggagtaactccctagacgtacctctccgtgtcgaccacgtccttcgtaggtactttccttaaaccgtttaggtttaagtttagttgggattcggtacggtcggttccggggtacccgaccgaggtacccgtaccgggaaggggggtaacggggtccgtagggttaccggttacgggaccgaaaccccgaaaactaaaaccgttaaaaacccggaaggttaaacgtaaacggggtaaaaaggttaaaaaacgtaaaaacgtttgttaacggggtaggtaaccgttcgggttaaagggtacggggtaaaccgggtacccgttaacgtttacccaacccgtaaccgtttacccgtaaaccggaaacgggtaaaccgaaaacccccggtaaaccggaaaccggtaaaaaacggaccgttaaccgtaaaccgtttacggttaaatacccggttaacgaaacctaaaggttaaccggaaacccgtacggttacccggaaagggtaccgggtaaacccgggaccggaaacggggttacccgtaacggttacccgttaaagttaccggttaaacccgttgggtaacggttaaccgggactaaggtaaaccgttactacccgtttaccgtaccctttaccgttttaccggttttacgtcgttacgtacccgg

SEQ ID NO: 45655 - DNA, 856 bp, Homo sapiens
  misc_feature: GYAE6OF01D7YYF.27.57.F02.1.454.CMB.1.raw
  modified_base (774)..(774): a, c, t, g, unknown or other
  misc_feature (774)..(774): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgtgctattttagaggtgtccagtgtgaggtgcaacgtggtggtattcgtggaggaggtggtcgggtccacgccgtgggacgaactcccgtgagtacctctcctgtcgcagtccctgtggtacttccgtaactttagtagtttacgttggatggacgtcgttacggggtcccgtaccgaggtaccgtaccgggaagggggaacgggggtcttaggggtaacgtttccgggtaccggaacccaaacgtaaacgtaaaaccgaaaggtaacggttaagggaaaaggttaaaaacgtaaaacgttagttaacgggtacggtaaccgttacggttaggtacggggtaaaccgggtcccgttaacgttacccgtaacctaacgttccccgtaaccgaaggaaaacccgaacgaaacccggtaaacccgaaaagggtaaacccgtttaccgtaaaccgtttacggttaaaccgttacgttaaccgggaaaccttaaacgggtaccgaaacgtaaaccgggtacccgttaagggaaccgggttacgggacccgggaaacgggtaccgtaaccgggtcgttaaaggttaccgttaaacggttaccgtagggtaaccggnggttaacggaacgttaacgttaccccgtaaagttccctttaaacggttcccgttttaagtttaaccggtcgtttaacccggg

SEQ ID NO: 45656 - DNA, 661 bp, Homo sapiens
  misc_feature: GYAE6OF01AOB0K.27.57.F02.1.454.CMB.1.raw
  modified_base (258)..(258): a, c, t, g, unknown or other
  misc_feature (258)..(258): n is a, c, g, or t
  modified_base (377)..(377): a, c, t, g, unknown or other
  misc_feature (377)..(377): n is a, c, g, or t
  modified_base (526)..(526): a, c, t, g, unknown or other
  misc_feature (526)..(526): n is a, c, g, or t
  modified_base (579)..(579): a, c, t, g, unknown or other
  misc_feature (579)..(579): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctggttttccttgtgctattttagaaggtgtccagtgtgaggtgcaacgtggtggattcgtggaggaggtgtggtccagcctggagaactccctgagactctctgtgcncgcctgtgtattcctactttagtagttatggatgagcgtcggtccgcagactcggaaggggagggtctggacgtttcgcgaccaacaactaaaccgaagacgtagggtaaaggtaaaanaaacgtaggttaggtaggacctcgttaggaggtaaacgggcccgtaacttacccgaactacgtacctaccgaaagacgtaaacccgaaacgtaacccgaaagaaaccgttcgaacttaggtacttacggacgtaacaaagtacggaacnccggtacgtaaggacggacggaccggtaggaaccgtaccggtagtacgttaanacccgttacgtggtagggaccctaaaggagtaccgttacccgtacgtacgtttacgttccccgttattttcggaagttccgg

SEQ ID NO: 45657 - DNA, 806 bp, Homo sapiens
  misc_feature: GYAE6OF01DC107.27.57.F02.1.454.CMB.1.raw
  modified_base (188)..(188): a, c, t, g, unknown or other
  misc_feature (188)..(188): n is a, c, g, or t
tcagagcgtcgtctcacgaccggtgctcgatttagctcgatatagttgggtttgaggtctcagagaggagccttagccctggacctccaaggcctttccacttggtgatcagcacggagcacagacggacccaccatggaactggggctgagtcgtgggtttttccttgttgcttattttagaaggtntccagtgtgaggtgcaacgtggtggattcgtggaggaggttgtgggtccaggccgtggaagtaactccctagacggtacctcgtcctgtcgcgtacgccctcgtaggtactttaccgtaaccgttttaagttaagtttagttaggatggtacgtcggttccggggtcccgaccgaagtaccgtaccgggaagggggacggggtctacgggtacgttccggtacggaaccctaaaacgtaaacgtaaaacccgtaaaggtacgtaaggggtaaaaggtaaaaaacggtaaaaactttaggtacggtaacggtacgttaccggtagggtaacgggtaaccgggtcccgtaacgtttcccaaacccgttactaccccgtaccgtaaacggaaccgaaacccgaaccgaaccgaaaacggtcggttacaaccgtttacgtactccgttaagaacgtaaacgtaaccgaacggtactaacccggagggaaccgacggtaccggaacgacggtaccggacgtttacgtaacgtacctttcggtacggtacggactaacggtacgtaacctaccggtttaactcgtttaacccgtttcggttcttttacggtactttccccgggg

SEQ ID NO: 45658 - DNA, 752 bp, Homo sapiens
  misc_feature: GYAE6OF01DNZH2.27.57.F02.1.454.CMB.1.raw
  modified_base (205)..(205): a, c, t, g, unknown or other
  misc_feature (205)..(205): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactggggctgagcgtggtttctgtggctatttagaaggtgtcagtgtgagtgcaatggtggattcgnggaggcggtgtcggtaccagccgtaggacgaactcccgtagacgactcgtctgcgcagtcctgtacggtatttaccacgtttaggttagttagttggaattcggaacggtcgttcggggtacccacctaaggacccgtcggaagggggtaacggctagggtacgttccggagaaccccgtaaaataactaaaacgaagtagtaaggggaaaagtaaaacggtaaatgttacgggaagtactaacgtgggtaacggaagggtcctaattaccactactctaaccgagtaacgaaccgaacgtacgaaacggtattaccgaactttaggaccttacgaagtaacgtaaactaggaaacctaggtaacccgtaggaagggtaacccgaacccggaacggttaaaccgacccgggttaacttaacggtaaaccgttaaaccgttaacgtacggttaacgggtacccaaagggttcccgggtaacctttaacgtaacccgggttaacttttcgttacccgggtttacggttttacaacgggtttccccgggg

SEQ ID NO: 45659 - DNA, 666 bp, Homo sapiens
  misc_feature: GYAE6OF01BTW4K.27.57.F02.1.454.CMB.1.raw
  modified_base (179)..(179): a, c, t, g, unknown or other
  misc_feature (179)..(179): n is a, c, g, or t
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
  modified_base (444)..(444): a, c, t, g, unknown or other
  misc_feature (444)..(444): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtaggctatttagaggtntccagtgtgaggtgacacgtggtggtattcgtgggaggaggttggtcggtaccagtcctagggaactaagtcccctgaagtaccttctccgtgtcgcagccttgtcggtacttctacctttagtgttatgatagagcgtcgggtaccncacgacctcgggggggganaacgggntgacgttgcgacaanaacaacagagtagggaaaggtaaacaaagtgtacgtagacttcgtgaggaacggctagtacacgactccgtagganacgaacgacgaaccgaagaacgttcgaacgtacgtacgtaccggtataaccgaaagtaccgaaccggtaacgtaccggtagaaccgggacccgggaaccggttaacgggaccggtacgccgggttataaaccgttccgtagttagggacgtaaccgggtagaccgttataaccccggttacgttaccttacgttacccggtttattcgtaacccggttccgg

SEQ ID NO: 45660 - DNA, 801 bp, Homo sapiens
  misc_feature: GYAE6OF01ASFZO.27.57.F02.1.454.CMB.1.raw
tcagagcgtcgtctcacgaccggtgctcgatttagctcgatatagttgggtttggggaggtctcagagaggagccttagccctggactccaaggcctttccacttggtgatcagcacggagcacagaggaccccaccatggaactgggctgagctgggttttccttgttgctattttagaaggtgtccagtgtgaggtgcaactggtggattctggaggaggtgtggtccagcctggagaactccctgagactctcctgtcgcacgcctcgtcggattctacctttaaggtacgttagttggatgtaggcgttcgggtccgtccaggtacctaccgagggggaacgggcgttgggtagtttcgggtcgtaaccaaacgaactaaaacccgaaggtaagtaacggggtaaaaggttaaaaagtaaaaaccgttagttacggtacgggtaaccgttagttagggtaacggaacggggaccgttaacgtttacccaaccgtaaccttcctaaccccgaaggtaaaccggaaacctaaaaccgggtaaccccggaaaacgtaaacggttacctaaacgttacggttaacttacggtaaccggtaaaccttaaaaggtaccgaaaaaccggtccgtaaccggttaacggaaacgggacggtaaccccgggaaagggtacccggaaccggtacgttaacgttaaccgttaaccgtaagttcggtcggtaagacggtagtacccttacccggtttacgttaaccgtacccgtttacccggtttcttttaaccgggtaccttcccgggg

SEQ ID NO: 45661 - DNA, 623 bp, Homo sapiens
  misc_feature: GYAE6OF01DYWI7.27.57.F02.1.454.CMB.1.raw
  modified_base (388)..(388): a, c, t, g, unknown or other
  misc_feature (388)..(388): n is a, c, g, or t
  modified_base (505)..(505): a, c, t, g, unknown or other
  misc_feature (505)..(505): n is a, c, g, or t
  modified_base (521)..(521): a, c, t, g, unknown or other
  misc_feature (521)..(521): n is a, c, g, or t
  modified_base (554)..(554): a, c, t, g, unknown or other
  misc_feature (554)..(554): n is a, c, g, or t
  modified_base (567)..(567): a, c, t, g, unknown or other
  misc_feature (567)..(567): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaggtgtccagtgtgaggtgcaactggtggattcgtgggagggaggtgtcggtccaggcctaggaagaactcccgtgagacctcgtcctgtgccacgtccctcgtggaactttcctaccttttaaggtagtttagttggaatggagtcgtcggggtcccgaccgagtacctccggaagggggtaacgggcttagggagttcggtcgacccaaanactaaaaccgagagtagggaaagtaaaagaaactgtggtcggacctgtggtaaggaacgggcctaatccacctatccacgagacgaaccaacgaccaaaggacctacacgtgtactntacgacaaatcgaacngtacccaggacgacgtaccggagacgccggatnttacgtactacgngtacgtaggaggcgtacttaccgtacgtacctacggttcccttgtttcgcttacgg

SEQ ID NO: 45662 - DNA, 699 bp, Homo sapiens
  misc_feature: GYAE6OF01E1I6M.27.57.F02.1.454.CMB.1.raw
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttctgtgctattttagaaggtgtccagtgtgaggtgcaacgtggtggattctggaggaggtgtggtccagcctggagaactccctgagactctcctgtcgcagcctcgtggaacttctaactttagtagtttattggatgagtcgtcgggtccnccganacgtccgaaggggacgggctgggagtttcgtggacctaanaactaaaaccgaagaacgtgggaaaggtaaaagaaaacttagtaggtaggaacttcgtaggttacggaagggtcccgtaattaccgaacctattaccctaccgaagaacgaaacgtaaacccgacgtaaaacggtaacgtccgtaacgttggtaacttaccgtagaaccgtaaagttacgaaacctaggtaacccttagggaaagaccgggaacccggaagggaaccgtaccggttcgttaaggttaacttaaccgttaaccggtggttacggaacggagtaaacggaccctttaacgtacgttccttaacgtttttcccgttacgttttggacctttcccggg

SEQ ID NO: 45663 - DNA, 797 bp, Homo sapiens
  misc_feature: GYAE6OF01B40GW.27.57.F02.1.454.CMB.1.raw
  modified_base (637)..(637): a, c, t, g, unknown or other
  misc_feature (637)..(637): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccagtggaacgtgggctgagcgttgggttttccttgttgcttattttagaaggtgtccagtgtgaggtgacaacgtggtggattcgtgggaggtaggtgtggtccagccgtaggagaatcccgtgacgtactcgtcctgtgacgtacgtccttcgtaggtacttccgtaaccgtttttagtagtttagttggaattggtaacggtcgtcgggtcccgccgtaacgtaccgttaccggaagggggtaacggggtccgtagggtaacgggttccgtacgggaacccaaaacgtaacgtaaaaaccgaaaggtacgttaaggggaaaaggttaaaaacgtaaaacgtagtacggtaggtaacgttacgtaggtaacggtaacgggaccctaagttaccccgaaccgtattaacccgtacccgaaaggaaccgaaaacccgaaaccgtaacccgtaaaaggacgtaaccctaccgttagttacgtaccgtagaactaaaagtcgaaaccncgtacccgtaggaacggcgtacccgggaagacccgacgggttacctagtttaaactaccgttaacggtcggttacgggaaccgtaagggtaacccgtagttaaccccgtttaaggtcccctttaacggtttcccgtttcttttaacgacggttttcccgg

SEQ ID NO: 45664 - DNA, 779 bp, Homo sapiens
  misc_feature: GYAE6OF01E2LSH.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaactgggctgagcgttgggttttccttgttgcttattttagaaggtgtccagtgtgaggtgacacgtggtggattcgtgggaggaggtggtcggtccagccgtaggacgaactcccgtagacgaccttcctccgtgtcgccacgtcctcgtggtacttcctaaccgtttaggttactttagttggatgacgtcggtcgggtcccaccgaacgaccgtaccgggaagggggtaacggggtcgttagggtacgttcggtacggaacccaaaacgtaaacgtaaaaccgaaagtaaggtaaagggtaaaaggtaaaaacgtaaaacgttagtacggtacggtaccttcggtaggtacggaaccgggtacctaacgttacccgaaccgtactaccctaaccgaaggtaaccgaaacccgtaaacccggaccgaaaggtaaaccgtacctaacgttacgttaactacgtaacgaaaccgtaaagtacgaaacgtcgtaccgtaggaacggtaaccgaccggaacggaacccgtacggtaccgttagtaaccgtaccgtacggtcggtcgaaccggtaagttaccgtacgttacccgttacgttaccttacgtttacccggtttacgtttttacgccgttaccgggg

SEQ ID NO: 45665 - DNA, 675 bp, Homo sapiens
  misc_feature: GYAE6OF01CB83C.27.57.F02.1.454.CMB.1.raw
  modified_base (216)..(216): a, c, t, g, unknown or other
  misc_feature (216)..(216): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (529)..(529): a, c, t, g, unknown or other
  misc_feature (529)..(529): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtgggtggattcgngggaggagggtgtgggtccaggcctggagaactccctggacgacctctcctgtcgcacgcctactggtacttctacctttagttagttagttggatgagtcgtcggggtcccgaccgagaccgtccggaaggggaacgggtcgtgggaggtttccggnggacccaaanaacgtaaaaccgaagtaaggtacgggtaaaggtaaaaacgtaaaactaggtggtacggaacttcgtacggtaggaacgggtctaacttacccacgtacttcaccgaagacgaacaaccgaccaaagactacactagtatacgtanaactaagtacaacgaccgacgtaggaacggacgaccggaacgtaaccggccggtacgttagtaaccttaacgtacgtgggtacgtacggaagtactacgttccttaacggttccttaacgtttcccggttctttgtacgttccggg

SEQ ID NO: 45666 - DNA, 647 bp, Homo sapiens
  misc_feature: GYAE6OF01DMSH5.27.57.F02.1.454.CMB.1.raw
  modified_base (256)..(256): a, c, t, g, unknown or other
  misc_feature (256)..(256): n is a, c, g, or t
  modified_base (333)..(333): a, c, t, g, unknown or other
  misc_feature (333)..(333): n is a, c, g, or t
  modified_base (464)..(464): a, c, t, g, unknown or other
  misc_feature (464)..(464): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattcgtggaggaggtgtggtccagcctggagaatccctgagactctcctgngcagcctctggacttctacctttagtagttattggatgagctggtccgccagactccgagggagggctggagttcgnggccaacaataaaccaagaagtgggaaaggtaaagaaaactatggtaggactcgtggagaaggggccaattccaacctatcctaccgagtaacgaaccaaaccgaccaaaaggacgtaccaactgttaacnctagaactaaattcgaaaccagtacccgttaggaacggtacggacccggaacgaacccggtacggtaccgttaggttaaacgttaccgttaaccgtagggttaccgacgggtaaggtaaacgtaccgttaccgttaaggttccctaaagttttccccccggttatttttggaactttacccgg

SEQ ID NO: 45667 - DNA, 568 bp, Homo sapiens
  misc_feature: GYAE6OF01ED57F.27.57.F02.1.454.CMB.1.raw
  modified_base (340)..(340): a, c, t, g, unknown or other
  misc_feature (340)..(340): n is a, c, g, or t
  modified_base (509)..(509): a, c, t, g, unknown or other
  misc_feature (509)..(509): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaatccctgagactctcctgtgcagcctctggattctacctttagtagttattggatgagcgtggggtccgccagactccgaggggaaggggctgggagttcgnggccaacataaaccgaagatagggaagtaaaagaaactagtggtacggactctggtaggaaacgggtccgtaattccacctattcctaccagacaaccgaacgaccaagaacgtctaacgtgtactcgtagacaaatcgaactgacctgaggacgaccgaggccacggntgtatacctagtgtcgacgagacgtactctacgtctacgttcccgtattttgattccgg

SEQ ID NO: 45668 - DNA, 782 bp, Homo sapiens
  misc_feature: GYAE6OF01CCV55.27.57.F02.1.454.CMB.1.raw
  modified_base (241)..(241): a, c, t, g, unknown or other
  misc_feature (241)..(241): n is a, c, g, or t
  modified_base (760)..(760): a, c, t, g, unknown or other
  misc_feature (760)..(760): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctggttttccttgttgctattttagaaggtgtccagtgtgaggtgcaacgtggtggattcgtagggaggtaggtggtggtccagccgtggganaactccctgagactctccgtgtgcacgcctctggtacttctacctttagtagttattggatgagtcgttcgggtcccgccgagacccgtaccggaagggggaacggggcgtagggtaacggtttccggtcgggtaacccaaaacgaaacgttaaaaaacccgaaaggtaacgtaaaggggtaaagggttaaaaaaaggtaaaaacgttagttacgggtaggtaccttcggttacgggtaggaaaccggggacctacgttaccaaccgtactacccgtaccgaaggaacgtaaacccggaaaccgacccaaaaacggtacgttaacccaacggttacgttacgttacgtacgtaaacctaaagttaaccggaaacctacgaccgtaaggaccgggaaccgaccgggtaacggaaccggtacggaccgtttaacggttaactacccggttagtaccgggttcgaacggtacggtaagtacccttaccggtttaccgtacgtttaacccgtttcccggtttnttttagtaccgtttacccgggg

SEQ ID NO: 45669 - DNA, 681 bp, Homo sapiens
  misc_feature: GYAE6OF01EPHTJ.27.57.F02.1.454.CMB.1.raw
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (549)..(549): a, c, t, g, unknown or other
  misc_feature (549)..(549): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaggtgtcagtntgngtgcatggtggattctggaggaggtgtcggtcagccgtggacgaactccctgagacctctcctgtgacacgccttcgtagactttcctacgttttagtagttttagttggattggacgtcggttggggcccgaccgaacggaccgttccgggaagggggacggggtcgttaggggtaggtttccggtcggaacccaaacgtaaactaaaaccgaaggaagtaagggtaaacgtaaaaagaaaactgtacggtaggtactcggtaggacggacggaccgtacttaccactacttcccgtaacagtaacgaaccgaaccgaacgaacgtaagtaccacgttacgtataccgtagaacgttaaancgaacggctaccggagaaccggacgacggaagtaccgacgtagtacgtaactccgattacgggcgacgggaataacccggtcttacccggttataccctttacttacccgttcgttttaacgcgttacccgg

SEQ ID NO: 45670 - DNA, 702 bp, Homo sapiens
  misc_feature: GYAE6OF01DLN3D.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcttgggttttccttgttgctattttagaggtgtccagtgtgaggtgcaacgtggtgattcgtgggaggaggtgtggtccagcctggagactcccgtgagactctcctgtcgcacgtcctcgtaggtactttccttaaccgttttagtagtttagttggatggagtcggtcgggtccgccgagacctccggaaggggacgggtcgtagggtacgttcggtacggaaccaacgaactaaaccgaaggtagtaagggaaagtaaaacgaaacgttagtggtacggtacttcggtaggtacggaacgggtcctaattaccaaccgtacttcccgtaacgagaaaccgaaccaaaccggaaccctaaaggaaccgtttacgacgtttaggttaactccgtacgaaactaaacgtcggaaaccgcggtacccgtaagggacgacggaccggaacgaccgtacgggtactacgtaacttccgtaaggtgtacggacgtaaggtaactaccgttacctaacggtcctttaacggtttcccgttacgtttgcgttaccgg

SEQ ID NO: 45671 - DNA, 807 bp, Homo sapiens
  misc_feature: GYAE6OF01DNH95.27.57.F02.1.454.CMB.1.raw
  modified_base (212)..(212): a, c, t, g, unknown or other
  misc_feature (212)..(212): n is a, c, g, or t
  modified_base (787)..(787): a, c, t, g, unknown or other
  misc_feature (787)..(787): n is a, c, g, or t
tcagagcgtcgtctcacgaccggtgctcgatttagctcgatatagttgggtttgaggtctcagagaggagccttagccctggactccaaggccctttccacttggtgatcagcacggagcacagacggacccaccatggaactgggctgagtcgttggttttccttgttgtcttattttagagtgtcagtgtgaggtgcactggtgattcgnggaggtaggtgtggtccagccgtaggacaactccgtagacgtcctccgtcgtgtcgacgtccgtccttcggtagttacttacctttaacgttttagttagtttagttaggtagtaggaccggtcggtacccgggtaccgtaccgtaaccggtacccggtaacccgggaagggggtacggggtccgttagggtccggttacgggtaccgaaacccgtaaaacaaaccgtaaaaccgtaaggtaaggtaaacgggtaaaacggtaaaaaagtaaacgttaggtcggttaacggtaccttgggtaacgggtaacggtaacccggtaacgttaccttacccgaaccgttctacccgtaaccgaagggaacccaaaccggacccgaaagaaacgtcttacccagtttaccgtactaacggtacccaaacgtaactaacgaccggaactccgtaaggacgaccgggaaaccgtacggaccgttccgtgttaaaccgtacttaccgttagggagttacggagttaaaccggggactttaacccgttgacccgtttttaaaccgttccgtttggtttttaacngggttaccctaacccggggg

SEQ ID NO: 45672 - DNA, 814 bp, Homo sapiens
  misc_feature: GYAE6OF01DENZV.27.57.F02.1.454.CMB.1.raw
  modified_base (147)..(147): a, c, t, g, unknown or other
  misc_feature (147)..(147): n is a, c, g, or t
  modified_base (439)..(439): a, c, t, g, unknown or other
  misc_feature (439)..(439): n is a, c, g, or t
  modified_base (679)..(679): a, c, t, g, unknown or other
  misc_feature (679)..(679): n is a, c, g, or t
tcagagcgtcgtctcacgaccggtgctcgatttagctcgatatagttgggtttgaggtctcagagaggagccttagccctggactccaaggtcctttccacttggtgatcagcacggagcacagaggaccacatggaactgggctgngcttgggttttcctgttgcttatttagaaggtgtccagtgtgaggtgcaacgtgggtggattcgtgggaggaggtggtggtccagccgtaggagtaactccctaggacgtactctcctgtcgcacgcctgtggtacttctaccgtttatagttagttggatggagtcgtcggtccacgtacgtaccgtaccggaaggggaacggggtcgtagggtacgttcggacggaccaaaacctaaacgtaaaaccgaaaggtaacggtaaggggaaaacggttaaaagaaaaacgttntacggtacggtacttacggtaggtaacgggaacgggtaccctacgttacccgactacgtaccctaaccggtaaggaaacccggtaacccgaaaccggaaccgtaaaaacggtaacccggttaactaacggttacgttaaccgtacccgttaaggaaacgtaaaagttaccggaaaacgtccggtaaccggtagaaaccgggtacccgggaacccggtaaggaacccggtaacccgggttnttaaaccggttaacctaaaccggttacgtacggggtacgtaaccgggtaacgttaacgtaccggtttaccccttaaggttaacccttacccgttttacccgggtttacttttagggtcccgttttaccccggggg

SEQ ID NO: 45673 - DNA, 694 bp, Homo sapiens
  misc_feature: GYAE6OF01E0D4R.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctgggaggaggtgtggtccagcctggagaactccctgacgactctcctgtcgcagcctcgtggacttctacctttagtagttattggatgagcgtgggtccgccgagacctccggaaggggacggggcgtgggtacggttcggtggaccaacaataaaccaagagtagggaaagtaaaagaaaactagtggtaggtactcgtaggtaggaacgggccgtattaccgaactactccgtaccgaaggtaacgaaccgaaaccggaccgaaaaggtaacgtaccgtaacgttacggttaacttccgtaacgaaacgtaaactacggtaaaccgaacggtccgtaggaacggaccggccggaacggaaccgacggtacgtagttaacttaaccgttacgttcgggtaccggaggaacggtacgtaacgttaccgttaacgttacgttaccgtttacccgtttacggtttttagtaccgtttacccggg

SEQ ID NO: 45674 - DNA, 537 bp, Homo sapiens
  misc_feature: GYAE6OF01BP075.27.57.F02.1.454.CMB.1.raw
  modified_base (505)..(505): a, c, t, g, unknown or other
  misc_feature (505)..(505): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagctgggtccgccagactccgaggggaaggggctgggagttcgtggccaacataaaaccaagatagggaaggtaaagaaaactagtagtaggactctgtaggaagggccgattcaccatctccagagacaacgcaaagaacgtcaactgtatctgacaaatcgaacagacctaggagacgaccgaggacacggctagtactactactgtcgngagagatcctagtctattccgtctttgattcg

SEQ ID NO: 45675 - DNA, 837 bp, Homo sapiens
  misc_feature: GYAE6OF01C0LR0.27.57.F02.1.454.CMB.1.raw
  modified_base (189)..(189): a, c, t, g, unknown or other
  misc_feature (189)..(189): n is a, c, g, or t
tcagagcgtcgtctcacgaccggtgctcgatttagctcgatatagttgggtttgaggtctcagagaggagccttagccctggactccaaggcctttccacttggtgatcagcacggagcaacagaggacccaccatgggaacgtggggctgagtcgttgggtttttccttgttgcttattttagaggtntcagtgtgaggtgcaacgtggtggattcgtgggaggaggtggtcggtaccaggtcctggacgtactcccgtagaacgtctcgtccgtgtgactacgtcctcgtgtacttaccttaaccgtttagttagtttagttaggagtgtacggtccgttccggggtcccgaccgaacggaccgtaccggaagggggtaacgggtcgtagggttacggtttccggacggtaacccaaacgtaaacgtaaaaccgtaaggtaacgtaaggggaaaaacggtaaaaagtaaaaaccgttagtacggtaggtaacttacgtaggtaacggaacgggtaccgtaacgtttaccgaaccgttacgtcccgaaccgaagtaaccggaaaccctaaccggaaaccgaaaaggtaccttaccgtaactttaacggttaacctaccgtaacgtaacgtaaactacggaaactaccggtaactacgggaacgtaacggaccgggtaacggtaacccggtacggttaaccggttaaccgttaaacgttaacggttaacggttacggcgggtaaccggtaacggtacgttaacccggttaaccttaccgggtttacctttacccggttttacccggtttacggttttccgttccgggttaacccggg

SEQ ID NO: 45676 - DNA, 870 bp, Homo sapiens
  misc_feature: GYAE6OF01C0NRJ.27.57.F02.1.454.CMB.1.raw
  modified_base (243)..(243): a, c, t, g, unknown or other
  misc_feature (243)..(243): n is a, c, g, or t
  modified_base (664)..(664): a, c, t, g, unknown or other
  misc_feature (664)..(664): n is a, c, g, or t
tcagagcgtcgtctcacgaccggtgctcgatttagctcgatatagttgggtttgaggtctcagagaggagccttagcccgtggacctccgaaggccctttccacttggtgatcagcacggagcacagacggacccacatggaacgtgggctgagtcgttgggttttccttgttgcttattttaggaggtgtccagtgtgaggtgactaacgtggtgtattcgtggaggtaggtgtcgggtccngccgtaggacgaactcccgtagacgtacctcgtcctaggtcgacctcggtcccttacgtcggttaacctttacccgttaacccgtttttaaggttaagttttaaggttaggacgttgggacggtccgggtttccgggttacccgacccgtaacgggtacccgtaacccggggtaagggggggtaacgggtccgtagggggtaccgttaccgggacggtaaaccccaaaacgtaaacgtaaaaaccgaggttaacggtaaaggggtaaaaggtaaaaaacgtaaaacgtttacggttacggacggtaacttcggtagggtaacgggaacgggtaccctacttcccaaaccctgttccccgaaccgaaggaacgtaacccgtaacgaaccgtaaaagtccgtactagtttaccgtatccgtanaacgtaagacgtaaacgccgtactaagggaccgggaccgtaaccgggaacgtaaccggttacgggtaccttaaaagggttaccttaacccgttaaggtcgggtacggtaaacggttaagggaaacccttcccgtttaaaccggttagttttaccccgttaacccggttttcccgtttacgtttttaccgggccttttaacccgggg

SEQ ID NO: 45677 - DNA, 805 bp, Homo sapiens
  misc_feature: GYAE6OF01ACK61.27.57.F02.1.454.CMB.1.raw
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcttgggtttcctgttgctatttagagtntccagtgtgaggtncaacgtggtgattcgtggaggaggtgtcggtccaggcctggacgaactcccgtagacgtacttccgtccgttaggtcgcctacgtccttcgtggtactttcctaaccgtttttagtaagttttagttaggacttacggacgtccggttccggggtaccctaccgaacggtacccgttacccgggaaaggggggtaacggggtccttaggggtacggtttaccggtaccggaaccctaaaacgtaacgtaaaaccgaaggtacgtaggggtaaaagtaaaacgaaacttagtcgggtacggtacttcggtacggtaaggtacgggtcctacttaccgaccgtattacccgtaccgaaggtaccgtaaaaccaaccggaccgtaaaaggtacgtaccctaacgttagtaactccgttaggaacctaaagtacgaaccgcgttaacccgaggtaacggaccgggaccgtaacgggaacccgacgggtacttaacgggttaccttaaaccggtaaccggtttgacgggaacccggtaggtaacccgttacgttaccccgttaaggttacccttacccgtttaccgttacggtttttacccgaaccgtttcccgggg

SEQ ID NO: 45678 - DNA, 872 bp, Homo sapiens
  misc_feature: GYAE6OF01DB8KI.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaacgtgggctgagcttgggttttcctgttgcttattttagaggtgtccagtgtgaggtgcaacgtggtggattcgtggagggaggtgtcggtccagtccgtaggagaactccgtgacgtacctctccttggtacgctacgtcctcgtaggttactttaccgttaaccgtttttaaggttagtttagttacgggtacttggacggtccggttcggggtcccgaccgtacggtacccgtaccgggaaggggggtaacgggtcgttagggtacggtttcgggtacggaaccctaaaacgtaacgtaaaacccgtaaaggtaacggtaaaggggtaaaaggtaaaaacgtaaaacgttaggtaacggtacggtaaccgttacgtagggtacgggaaaccgggtacccgttaacttaacccgaaccttaccgttcccgttaaccgaacgggtaacccgaaacgaacccgtaaaccgtaaaggtaaccgtaccgtaaccgttaggttaaccgtacgtaacgtaacgtaaaacgttacggaaaaccgtcggtaacccgtacggaaaccgggtaccgggaccgggtaacgggtaacccggtaccgggtaaccgtttaggttaaaccgtaaaccgtttcggtaagggtccggaacgggtaaacggttaccgtaaccgttacccggtttaccgtaacccgtttacgttttacccgggttttacgttacgttaccggtttacccggg

SEQ ID NO: 45679 - DNA, 754 bp, Homo sapiens
  misc_feature: GYAE6OF01B5F0F.27.57.F02.1.454.CMB.1.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacagtggaacgtggggctgagcgttgggtttttccttgttgtcttagttttaggaaggttgtccagtgtgtaggtgacaacgtggtggtattcgtgggaggaggtgtggtccagcctgganactccgtgacnctctcngtncngcctgtgtacttctacgtttagtattagtgatgagtcggtcggtcccgcgacgtaccgtcgggaaggggagggtcgttagggacggttcggtacggaacctaacgaaacgtaaaccgaaggtagtaagggtaaaggtaaaaagtaacgttagtagggttacggtacttacggtaggtaacggtaacggggtccgtaacttacccgaccttaccgttacccgtaccgtaaggaccgtaaacccgaaccggaacccgtaaaaggtaccgtaaccgttaacggttacgttaactaccgtaacgtaacgtaaacgtaccgtaaacgccggtaccgagggtaccggaccggaccggaacggtaaccgtcggaacgtttagtaaccgttaccgttaacgtcgggtacgtacggaacggttcttaccgttacccggttaacgttcccgttaacgttttccggtttaccgtttggtccgtttacccggg

SEQ ID NO: 45680 - DNA, 692 bp, Homo sapiens
  misc_feature: GYAE6OF01A0YO6.27.57.F02.1.454.CMB.1.raw
  modified_base (181)..(181): a, c, t, g, unknown or other
  misc_feature (181)..(181): n is a, c, g, or t
  modified_base (218)..(218): a, c, t, g, unknown or other
  misc_feature (218)..(218): n is a, c, g, or t
  modified_base (323)..(323): a, c, t, g, unknown or other
  misc_feature (323)..(323): n is a, c, g, or t
tcagagcgtcgtctcacgaccggtgctcgatttagctcgatatagttgggtttgaggtctcagagaggagccttagccctggacctccaaggtcctttccacttggtgatcagcacggagcacagaggacccaccatggaactggggctgagcgtcggtttcgtgtaggctatttagagtntcagtgtgaggtgcaagtggtggtattcgtgggaggnggtgttggaccagccgtggagtaactccctaggataccttctcctgtcgcagcctcgtgtattctaccgtttagtagtttagttggatgacgtcgtcgggtcccncgacgaccgtccgaagggggaggtcgtggtaggttcggtcggacaaacaataaaccaagagtaggaaaggtaaaagtaaacgtagttaggtacggtacttacgtaggttacggggaacgggtccgtacgttaccctaaccctattaccctaaccgacgaacggaaaccccaaacggaccgtaaaggaaccttacgtacgttagtaacgtccgtagtaaactaaagtcgaaaccgtcgtaccgacggaacgtacgggaccggaagtaaccgggaccgtacgtaggttacttaaaccgttcggttagtcggagaacggaatccgtacgttacgtaccttacgtttaccgttcttttaagtcgtttcccggg

SEQ ID NO: 45681 - DNA, 849 bp, Homo sapiens
  misc_feature: GYAE6OF01BORFH.27.57.F02.1.454.CMB.1.raw
  modified_base (182)..(182): a, c, t, g, unknown or other
  misc_feature (182)..(182): n is a, c, g, or t
tcagagcgtcgtctcacgaccggtgctcgatttagctcgatatagttggggtttgaggtctcagagaggagccttagccctggactccaaggcctttccacttggtgatcagcacggagcacagaggacccacatggaactggggctgagctggtttctgtgctatttagagtgtccagtgngagtgccgaaccggtggacttcgtggaggtaggtgtggtccaggcctgggacgaacgtcccctgacgtactctcctgtcgcacgcctcgtggtacttccaaccgttttagtagtttattcggattggacgcgtcggggtcccgccgtaaggacctccggaagggggaacggggtctaggggtaacgtttcggtacgggacccaaaacgtaaacgttaaaaacccgaaaggtaacgttaaggggaaaacgggttaaaaaagaaaaaccgttagtaacgggttagggaacctttacggtacggttaggaaacgggggtccctaagtttacccaacccgtattccctaccgaacgaacggaacccgaaaccgacccgtaaaaggaaaccggttacctaacgttacgttaaacgttccgtaacggtaaaccctaaaaggttacggaaaacccgtacgggaaccccgtttaagggaaaccgggaacgggttaccccgggaaaacggggttaacccaacccggggttacttaacgggtttaaaccttaaccggtttaccgttagggtacgggtccggaaaaggcggttaaaccctcccgtttaaggtacccgttaaacccgtttttcccggttaccgttttttaacggacccgtttccggttaacccgggggg

SEQ ID NO: 45682 - DNA, 842 bp, Homo sapiens
  misc_feature: GYAE6OF01AS9XV.27.57.F02.1.454.CMB.1.raw
  modified_base (796)..(796): a, c, t, g, unknown or other
  misc_feature (796)..(796): n is a, c, g, or t
tcagagcgtcgtctcacgaccggtgctcgatttagctcgatatagttgggtttgaggtctcagagaggagccttagccctggactccaaggtcctttccacttggtgatcagcacggagcacagacggacccaccatggaacgtggggctgagtcgttgggttttccttgttgtcttagttttagaaggtgtcagtgtgaggtgctacgtggtggtattcgtgggaggtggtggtcggtccgagtccgtggaacgtacctcccgtagacgtaccttcctaccgtggtcgcacggtccttacgtcggtactttacccgttaccgttttaggttagtttagttcggataggtaggtccggtcgggtcccgtacgaaccgtaccggtaccgggaagggggaacgggtcggtacgggtacggttccggtaccggtaaccaaacgtaaacgtaaaccggaagtaaggtaaacgggtaaaggtaaaaacgtaaacgtgtaggtacggtacgtacggttagggtacggggtaacggtcctaacgttacccgaacctaacttcccgtaacgaaaccggacggtaaaccccctaaccggtaaacccggtaaaaggtaaccctacccgttacgttaaacggttactacggttaaccgaaacttaaagtaccggaaacctccgggtaaaccggtaggaccgtaaaccgggtaccggaacgggtaacccgacgggtttctaaaggttaaacccttacggtaccggtagccgggtaaaagacggttcgtaaacccttacccgggtttanaaccccttttagggttttccccttaacgtttggtccccgtacgggg

SEQ ID NO: 45683 - DNA, 765 bp, Homo sapiens
  misc_feature: GYAE6OF01COBQ4.27.57.F02.1.454.CMB.1.raw
  modified_base (175)..(175): a, c, t, g, unknown or other
  misc_feature (175)..(175): n is a, c, g, or t
  modified_base (210)..(210): a, c, t, g, unknown or other
  misc_feature (210)..(210): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgtggtttctgtagctatttagaggtntcagtgtgaggtcgacaagtgggtaggtattcggnggaggtaggtcgtacgggtccaggccgtagggaataactcccgtagacgtacctcgtccgtgtacgcgacgtcctgtacgtacttaccgttacctttagtagtttagttacggagttacggacgtcggttcggggtcccaccgacggttaccgtaccggaaggggggtaacgggtccgtagggtacgtttaccggtacgggaaccccaaaataaacgtaaaccgaaaggtagtaaagggtaaaaggtaaaaacggtaaaacgtaggtacggtacggtaacgttcgtaagggtacggaaacgggtccgtaacttaccgaacctacttaccgaccgaaggacaaaccgaaccgaaccgtaaaagcgtaccaagttcgtaactactaggaaactaaggttaagaaccgagtaccgaggaacggaccgaaccgggacggaaccgttacggtacttaacggttactaaacccggttgacgggagaaccgggtagaaacggttaccctacggttacgttaccttaccggtttaccgtttactttgaacggtttaccccggg

SEQ ID NO: 45684 - DNA, 783 bp, Homo sapiens
  misc_feature: GYAE6OF01ARJC1.27.57.F02.1.454.CMB.1.raw
  modified_base (312)..(312): a, c, t, g, unknown or other
  misc_feature (312)..(312): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaaccaccatggaactggggctgagctgggttttccttgttgctattttagaaggtgtccagtgtgaggtgcaactggtggattctgggaggaggtgtggtccagcctggagaactccctgagactctcctgtgcagcctcgtggtacttctacctttagtagttatggtatgagtcgtcgggtccncagctccggaaggggaagggtctgggtacgttcggtcggacccaaacgtaactaaaaccgaaaggtagtaaggggaaaggttaaaaacgaaaaacttagttagggtacggtacttacgtaggttaacggaacggggtacccgtaagttacccaaccgtaacttcccgtaaccgaaggtaacgaaacccgaaaccggacccgaaaaggtaacggtacctaaccgttaggttaactaccgtaacggaaacctaaaagttaccggaaaacgtaaccggtcccggttaaggaacgggtaacccgggacccggaaacggggaacccgtaccggggtactttaacgggttaaaccttaaccgtttaaccgtcgggtaccggaacggtaaacgggtacgttaacccgttaccccgtttaaagggttacccttaaccggtttttccccgttaacttttttacggaccgttttacccggg

SEQ ID NO: 45685 - DNA, 787 bp, Homo sapiens
  misc_feature: GYAE6OF01AZIE3.27.57.F02.1.454.CMB.1.raw
  modified_base (196)..(196): a, c, t, g, unknown or other
  misc_feature (196)..(196): n is a, c, g, or t
  modified_base (582)..(582): a, c, t, g, unknown or other
  misc_feature (582)..(582): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcgttgggttttcctgttgcttattttagagtgtcagtgtgaggtnactaacgtggtggtattcgtgggaggaggtgtcggccagccgtagggaacgtactcccgtgacgaccttcctccgtgtacgcgacgtccctgtacggtactttccgttaacgtttagttagtttagttggtatggtacggtcggtcggggtacccgacgtaccggtaccggtaccgggagggggtacgggtccgtagggtacggttccggacggaaccaaacgtaaacctaaaccggaaagtaaggtaagggtaaaagtaaaacgtaaaacttggtaggtaacgtactacggtaggtaacgggtaaccggtactaacgttaccaccctagttccaaccgaaggaaccgaacgaaacccgtaacaaaggtaacgttaccacgtttanaccgtaggtaagaacttaaacggacgaaacgcgttaacgggcgaaagggaccccggaggaacggtaaacccggtccgtaaagttttacgtaaccgtacggttaccgggagtacccgggtaataaccggtacggttaaccttaaccgggtttccccttaaagtaccccggtttttaaccggttcgtttagaccccgttcccggggg

SEQ ID NO: 45686 - DNA, 644 bp, Homo sapiens
  misc_feature: GYAE6OF01AZABE.27.57.F02.1.454.CMB.1.raw
  modified_base (330)..(330): a, c, t, g, unknown or other
  misc_feature (330)..(330): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcgttgggttttccttgttgcttattttagaaggtgtccagtgtgaggtgcaacgtgggtggattcgtgggaggaggtgtcggtccaggtccgtggagaactcccctggacgtactctccgtgtcgcagcctctggacttctacctttagtagttattggatgacgtcgtcggggtcccnccgaggcctccggaggggaggggtctagggtagttcggtggaccaagtaactaaaccgaagtagtagggaaaggtaaaacgaaaactgtagtacggtactcgtaggtacggaacgggcctattccacctagtcctaccagacgaaccaacggaccaaagtacgtcacgttgtactctagaactaagtcgaactacgcctaggacgtacggccgaaggacgacggtctaggattaccgtacggtgtacggacggaagtaggtacccttacggtacgtaccgttacgtttaccggttacttttggacgtttcccgg

SEQ ID NO: 45687 - DNA, 708 bp, Homo sapiens
  misc_feature: GYAE6OF01EL8LA.27.57.F02.1.454.CMB.1.raw
  modified_base (611)..(611): a, c, t, g, unknown or other
  misc_feature (611)..(611): n is a, c, g, or t
  modified_base (617)..(617): a, c, t, g, unknown or other
  misc_feature (617)..(617): n is a, c, g, or t
  modified_base (662)..(662): a, c, t, g, unknown or other
  misc_feature (662)..(662): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtgattcgtgggaggaggtgtggtccacggcctggaacgaacttccctaggacgtaccttcctccgtggtcgccacggtcccttcgtcggactttccgttaaccgttttaagttagttttaagtttcggaagttggtacggtcgttacgggggtccccacgtaacggtaccgtcccggaagggggaacgggggtcttaggggtaacgtttccgggtacgggaccccaaaacgtaaacgtaaaacccaaagggagttaacggggaaaagggttaaaaaacgtaaaaacgttagttacgggtaacggtaacttcggtgggttaacggaacgggtacctacgttaccaccgtactacctacgaagtaacgaacctaacgaacaaagaactcactgtaatctagactaanagaacngaccgtagacgtacgacgaagcgacgtctagtactacgtacgtgngagagtacgacgttactagtcctacgttcttacgtttgacttccgg

SEQ ID NO: 45688 - DNA, 840 bp, Homo sapiens
  misc_feature: GYAE6OF01DKD0H.27.57.F02.1.454.CMB.1.raw
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtggggctgagtcgttggggtttttccttggttgtcttagtttttaaggaaggttgtcctaggtgtggaggtgctaacgtggtggtattcgtgggagggtaggtgtcggtccagccgtaggacgtactcccgtgacgccttctcctgtcgcncgtccttgtggtacttacctaccgttttagtagtttagttaggactggagtcggtcgggtcccncgaaggcctccgggaaggggtagggtcgttagggtacgttcgggtaccggaacctaaaaccgtaaacgtaaaaccgtaaggtaacggtaaaggggtaaaacgggttaaaaaacgtaaaacgttagtacgggttacggtaccgttacggttacgggtaaaggggaaccgggtcccgtaacgttacccgtaacccgtaccgttacccgtaaccggaaacggtaaccgaaaacccgtaaacccggaaccgtaaacgggtaaccgttaaccgtaaccgttaggtttactaccggttaaccgaaacgttaaacgaacggtaaacgtaccggtaccgtacgggaaccgggtaacggacccgggtaacggacccggtaccggtacgttaccgttaacgtaccggtaacgtagggtaccgtaggaacggtacgtaccttaccggtaacgttcgttacccgttaccgtttaccgtttcgtcgtttcccgggg

SEQ ID NO: 45689 - DNA, 882 bp, Homo sapiens
  misc_feature: GYAE6OF01C0NYK.27.57.F02.1.454.CMB.1.raw
  modified_base (183)..(183): a, c, t, g, unknown or other
  misc_feature (183)..(183): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaacgtggggctgagcttgggttttccttgttgcttattttagaggtntccagtgtgaggtgcaacgtggtggattcgtgggaggaggtgtcggtccagccgtggagaactccctaggacgtactcctacctgtacgcacgcctcgtggtacttcctacctttagtagttagttggatggagcggttcgggtcccgaccgtagacccgtaccggaagggggaacggggtccgttagggtaacggtttcggtcgggaacccaaaacctaacgtaaaaacccgaaggtaacgtaaggggtaaaacgggttaaaaacggtaaaaaccttaggttagggtaccggtaacgttaccgttagggtaacggggtaaaccggggtaccctaacgttttacccgaaacccgttacgttaccccgtaaccccgttaaagggaacccgtaaaccccgaaaacccgggtaacccgtaaaaacgggtaaccggttaacccgtaaacgtttttaaccgggttaaacctttcggtttaaaccgaaaccgttaaaacggttaccgaaaccgttaacggtacccggttaaagggaaccgggtaacggaaccccggggaacggttaaccggaacccgggtctttaaacgggtaaccttaaaccggttccgttagggtaccggacggtaacggtaaagtaccccgtttaacgttacggttacttaacccggttcccgttttacgtttaccggtatttaccccgggg

SEQ ID NO: 45690 - DNA, 575 bp, Homo sapiens
  misc_feature: GYAE6OF01DYAML.27.57.F02.1.454.CMB.1.raw
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctgggaggaggtgtggtccagcctggagaatccctgagacctctcctgtgcacgccttcgtggattcctacctttagtagttattggatgagctgggtccnccgagactccgaggggaagggctgggacgttgnggccaacataaaccaagatagggaagtaaaagaaactatgtaggactcgtgtaggaaagggtccgtattcaaccctatcctactaagacgaacaaccgacaaagaacgtacactagtatcgtgaacaatagaacaacgtccgtagaagacggaccgaggacacggctagtaatactatggtcggagaggagtacctacgtacgttcaacgttcccgttacttttgattaccgg

SEQ ID NO: 45691 - DNA, 815 bp, Homo sapiens
  misc_feature: GYAE6OF01CI86L.27.57.F02.1.454.CMB.1.raw
  modified_base (183)..(183): a, c, t, g, unknown or other
  misc_feature (183)..(183): n is a, c, g, or t
  modified_base (600)..(600): a, c, t, g, unknown or other
  misc_feature (600)..(600): n is a, c, g, or t
  modified_base (708)..(708): a, c, t, g, unknown or other
  misc_feature (708)..(708): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacagtggaactgggctgagcttgggttttccttgttgcttattttagaggtntccagtgtgaggtgacacgtggtggattcgtagggagtaggtgtcggtcagcgtaggataactcctagacgtacctctcctaggtcgctacggtcccttacgtaggttacttaccctttaacgtttaggtttaagtttaggttaggtactaggacgttccgggttacggggtccccacgaacggtaccgtaccgggaaggggtaacgggtcgttagggttaacggttcgggacgaaccccgaaataaacgtaaaaccgaagtaagtaagggtaaaaacggttaaaactaaagtgttacgggtacgttacgttacggtaagggtaacgggaaccgggtactaaccgtttccgaaccgttactacgtacccgaaaggaccgtaaacccgtaaccggaacgttaaaaggacccgtttaanaccgtttaacgttctaaccgtaacgaacgtaaacgttaaccggaaccgtaacgtacccggttagggaacgtacccgggtaacggaaccggttaaccgaacccggtttnttaaaccggtaccttacgtacggttacggacgtaacgaagttacccggtaaacttgttacccggtttactacccggtttaccgttaagtttccgtaaacggttccgg

SEQ ID NO: 45692 - DNA, 799 bp, Homo sapiens
  misc_feature: GYAE6OF01DRMEO.27.57.F02.1.454.CMB.1.raw
tcagagcgtcgtctcacgaccggtgctcgatttagctcgatatagttgggtttgaggtctcagagaggagccttagccctggactccaaaggcctttccacttggtgatcagcacggagcacagaggacccaccatggaactggggctgagctgggttttccttgttgctattttagaaggtgtccagtgtgaggtgcaacgtggtggattcgtgggaggaggtgtggtccaggcctaggagaactccctgacgactctcctgtgcagcctcgtggtacttctacctttagtagttatggatgagcgtcgggtccgccagaccgtccgagggggaaggggtctagggtacgttcggcggacccaaactaaactaaaccgaaaggtagtaaggggaaaggttaaaaacgaaaactttagttagggtacggtactcggttaggtacggaaaaccggggtcccgtaagtttacccaacccgtaacttaccccgtaacccgaaggaaaccggaaacccgtaaaaccggaacccgtaaaaggaacgttaccctaacgttaggttaacctcgttaacgtaactaaacgtacgaaaccgtcgtaacccgtagggaaacgggaccggaacccggggtaaaccggaacccggtacgggttaccgttaacgtaaacgttaaacccgttaaccggttagggtaccggtaaacggggaaggtaaaccggtaacccctttcccggttaacggttaccctttaacccggttttcccggtttaccccgtttttagcccggtttttaaccccggg

SEQ ID NO: 45693 - DNA, 749 bp, Homo sapiens
  misc_feature: GYAE6OF01CQFL3.27.57.F02.1.454.CMB.1.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacagtggaacgtgggctgagcgttgggttttcctgttgctattttagagtgtcagtgtgagtgacacgtggtgattcgngggaggaggtgtcgtccgagccgtagganaactccgtagacgtctcgtcgtgtcgcacgtccttgtgtattccttacgtttagtagttagtgaatcgacgtcggtacggtccacgtacgaccgtcggaaaggggtacggtcgtaggtacggttaccggtacgaaacctaaacgtaaacgttaaaaccggaaaggtaacgtaaaggggtaaagtaaaaacgaaacgtttcggtaggtaacgacgttagtagggtaacggaacggtacctattaccaacgtctacgaccgtaaagacgaaaccccgaaagaccgtaaagtaccgtacctaacgttaggtaccctgtaacggtaaacctaaagttaacccggaaccgttcgggtaaccgtagggaaaccgggtacccgaaacgggaaccgttcgacccggtttagtaacgtaaacccggttcgttacggtcggaacgggaagttaagacccgtttacgtccgttaaggttccctacgggttttacccgttgttaacggcgtttaacccgggg

SEQ ID NO: 45694 - DNA, 814 bp, Homo sapiens
  misc_feature: GYAE6OF01CD2DH.27.57.F02.1.454.CMB.1.raw
  modified_base (238)..(238): a, c, t, g, unknown or other
  misc_feature (238)..(238): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggttttccttgttgcttattttagaaggtgtccagtgtgaggtgcaacgtggtgattcgtgggaggaggtgtggtccagcctgganaactccctgagactctccgtgtcgctagcccttcgtggtacttaccgtaccgtttttaagtaagtttagttggtatggacgtcgtcgggtcccgactaacggacctaccggaagggggaacggggtcgtagggtaacggtttccggtacgggaacccaaaacgtaaacgtaaaaacccgaaggtaacgttaaggggtaaaagggtaaaaaacgaaaaacgtttagtagggtacggtaactacgttaggtaggtaaaccgggacccgttagttacccaaccgtactaccgtaccgtaacgacggaaaccgaaaccgaccgaaaacgtaaggtacctaacgttagtaacgttcaacggtaacgtaaagtacgaaccgaagtcccggttaagggaaaccggtaccgggaccgggaaacgggaaccgtaccgggtaccgtttaaggttaaaacccgttaccgttaccgttacgggtaccgggaacgggaacggttaaacggttaacccgtttaccgttaaacgtttacccgttaacggttttaccccggtttacgttttttcggaaaccgttttcccggg

SEQ ID NO: 45695 - DNA, 755 bp, Homo sapiens
  misc_feature: GYAE6OF01AXE5V.27.57.F02.1.454.CMB.1.raw
  modified_base (205)..(205): a, c, t, g, unknown or other
  misc_feature (205)..(205): n is a, c, g, or t
tcagagcgtcgtctcacgaccggtgctcgatttagctcgatatagttgggtttgaggtctcagagaggagccttagccctggaacctccaaggcctttccacttggtgatcagcacggagcacagaggacccaccatggaactgggctgagctggtttctgtgctatttagagtgtccagtgtgaggtgcaacgtggtgattcgnggaggaggtgtggtccagtccgtaggagaactcccgtgacgacctctccgtgtcgactacgtccctgtggtacttccgtaccgtttagtacgtttatggatgacgtcgtcggggtcccaccgagtaccgtccggaagggggagggtctggggtacgtttccgggtacggaaccctaaactaacgtaaaacccgaaggtagttaacggggtaaacggttaaaaactaaaaccgttgttacggtacggacttcggtagtacggaacgggccttacgttaccaccgtacttacccgaaccgtaaggaaccgaaccgtaaaccggtcctaaaaagggtaccgttaccgtaacgtttaggaacctttccggtaaggaaaccttaagtaccgaaaccgtaccggtaccgtaacgggtaacggacccggttaacgggaaccggtaaccggtaccgggtacttacggtaaaccttaccgtacggttaggccgacgggtataacggacccgttacgtacggtcctttacgttccccgttagttttcgccgtttaccggg

SEQ ID NO: 45696 - DNA, 604 bp, Homo sapiens
  misc_feature: GYAE6OF01CXE5P.27.57.F02.1.454.CMB.1.raw
  modified_base (176)..(176): a, c, t, g, unknown or other
  misc_feature (176)..(176): n is a, c, g, or t
  modified_base (179)..(179): a, c, t, g, unknown or other
  misc_feature (179)..(179): n is a, c, g, or t
  modified_base (254)..(254): a, c, t, g, unknown or other
  misc_feature (254)..(254): n is a, c, g, or t
  modified_base (404)..(404): a, c, t, g, unknown or other
  misc_feature (404)..(404): n is a, c, g, or t
  modified_base (478)..(478): a, c, t, g, unknown or other
  misc_feature (478)..(478): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttcctgtgctatttagaggtntcngtgtgaggtgcaacgtggtggattcgtgggaggtaggtgtggtccagcctggagaatccctgagactcctcctgngcagcctctgtattcctactttagttagttatttggactgagcgtcgggtccgacagactccggaaggggaggggcgtaggtaggttcgtggaccaacaataaaccaagagttaggaggtaaaagaaaactagtggtagtactgttaggnggaagggccgattcaacactcgtaccaagagaaccaacgaccaaagggaactcacgtgttactactacggtaanaaacgttagaaccctaagtccgaggaacggacggacgaacgggaccacggccgttaggtactacgtacgacggtggaggacaaagttcctaacgtaccgttgttaccttccgtttctttgcgtacg

SEQ ID NO: 45697 - DNA, 749 bp, Homo sapiens
  misc_feature: GYAE6OF01EB9L6.27.57.F02.1.454.CMB.1.raw
  modified_base (737)..(737): a, c, t, g, unknown or other
  misc_feature (737)..(737): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcttgggttttccttgttgcttattttagaggtgtcagtgtgaggtgcaagtggtggattcgtgggaggaggtgtggtccagtccgtggagaactcccgtgacgtacctctcctgtgcagccctcgtggtacttcctacgtttagtagttagtggtatgagtccgtgggtcccgaccgagtaccgtaccggaaggggacggggcttagggtacgttcggtcggaaccaaacaactaaaaccgaagtagtaagggtaaaggtaaaacgaaaacgttagtaggtacggtaacttacgtaagtacggtaaacgggtaccgtaacttaccaacctacgttacccgtaaccgaaggtaaacccgaaaccctaaaccggaacccgtaaaagggtaaccgttaccctaacgttaccggttaacttccgtagaaaccgttaaagtaccgggaaacctacggtacccgtagggaacggaccggaccgggaacggaccgaccggtatagttaaacttcccgtagttcgggtagaccggtaagtaacggtacttacccggttaagttacccgttaccgtttcccgtttacgttttcgngtttaccccggg

SEQ ID NO: 45698 - DNA, 603 bp, Homo sapiens
  misc_feature: GYAE6OF01EZFQ2.27.57.F02.1.454.CMB.1.raw
  modified_base (261)..(261): a, c, t, g, unknown or other
  misc_feature (261)..(261): n is a, c, g, or t
  modified_base (594)..(594): a, c, t, g, unknown or other
  misc_feature (594)..(594): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaatccctgagactctcctgtgcancctctggattcacctttagagttattggattgagtcgtggggtcccgaccaggacctccggaaggggtaacggggctgggaggtttcggtaggacccaaagaactaaaccgaagattagggaaaggtaaaagaaaactagtgtacggacttcgtggtagaacgggcctattaccacatctacgagtagaccaacgccaaagaacgtcacgtcgtatactagacaatacgaacacgacgtagacgacgtaccgagggaccgacggcgtagtacttaacgtacgtcggtcgaggacgtagacgtacctacgtacgtaccttaggtcccttttagngttacccgg

SEQ ID NO: 45699 - DNA, 961 bp, Homo sapiens
  misc_feature: GYAE6OF01DDWGN.27.57.F02.1.454.CMB.1.raw
  modified_base (61)..(61): a, c, t, g, unknown or other
  misc_feature (61)..(61): n is a, c, g, or t
  modified_base (215)..(215): a, c, t, g, unknown or other
  misc_feature (215)..(215): n is a, c, g, or t
  modified_base (917)..(917): a, c, t, g, unknown or other
  misc_feature (917)..(917): n is a, c, g, or t
tcagagcgtcgtctcacgaccggtgctcgatttagctcgatatagttgggtttgaggtctnagagaggagccttagccctggactccaaggcctttccacttggtgatcagcacggagcacagaggacccacagtggaacgtgggctgagcttgggtttttccttgttgcttattttagaaggtgtcagtgtgaggtgacacgtggtgtattcgnggaggtaggtgtcggtaccaggccgtaggagtaactccgtaggacgactcctcgttgacgccgtacgtccgttcgtacggttactttaccgttaaccgtttttaagggtttaacgttttaagttaggtagttacgggtaacggtccgggttccggggttaccccgaaccggtaacggtaaccccggtaccggggtaaaaggggggaaccggggtacgggttacggggttaccgggtttcccggggttacggaaaaccccgtaaaaacgtaaaaaccgttaaaaccggtaaaaggttaaacgggtaaaacgggggttaaaaacggtaaaaaaacgttaaaaccgtttaaggttacggggttaacggtaaccgtttacggtttaaggggaaacggggtaaaccgggttaccgttaaaccgtttacctaaaccccgttacgttaccctaaccggtaaaggaaaccgtaaaaccccggaaaccggtaaacccgtaaaaagggttaccgtaaccttaacgggtttacgtttaaaccgttaccggtaaccgggttaaactaaaggtaacccgtaaacgacccggttaccggttaacgggaaaccgggtacgggaaccccggtaaacgggaccgtacggtaaccgttaacgttaacgttaacccgtaggtacggtacggaacggtaacgaacgtttcctaacccggttnttaaccgtttcgtttaccgtttacgtttcggtcctttaccgggg

SEQ ID NO: 45700 - DNA, 782 bp, Homo sapiens
  misc_feature: GYAE6OF01DF6SD.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaacgtggtggattcgtgggaggaggtgtggtccagcctggagaactccctgagtactcctcctgtgcacgccttcgtggtacttctaacctttagtagttattggatgagtcgtcggtccgcgagaccgtccggaaggggagggctagggtagttcggtacgaccaactaacgtaaaccgaaggtaacgtaagggaaaggtaaaaacgaaaacgttagtggtaggtaaccttacgtgggtaacggaacgggtcctaacgtttacccgaacctacttccccgtaacgaaggaaacgtaaacccgaaaccggacccgtaaaaaggtaccgttaaccctaacgtttacggttaactccgttaacggaaacctaaaaacgtcggtaaaaccgccggttacccgttaagggaaaccgggtaacccgggaacccggggaagaacccgggtaacggtccgttaaacggttaacttaacccggttaacgtcggggttaacggaaccggtaaggaaacgttaccgttaccccgttaaggttacccttaacggtttttacccccggtttacgttttaggaccttttaccccggggg

SEQ ID NO: 45701 - DNA, 898 bp, Homo sapiens
  misc_feature: GYAE6OF01D1OMK.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccagtgggaacgtggggctggagtcgttcgggttttccttgttgtacttagttttaaggaaggttcgtccgtagtggtggaggtcgacgtaacgtgggtggtagttcggtagggagggtagggttggtcggtaccgacggtccggttaggaacgtaacctcccggtaggtaccgtaccttccgttccgttggtccgccgtacgtccgtcggtaggttacctttaccgtttaacggttttaaggttaagtttaggttaggtaacgtggtacggtccgggttccgggaccccggtaccgaccggtaccggtaaccggggtaacgggggtacggggtcggttacggggttacggtttacccgggtacgtaaaccccgtaaaacggtaaaccgtaaaaaccggtaaaggtaagggtaaaacggggtaaaaacggtaaaaacggtaaacgtttaggtaacggttacggtaacgttcggtagggtaacggtacggtaccttactaacccgataccttaccgaacgaagtaaacgaaccgaccgaacgaaaggttcctacgttagtgtaactcgaacgtaaacaagtaccgactcgtaacggacgaacgggtaacggacccgggtaagtacccgtcgggtttaacaaggttttaaaccgtccggtaagggtcggtaaacgggtacggtaaaccttaagttacccccgtttagttaacccctttaaccggttccgttttaccgggtttaatttcccgggcccgttaaacggggg

SEQ ID NO: 45702 - DNA, 709 bp, Homo sapiens
  misc_feature: GYAE6OF01EZ4RD.27.57.F02.1.454.CMB.1.raw
  modified_base (572)..(572): a, c, t, g, unknown or other
  misc_feature (572)..(572): n is a, c, g, or t
tcagagcgtcgtctcacgaccggtgctcgatttagctcgatatagttgggtttgaggtctcagagaggagccttagccctggactccaaggcctttccacttggtgatcagcacggagtcacagaggacccaccatggaactggggctgagcttgggttttccttgttgctattttagaaggtgtccagtgtgaggtgcaacgtggtggattcgtgggaggaggtgtggtccagcctggagaactccctgagtactctcctgtgcagtcctcgtggtattcctacctttagtagtttagttggatggagtcgtcggggtcccgccgaggtacctccggaagggggaacggggtcgtagggtaggttccggtcggtaccaaactaactaaaaccgaaagagtagggaaaggttaaaagtaaaactagtggtacggtacttcgtaggtacggaacggggtcctaagtttacccaaccgtaacttccctaccgaaggtaaccgaaaccgaaaccgaccgaaaggtaacgtacctacgttacgttactacgtagtaaacctaaagtaccggaaacncggtacccgtaggaacgggaccggacccgggtaaggaaccgaccgggttctagtaaccttaacgtacgtggtacgaggacggtagtaccttaccgttagtacctttacgtttcccggttcttttagcgtttacccgg

SEQ ID NO: 45703 - DNA, 705 bp, Homo sapiens
  misc_feature: GYAE6OF01CLEY2.27.57.F02.1.454.CMB.1.raw
  modified_base (652)..(652): a, c, t, g, unknown or other
  misc_feature (652)..(652): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttccttgttgcttagtttagaaggtgtccagtgtgaggtgcaacgtggtggattcgtgggagggaggtggtggtaccgagccgtaggacgaactcccgtagacgtaccttcctcccgtggtcgcacgtcccttcgtggtacttccttaaccgttttagttagtttagttggaatggagtcggtcgggtcccgaccaggtacccgtccgaagggggtacgggtctagggtacgttcggcggaaccaaacaactaaaccgagaagtaagggaaaggtaaaacaaagtagtaggtacgtacgtgtaggtaggacggcctagttacccaccgtactccgtaaccgaaggaaccgaacctaacggacccgaaaggtaaccgttccgtaaacttgggtaaaccctgtaacgaacctaaagtaccggaacgtaccgtacccggtaaggacgggacgaaccgggaacgggaacccgtacggtacttaggtaacctacgttcgnggtacgacgagtacgtctacgttactcgttacgtttcctgtttgcgttccggg

SEQ ID NO: 45704 - DNA, 630 bp, Homo sapiens
  misc_feature: GYAE6OF01A0YAU.27.57.F02.1.454.CMB.1.raw
  modified_base (313)..(313): a, c, t, g, unknown or other
  misc_feature (313)..(313): n is a, c, g, or t
  modified_base (617)..(617): a, c, t, g, unknown or other
  misc_feature (617)..(617): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtgggaggaggtgtggtccagcctggagaatccctgagacctctcctgtcgcagcctcgtggacttctacctttagtagttattggatggagcgtgggtcccncgacgactccgaggggaaggggtcgtagggagttcggtacggaccaacaactaaaccgaagagtaggaaggtaaaagaaaactagtagtaggtactcgtaggtaggaacggggccgtattccgacctacgttacctaccgaaggacgaaccgaacgaccgaaagaacgtcaacgtgttactacagtaacaagtacgaacacgaccgtaggaacggacgaccgggaacggaccgacggtacttaggtacttaaccgtacgtggtcggagtaacggatacgtaccgttagtcttacgttcccgttnttttcgtcttcgg

SEQ ID NO: 45705 - DNA, 612 bp, Homo sapiens
  misc_feature: GYAE6OF01BFITG.27.57.F02.1.454.CMB.1.raw
  modified_base (314)..(314): a, c, t, g, unknown or other
  misc_feature (314)..(314): n is a, c, g, or t
  modified_base (565)..(565): a, c, t, g, unknown or other
  misc_feature (565)..(565): n is a, c, g, or t
tcagagcgtcgtctcacgaccggtgctcgatttagctcgatatagttgggtttgaggtctcagagaggagccttagccctggactccaaggcctttccacttgtgatcagcacggagcacagaggacccaccatggaactggggctgagctgggttttccttgttgctattttagaaggtgtccagtgtgaggtgcaactggtggattcgtggaggaggtgtggtccagcctggagaatccctgagactctcctgtgcagcctcgtggtactttcctacctttaagtagtttattggatgagcgttcgggcccnccgagacctccgaaggggacgggtcgtgggtaggttcgacggacccaaacgtaacgtaaaccgaagtacgtaagggaaacggtaaaagaaaacgttatagggtacgtacgtacgtaggaggtaacggccgtattaccacctataccgaccgaaggacgaaccaacggaccaaagacgtactacgtgtatacagacaaatcgaactcgcaggagacgacggacgacgacgtctagtactacgtagtggcganaggacacttaccgtcgtactacccgtttaccttctttagcgttacgg

SEQ ID NO: 45706 - DNA, 668 bp, Homo sapiens
  misc_feature: GYAE6OF01BOPE4.27.57.F02.1.454.CMB.1.raw
  modified_base (548)..(548): a, c, t, g, unknown or other
  misc_feature (548)..(548): n is a, c, g, or t
  modified_base (568)..(568): a, c, t, g, unknown or other
  misc_feature (568)..(568): n is a, c, g, or t
  modified_base (654)..(654): a, c, t, g, unknown or other
  misc_feature (654)..(654): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccagtggaactggggctgagcgttgggttttccttgttgcttattttagaaggtgtcctagtgtggacggcgacaacgtggtggacttcgtggggaggacggttggtcggtacccgacgtccgtggaacgtaacttcccgtgacgtaccttcctccgtggtcgcctacggtccttcgtacggtactttccttaaccgttttaagttacgttttagtagggtatggtacggtcgttaccgggtcccgacgacggtcccgtacgggaggggacggtgtggtagttcggcgtacaacaacgtaacagagtaggaaacgtaaagtaaactgtgtacggtactgtaggaaggtaccggtacctattaccgactacgtccgaacgtaacgacgaaaccgaacgtacaacggtaactctacgtntaactgaaccgaataacgtntaacgcgtacgtacgagtacgacgtagaacgcgtagtactactgacgttggactaggacttcgctacgtcttacgtcgttaccgtnttcgtcgttaccgg

SEQ ID NO: 45707 - DNA, 873 bp, Homo sapiens
  misc_feature: GYAE6OF01B2IJ3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaactgggtggattcgtgggaggaggtgtggtccaggcctgggagaactccctgacgactctcctgtcgcagcctctgtacttcctacgtttagtagttagttggactggacgtcgtacgggggtcccgacctaggaccgtccgggaaggggggtaacggggtccttaggggtacggtttccgggtacggacccctaaaacgtaaactaaaaaccggaaagtaggtaacgggaaaagggtaaaaaccgtaaaaacgttgtaagggtcggtaacctcggttaggtaacgggaacggggtccctaacgttcccgaacctagttaccccgtaaccgaaacgggaacgaaaccccgtaaaaccggaccggtaaaaaaggtaaccgttaccctacggttttaaggtaaccttacgttaacggaaacgtaaaactccggggtaaaaccaccgggtacccgttaacgggaacgggtaacccgggaaccggggtaaacgggaaccccgggtaacgggttacccgtttaacggttaaaccgtttaaaccccgtttaacgggacggtttacgggaaaaccggggaggttaaaacccggttaccctttaacccggttacggtttaaccctttacccgggtttttaaccccggttttcgtttttaaccggaaccggttttccccgggg

SEQ ID NO: 45708 - DNA, 866 bp, Homo sapiens
  misc_feature: GYAE6OF01BYNEH.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctagttttagaaggtgtccagtgtgaggtgcaactggtggattctggaggaggtgtggtccagcctggagaactcccgtgagtacctctcctgtgcagcctgtggtattcctactttagtagtttagttggagtgagtcgtcggggtcccgaccaggtaccgtccggaaggggtaaggggcgtaggggtacgtttcgggtacggaacccaaactaaaccgtaaaaccgaaaggtaacgttaaggggaaaacgggttaaaaaagtaaaacgttaggttacgggttacggggtaacttccggttagggtaaggggtaaaccggggtacccggttaacttttacccgaacccgttaacgttacccgttaaccgaaacgggtaaacggaaaaccccgaaacccgggtaaacccgaaaaacggggtaaaccgtttaccgtaaaccggttttacgttaaacgttacccgggtaacgtaaacccgtaaaaagttccggaaaccgtaaccggtacccttaacgggaacgggtaccggacccggggaaacgggaaccggtaccgggtacggttaaccggtaacgtttaaacccttaccgggttaggtacgggtacgggaaagggtaaccgtaacgttaccccgtttaaacgtttacccgtttacggttttaccccggttacgttttttacgaaccgggttttacccgg

SEQ ID NO: 45709 - DNA, 971 bp, Homo sapiens
  misc_feature: GYAE6OF01A0TRR.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttattttagaggtgtccagtgtgaggtgcaacgtggtggattcgtggggaggaggttggtcggtccaggtccgtaggaacgaacttccccgtaggacgtaccttcctcccgttggtcgacctacggtcccttcgttacggtactttaccgttaaccgttttttaaggttaaggttttacgttagggtaattagggtacggtccgggttcgggggtacccccgtacccgtaacggtaacccggttaccccggggaaagggggggtaaccgggggtccgttagggggttaaccggttttaccggggtaccggggtaaaccccctaaaaacggtaaaaccgttaaaaaccccggaaaggtaaggttaaacgggggtaaaaaacgggttaaaaaacggtaaaaaaccgtttaggttacgggttaacggtaacccggtttacgggttaagggtaacggggtaaacggggtaccctaacgttttaacccggaacccttacgttaccccgttaacggaacggtaaaccgaaccgaaaacccggaccgaaaaggtaacccgtcctaaacggtttcctaaacgttacgtaaccggtaaacttaaacgtacgggaaaccctacgggtaccgtaacggtaaacgggaccgggaaccgggtaaccgggaaccgtaccgggtccgttaaacgttaaccggtaacctttaccgggtacgggtcggtaaacggtacggttacttaacccgttacggttacctttacccgttaaacgttttcccggttttacgttttaacggacccgttttcccggggg

SEQ ID NO: 45710 - DNA, 613 bp, Homo sapiens
  misc_feature: GYAE6OF01BLO3A.27.57.F02.1.454.CMB.1.raw
  modified_base (308)..(308): a, c, t, g, unknown or other
  misc_feature (308)..(308): n is a, c, g, or t
  modified_base (599)..(599): a, c, t, g, unknown or other
  misc_feature (599)..(599): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttctgttgctatttagaagtgtccagtgtgaggtgcaacgtggtggattcgtgggaggaggtgtgggtccaggcctaggagaatccctgagactctcctgtgcagcctctggtattcacctttagtagttattggatggagcgtgggtcccnccagacctccgagggaaggggctggagttcgtggaccaacgaactaaaaccgaagacgtagggaagggtaaaagaaaacgtataggtggtactacgtggtaggaacgggccgacttaccaaccgacttctacccaggacgaacaacgaccaaaggaacgtcaactgtatcctaggacaaataggaacagaccgtagaacggagacccggaaaggaaccaccggtacgtgttaacgtacttacgtgtcggaccggaggacgtaactcccgtaagttccagttttaccccgtnttttagcgttaccg

SEQ ID NO: 45711 - DNA, 568 bp, Homo sapiens
  misc_feature: GYAE6OF01EOAVG.27.57.F02.1.454.CMB.1.raw
  modified_base (253)..(253): a, c, t, g, unknown or other
  misc_feature (253)..(253): n is a, c, g, or t
  modified_base (306)..(306): a, c, t, g, unknown or other
  misc_feature (306)..(306): n is a, c, g, or t
  modified_base (346)..(346): a, c, t, g, unknown or other
  misc_feature (346)..(346): n is a, c, g, or t
  modified_base (531)..(531): a, c, t, g, unknown or other
  misc_feature (531)..(531): n is a, c, g, or t
  modified_base (541)..(541): a, c, t, g, unknown or other
  misc_feature (541)..(541): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcttgttgctattttagaaggtgtccagtgtgaggtgcaactggtggattcgtggaggaggtgtggtccagcctggagaatccctgagactctcngtgcagcctctggattcaccttttagtagttattggatgacgctggggtcccncagactccgaggggaaggggctgggagttcgtggcccaanataaaaccgaagataggaaggtaaaacgaaaactatggtaggacttcgtaggttggaaacgggcccgtaattccacccgtaatctacccgaagacgaacaaaccggacccaaggaaagccacctgtactactgacaaatgaaacagacctgaagagccgaaggaccgacggctgtactacctacngtgagagagntacctgtctacttcgtcttttgattcg

SEQ ID NO: 45712 - DNA, 822 bp, Homo sapiens
  misc_feature: GYAE6OF01BKNLA.27.57.F02.1.454.CMB.1.raw
  modified_base (212)..(212): a, c, t, g, unknown or other
  misc_feature (212)..(212): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaacgtgggctgagcttgggttttccttgttgcttagttttggaaggtgtcagtgtgaggtgcacgtggtgattcgnggaggaggtgtcggtccaggcctggacaactccctagacgctcctcgtgtcgcacgtcctgtggtacttcctaaccgtttagtagttatggtaactggacggtcgtacgggtcccacgacgtaccggtaccggaagggggtaacgggtcgttagggtacggttacggcggtaacccaaacgtaaaccgtaaaaccgaaggtaggtaaagggtaaaagggtaaaaacgtaaaagttcggtaaggttcggtaacccgtttgggtaacgggtaaacggggtaaaccggggccctttaacgttaacccgtaaccgtaaccgttacccgtaacccggaaacggaaaccgtaaacccgaaaacccgtaaccgtaaaaacggtaaccgttaaccgtaacgttacgttacgtaccgtaagtaaactaaacgacggtaaaccgtcgaccgttaaggaccggtaaccggaccgggtaacgggaaccgtacggtcgttaaacgtacgtttaacccgttaacggtcgggtacggtaaggtacggtaaacccgtacggttaaccgtaaccgttccgtttaaccggtttacccgtttaacggtttccgttacggttaacccggg

SEQ ID NO: 45713 - DNA, 806 bp, Homo sapiens
  misc_feature: GYAE6OF01E3D87.27.57.F02.1.454.CMB.1.raw
  modified_base (181)..(181): a, c, t, g, unknown or other
  misc_feature (181)..(181): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacagtggaactgggctgagtcttgggttttccttgtgcttatttagagtntccagtgtgaggtgcaacgtggtgattcgtgggaggtaggtgtcggtccagtccgtaggacgtaactcccgtagacgtccttcctcctggtcgcacgtcctcgtcggttacttaccttacgtttagtacgtttattggatgtacggtcgtccggtaccacgtacggacgtacgggaagggggtacgggtcttacgggtacgttccggtaaccggaacctaaaacctaaaacgtaaaaccggtaaaggtaaacggttaaaggggtaaaaacggttaaaaagtaaaaccgtttcggtaacgggttaaccggtacgttccggtaaggggtaccggtaaaccggggtacctaaccgttaccctaacccgtacgtttacccgaaccgaaacggaaaccgtaaaccccgaaacgtaacccgaaagttaaaccctaccgtaaccgttagtaaccgtacgttaaacgaaaccgttaaacgacgaaccggttcgaaaccgaggaacccgggtacgaaccgggacgtaccggtacggttatacgtttaaaccgaacgtccggtcgaacggtaccgaaagtaccttcctttaagtccgttaacttacgtttccgtttatttaacgcggttaccggg

SEQ ID NO: 45714 - DNA, 711 bp, Homo sapiens
  misc_feature: GYAE6OF01B06R6.27.57.F02.1.454.CMB.1.raw
  modified_base (586)..(586): a, c, t, g, unknown or other
  misc_feature (586)..(586): n is a, c, g, or t
  modified_base (606)..(606): a, c, t, g, unknown or other
  misc_feature (606)..(606): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaacgtggggctgagcgttgggttttccttgttgcttattttagaagtgtccagtgtgaggtgcacgtggtggtattcgtgggaggaggtggtcggtccagtccgtaggaacgtaactccccgtgacgtaccttcctccgtggtcgccgtacgtccttacgtaggttacctttaccttaaccgttttaaggttacgtttagttcggtagtggtacgtcggtccggggtcccacgaccgtaccggtcgggtaaggggacgggtcgtagggtacggttcggacggaaccaaaacgtaactaaaaccggaggtaaggtaagggtaaaacggtaaaaacgtaaactaggtaggtacggtacttcggtagggtaaggaaccgggtctaacgttacccaacttcacctacgaagaacgaacccgaacgaacgaaagtacctctaacgtgtactacgngaaactaagacaacgaccgngtaggaacggacgacggaacggacgacggtcttagtaactacgtcgtaggtcaggagacgtccttaccgtgttacctaccgtttaccgttgtttccgtcgttcgg

SEQ ID NO: 45715 - DNA, 739 bp, Homo sapiens
  misc_feature: GYAE6OF01DONEP.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagtcttgggttttccttgttgtcttattttagaggtgtccagtgtgaggtgacaacgtggtgattcgtgggaggaggtgtcggtccagccgtaggaacgaactccccgtagacgtactcctccgtgtacgcagtccttcgtaggtacttacctaacctttagtagtttagtggtaatggacgtccgtcgggtcccgactacggaccgtaccgggagggggaagggtctagggtagtccggtacgaaccaaagtaaactaaaaccgaaggtacgtaagggtaaaagtaaaacgtaaatagtggtagaacctcggtaggtacgggaacggtccgtaattcccgaactacgtcccgtaacgaaggaaacccgtaaccgaaaccggaaccgtaaaaaggtcctaccgtcgttacgtaacttcgaacgtaactaaaggacgaacacggtcctaagggaacgtcggaacccggaaggtacccggacggttattacggtaaacctaccgtgggttacggacgggtacggaataaccggtacgtttacccgtaagttcccgtttaacgtttccggtttaacttgtccggttacccggg

SEQ ID NO: 45716 - DNA, 645 bp, Homo sapiens
  misc_feature: GYAE6OF01EL6X4.27.57.F02.1.454.CMB.1.raw
  modified_base (318)..(318): a, c, t, g, unknown or other
  misc_feature (318)..(318): n is a, c, g, or t
  modified_base (521)..(521): a, c, t, g, unknown or other
  misc_feature (521)..(521): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaactggtggattcgtgggaggtaggtgtggtccagcctggagaactccctgagaccttctcctgtgcacgcctcgtggacttccgtacctttagtagttattggatgagcgtgggtccnccagctccgaaggggacgggctgggacgttcgtacggacccaaactaactaaaaccgaagtagtacgggaaaggtaaaacaaaactagtggtacggtactcgtagtaggaacgggtcctattaccaacctactcctacgaagaacgaaccaaaccgaccaaaggtaacctcaacttagtaactcgtagaacaaagtcgaaacncgtacctaggacgaacggaccggaacggtaccgacggtacttaggtaacctacgtaacgtcggtacgacggaagacgtacttaccttacgttcctacgtttccgttacgttttgacgtttccgg

SEQ ID NO: 45717 - DNA, 695 bp, Homo sapiens
  misc_feature: GYAE6OF01BELY5.27.57.F02.1.454.CMB.1.raw
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtcagtgtgaggtgacaacgtggtggattcgtggaggaggtgtggtccagcctggagaactccctgagactctctgngcagcctntggattctactttagtagttatggatgacgcgtcgggtccaccgagaccgtacggaaggggaacgggtctagggtagttcggtacggacctaaacaactaaaaccgaagaagtagggaaaacggtaaaaagtaaaacgtagtacggtaggaacttcgtaggtaacggaaacgggtcctattacccgaacctacttacctaccgaaggaaccgaaccaaaccgaccaaaaggtaacgttaccaacgttacggtaacttacgtagaaacctaaagtacgaaaccgtagacccgtaggaacgaaccggaccggaagaaccgtacggcttaacgtaacttacgtaccgttaggtaccggaggaaggtactaaccgtttaccctaaggttaccctaacttttaccccgtatttttaccggaactttcccggg

SEQ ID NO: 45718 - DNA, 783 bp, Homo sapiens
  misc_feature: GYAE6OF01CWQKU.27.57.F02.1.454.CMB.1.raw
  modified_base (213)..(213): a, c, t, g, unknown or other
  misc_feature (213)..(213): n is a, c, g, or t
  modified_base (765)..(765): a, c, t, g, unknown or other
  misc_feature (765)..(765): n is a, c, g, or t
tcagagcgtcgtctcacgaccggtgctcgatttagctcgatatagttgggtttgaggtctcagagaggagccttagccctggactccaaggccctttccacttggtgatcagcacggagcacagacggacccaccatggaacgtgggctgagcttgggttttccttgttgcttatttagaagtgtcagtgtgaggtgcaacgtggtgattcgnggaggaggtgtcggtccagtccgtaggagaactcccgtagacgtacctcctcctggtcgcgacgtccttcgttaggtacttacccgtttaaccgtttttaaggttacggttttagtttaggtagttaggacggttccggttaccggggtaccccgcccgtaaggtaccccgtaccggggaaggggggtaaacggggtccggtttagggtaacgggtttccgggtaccggaaaccccgaaaaccgtaaaacgtaaaacccggaaggtaacggtaaacgggtaaaacgggtaaaaaacgtaaaacgtagtcgggtacggtaaccgttcgtaggtacggtaacgggtacccgtattacccacgtactccgtaccaaggaaccgaaccaaccgaaccgaaagtacgtaccaacgttagtactatacgaaactaagtacgaaccgtcgacgtaggaacggaccgaccgggaacggtcccaggtacttaggtaacctacgtacgtcggtcggaacggtagacgttacgtacccttacgtaccgttccgttaccggttntttaccggcgttaccggg

SEQ ID NO: 45719 - DNA, 908 bp, Homo sapiens
  misc_feature: GYAE6OF01CL5WI.27.57.F02.1.454.CMB.1.raw
  modified_base (214)..(214): a, c, t, g, unknown or other
  misc_feature (214)..(214): n is a, c, g, or t
  modified_base (816)..(816): a, c, t, g, unknown or other
  misc_feature (816)..(816): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactgggctgagtcgttgggttttccttgttgcttattttagaggtgtccagtgtgaggtgcaacgtggtgattcgnggaggtaggtgtcggtccaggcctaggataactcccgtgacgtacctcgtccgtgtacgaccgacgtcccgtcgttaggtaacttttacccgtaaccgtttttaggtaagttttacgttagggtaattgggtaaccgtccggtttaccgggggtccccaccggtaaacggtacccgttaacccgggaagggggggtaaacggggtcctttagggggtaaccggttttccggacgggtaaacccctaaaacgtaaaacgttaaaaacccggaagggtaacgtaagggggtaaaaacgggttaaaaaacgaaaaccgtttggttacgggtaacggtaaccgttcggttaagggaacggggtaaccggggtacctaacgtttacccgaaacccgtttaacgtcccgtaaacccgaagggtaaccgaaaacccgtaaaccgtaaccggtaaaaaacggtacgttccctaaacggtttaggttaacctacgggtaaacgtaaactaaaaccgttacgtaaacgaacccgggtcccggtaaggtaaaccgggccggacggtaaacggtacccgtaggtaccttaaaggtaaccttaaccgttacgggnggtaacgttaacgggactaacggttaccgttacccgttaaagtttcccgaaacggtttttcccctaaggtttttgaacccggtttacccggg

SEQ ID NO: 45720 - DNA, 1014 bp, Homo sapiens
  misc_feature: GYAE6OF01EOCP9.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagtcttgggttttccttgttgtcttattttagaggtgtccagtgtgaggtgactaacgtgggtggtacttcgtagggagggtagggttggtcgggttccacgtccgtgggaacgaacttccccgtaggacgtaccttccttccgtggtcgacacgtccctcgtacggtactttcccgttaaccgtttagttaacgtttagttaggtatggtacgtcggttcgggacccgtccgacggtaccggtaccgggaagggggtaacggggtcgttacgggtacggtttccggtaacggtaacccaaaacgtaaccgtaaaaaccgtaaacggtaaggttaaagggtaaaacgggttaaaaaaacgtaaaaccggttttaaggttacggggttaaccggttaaccggttttaccggttaacggggtaacggggtaaaccggggttacccggtaaccgttttaaccccgaaccccgttaacgtttacccccggtaacccggtaaacgggtaaacccggtaaaccccggtaaaaaccccggtaacccggtaaaaacggggttaacccgttaacccggtaaaccggttttacgtttaaacccgttaccggttaaccggaaaccgtttaaaaacgggtcccgtaaaaaccggtccgttacccgggtaaggttaacccgggggaaaccgggtaccccgggggaaacggtaccccggggtaaccgggttccggtaaacggtttacccggttaaaccgtttccgggttacgggtaaccggtaaccggggaagttaacccgttaaccggttccttaaccgggttaccctttaaccggtttccccgtttttacgtttaccgggttcttaaccccgggggg

SEQ ID NO: 45721 - DNA, 669 bp, Homo sapiens
  misc_feature: GYAE6OF01EHEZY.27.57.F02.1.454.CMB.1.raw
  modified_base (180)..(180): a, c, t, g, unknown or other
  misc_feature (180)..(180): n is a, c, g, or t
  modified_base (237)..(237): a, c, t, g, unknown or other
  misc_feature (237)..(237): n is a, c, g, or t
  modified_base (266)..(266): a, c, t, g, unknown or other
  misc_feature (266)..(266): n is a, c, g, or t
  modified_base (654)..(654): a, c, t, g, unknown or other
  misc_feature (654)..(654): n is a, c, g, or t
tcagagcgtcgtctcacgaccggtgctcgatttagctcgatatagttgggtttgaggtctcagagaggagccttagccctggactccacggcctttccacttggtgatcagcacggagcacagaggacccacatggaactggggctgagctgggttttccttgttgctattttagaggtntccagtgtgaggtgcaactgggtggattctgggaggaggtgtggtccagcctggganaactccctgagactctcctgtgcagcctntggacttctactttagtagttatgatggagtcgttcgggtccgccacgaccgtccggaggggtaacgggctagggtacgttcggtacggaccaacaactaaaaccgaaggtaataagggaaaggtaaaagtaaaactgtacggtacggtactcgtagggtaggacggaccgtacttccgaccacgttaccgtacccgaagaaccgaaccaaaccggaccaaaaggtaaccgtaccgaacgttagttaactacctagaaacctaaagtacgaaacgtacgaccgtaacggaagacggaacccgggaagaccgaacgggtcctaggtaacttaccgtaacgtcggtagtacggaggtacgtactacccgtagttacctagttccccgttntttcgtgttacccgg

SEQ ID NO: 45722 - DNA, 763 bp, Homo sapiens
  misc_feature: GYAE6OF01EAHB7.27.57.F02.1.454.CMB.1.raw
  modified_base (234)..(234): a, c, t, g, unknown or other
  misc_feature (234)..(234): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggtttcctgtgctatttagagtgtcagtgtgaggtgacaacgtggtggtattcgtggaggaggtgtggtccagcctgganaactccctgacgaccttctccgtgtgcacgtcctgtggtacttctaaccgttttagtagtttattggtatggtacgtcggttcggggtcccaccgacggtaccgtaccggaagggggtacgggtcttagggtacggtttccggtacggaaccctaaataaacgtaaaaaccgaaggtaacgtagggtaaaaggtaaaaacgtaaaacgtgttacggtacggtaaccttacggtaggtaacggaaacgggtccgtaacgttccaaacccgttacgttacccgtaaccggaaacggtaaccggaaaaccgtaaaccggaaccgtaaaaggtaacgttaccctaacggtttaagttaccgttacccgtaaggaaacccttaaagtacggaaacgtaccgtaccgtaacgggacgaaccgggacccggtaaggaccgtacgggtacttaacggttaactaccgtagtcggtacggacgtaaggtaccgtacttacctaggtaccttaacgtttccgtattttagccttacggg

SEQ ID NO: 45723 - DNA, 725 bp, Homo sapiens
  misc_feature: GYAE6OF01BNVIU.27.57.F02.1.454.CMB.1.raw
  modified_base (679)..(679): a, c, t, g, unknown or other
  misc_feature (679)..(679): n is a, c, g, or t
  modified_base (688)..(688): a, c, t, g, unknown or other
  misc_feature (688)..(688): n is a, c, g, or t
  modified_base (712)..(712): a, c, t, g, unknown or other
  misc_feature (712)..(712): n is a, c, g, or t
  modified_base (717)..(717): a, c, t, g, unknown or other
  misc_feature (717)..(717): n is a, c, g, or t
tcagagcgtcgtctcacgaccggtgctcgatttagctcgatatagttgggtttgaggtctcagagaggagccttagccctggactccaaggccctttccacttggtgatcagcacggagcacagaggacccaccatggaactggggctgagctgggtttttccttgttgctattttagaaggtgtccagtgtgaggtgcaactggtggattctggagtaggtgtggtccagcctggagaatccctgagctctcctgtgcacgcctctggacttcctaccttttagtagttattaggattggacgtcgttcggggtccccgccgaaggtacccgttaccggaaggggggaaacgggggtcgttaggggtacggtttccgggtcgggaacccctaaaaccgaaacgttaaaaaccccgaaaggtaaacggtaaggggaaaaaggttaaaaaaacgtaaaaaacgtttaagtacgggttaacggtacccttaccggttagggtaaggaaaccggggtacccgtagtttaccgaaccctactacccttaccgaacggaacgaaacccaaaccggacccaaaagtaacgtaccacgttaacgtattccgacgaactaaagtaacgaacacgaccgtaaggacggtacggaccggaaggaccgacggtctagtactactcgtagngacgagganacgtactacggtcttacgttcctntttgngttacccg

SEQ ID NO: 45724 - DNA, 767 bp, Homo sapiens
  misc_feature: GYAE6OF01EUUTE.27.57.F02.1.454.CMB.1.raw
  modified_base (280)..(280): a, c, t, g, unknown or other
  misc_feature (280)..(280): n is a, c, g, or t
  modified_base (728)..(728): a, c, t, g, unknown or other
  misc_feature (728)..(728): n is a, c, g, or t
  modified_base (754)..(754): a, c, t, g, unknown or other
  misc_feature (754)..(754): n is a, c, g, or t
  modified_base (761)..(761): a, c, t, g, unknown or other
  misc_feature (761)..(761): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggggctgagcttgggttttccttgttgcttattttagaggttgtccagtgtgaggtgctaacgtggtggtattcgtgggaggtaggttgtcggtccagtccgtaggaagtaactcccgtgacgtaccttcctcctgtnccacgtcctcgtggtactttcctacgttttaagttagtttagttggtatggtcggtcggtcggggtcccgacgaacggtccgtaccgggaagggggacgggtcgttagggtacggttccggtacggaaccctaaacgtaaactaaaaccggaaaggtaaggtaaagggtaaaagggttaaaaaacgtaaaacgtttaggtacggttaacggtaacctttacgggtagggtaacgggtaacgggtacccgttaaccttacccgtaacctacgttaccctaacgaacggaaaggtaaaccccaaaccggaaccctaaaggtaaccctacgtaacgttacgttaactccgtaagtaactaaaggtaccgaaacgtccgaacgtaggaacgggaaccgtacccgggaagaccggtacggtatacgttaacttactaacgtggaccgagaagntacgtactagttcctacgttacgttntttacgnttcggg

SEQ ID NO: 45725 - DNA, 971 bp, Homo sapiens
  misc_feature: GYAE6OF01D5ESR.27.57.F02.1.454.CMB.1.raw
  modified_base (238)..(238): a, c, t, g, unknown or other
  misc_feature (238)..(238): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgctattttagaggtgtccagtgtgaggtgcaacgtggtggattcgtgggaggaggtgtggtccagcctgganaactcccgtgacgactctcctgtgcacgtccctcgtggtatttccttaacctttttaaggttaagtttaagttggaagtggtacgtccggttcggggtccccgaccgtaacggtaaccgtacccgggaagggggaagggggtcgttagggttaacggttcgggtaccggaaccctaaaaccgtaaacgttaaaaacccgaaaggtaaacggttaacgggggaaaaagggttaaaaaaacggtaaaaaccgttaaggtttacggggttaacggggtaaccctttacgggttaacggggttaaccggggaaaaaccgggggtccccgtttaaacttaacccccggtaacccttaacgtttaccccgttaaaccccggaacgggaaaaccccggtaaaacccggaaaaccccggaaaccccggaaaaaaacgggttaaacggttaaccccgttaaaccggtttaacggtttaaccgttacgttaacggaaaccgttaaaaacgttaacgggaaaaccgaacccggtaccccggttaagggaaaccggaaccggggtaacccgggtaaacgggaaccccggtaaccggggtaccgtttaaccgttaaaccgttaaacccgttacggttacgggtacggaaccgggttaaggtaaaccggttaccgttaaccccggtttaaacgttaccctttaacccgttttcccgttttaacgtttttcggtaccgtttacccggg

SEQ ID NO: 45726 - DNA, 660 bp, Homo sapiens
  misc_feature: GYAE6OF01DPWWA.27.57.F02.1.454.CMB.1.raw
  modified_base (528)..(528): a, c, t, g, unknown or other
  misc_feature (528)..(528): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactggggctgagcttgggttttccttgttgtcttattttaggaaggtgtccagtgtggaggtgacaacgtgggtggtattcgtgggaggtaggtgtggtccaggccgtggataactccgtagagtacctctccgtgtgacacgtcctgtaggtacttaccttaccgtttagtacgttagttggagtggacgtcggtcggtcccgcgacgaccgtcggaaggggacgggtcgtagggtacgttcggtacgaccaacgaaactaaaccgaagtaaggaagggtaaagtaaaacgtaaaatgtaggtagacttgtggtaggtacgggacctacgtacaccgtactcctacgagtaacgacaaaccggaccaaagtaacgtcaacgtgtacgtntacgaactaaggtaccaagccgtacgtaggacgggtaccgacggaacggacgacggtctaagtacgttacctaggtcggtcgagtaggactcgtaacgttctacttcgttccttagtttcggatttcccggg

SEQ ID NO: 45727 - DNA, 773 bp, Homo sapiens
  misc_feature: GYAE6OF01BQJ5M.27.57.F02.1.454.CMB.1.raw
tcagagcgtcgtctcacgaccggtgctcgatttagctcgatatagttgggtttgaggtctcagagaggagccttagccctggacctccaaggtcctttccacttggtgatcagcacggagcacagacggacccaccatggaacgtggggctgagcgttggttttccttgttgcttattttagaggtgtccagtgtgaggtgcaacgtggtggattcgtgggaggtaggtcgtcggtccagtccgtaggacgtaactcccgtagacgtcctctccgtgtcgcgacgtcccttgtcggtacttaccgttaccgttttagttacgtttagtggtatcggacgtccggttaccgggtcccgaccgtaggtacccgtaccggaagggggtaacgggtcgtacggggtaacggttccgggtacggtaacccaaacgtaaaccgtaaaaccgaggtaacgttaaacggggaaaagttaaaaacgtaaacgtgttaacggtacgtaccttgtacgggtaacggaacgggtacccgtaattaccgaaccctacgttacccgtaccgaaaggtaccgtaaaccccgaaaccgtacggaaagggtaaacctccgtaaacgttcggtaacgtcccgtaaggaactaaacggttcgaacgtcggacctaggaacgtaccgaccggacgaccgtacgtgttaacgcttaaccgtcggtagtaccgacggaagtcgttacccgtattaacggtcccttacgttttacggttctttggaccgttcccgg

SEQ ID NO: 45728 - DNA, 898 bp, Homo sapiens
  misc_feature: GYAE6OF01AY8W3.27.57.F02.1.454.CMB.1.raw
  modified_base (887)..(887): a, c, t, g, unknown or other
  misc_feature (887)..(887): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcgttgggttttccttgttgcttatttagaggtgtcagtgtagaggtgacaacgtgggtgtattcgtagggaggtaggttgtcggtaccaggtccgtagggaacgtaacctcccgtagacgtaccttccgtccgtggtcgacgtacgtcccgttacgtacggttactttaccgtttaaaccggttttaggtttaagttttagttagggtaacttagggaccggttccgggttcccggggtaccccgacccgaaccggttacccggtacgggggaaacggggggtacggggtacggttacggggttacgggtttacccgggaccgggtaaaccctaaaacgtaaaaaccggttaaaaccggaaaggttaacgggttaaaacgggggtaaaaacgggttaaaaaaccgtaaaacggtttacgggttaacgggttaaccgggtaacccgtttagggttaacggggtaaaccggggttaaacccgggtacccttaccgttaacccggaacccttacgtaccccgtaaccggaagtaaacccggaaacccgtaaacccgaaacggttaaaacggtaaccttaccgtaacgttacgttactaacggtacgaaactaaacgaccgtaacgtaccgtaccggtagggaaccggtaccggtaaccggacgtacggaccgtacttaacggtactacggtagtaggcgagtaagtccgtactcgttacgtcttacggtttcttcgttntcgttaccggg

SEQ ID NO: 45729 - DNA, 742 bp, Homo sapiens
  misc_feature: GYAE6OF01BN8T1.27.57.F02.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (342)..(342): a, c, t, g, unknown or other
  misc_feature (342)..(342): n is a, c, g, or t
  modified_base (697)..(697): a, c, t, g, unknown or other
  misc_feature (697)..(697): n is a, c, g, or t
tcagagcgtcgtctcacgaccggtgctcgatttagctcgatatagttgggtttgaggtctcagagaggagccttagccctggactccaaggcctttccacttggtgatcagcacggagcacgagacggacccaccagtggaactgggctgagccgttgggtttcctgttgctattttagaaggtcgtccagtgtgaggtcncaacgtggtcgtattcgnggaggagttggcggtccagccgtggacgaactccgtgaacgtctcctccgtgtcgacgtcgtcctcgtaggtacttacctaccgtttaggtaagttattggtagtggtacgtcgtcgggtccncgagtaccgtcgagggtacggcgtaggagttcggacgaccgaactaacgaaaccgtaagaacggtaacggtaaacggtaaaaacggtaaacgttaggtacggtacggttaacctacgggtaggttaacggaaacggggtccctaacgtttccggaaccctaagttacccgtaccgagaacgaaccgtaaccgcgaaacgtacggtacctaaggtacgtactaggtacctaaacgaagtaaccaaacgtcgtaccgtacgaccggtaccggaccgtaaacggacccgtacggttactaacggttaacctaccgtacgtttacgggaacgcggtaacgggttaacacggtttaaccnccggttaacttacgtttccccttagttcccgtaacctttaccggg

SEQ ID NO: 45730 - DNA, 709 bp, Homo sapiens
  misc_feature: GYAE6OF01BSE6I.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaacgtggtggattcgtggaggaggtgtggtccaggcctggagaactccctagacgtactcctcctgtgcacgcccttcgtggtattcctaaccgttttagttaagtttagttggatggaggtcgtcggggtcccgccgagaccgtccggaaggggacgggcgtgggacgtttcggtaggaccaaacaactaaaaccgaagaagtagggaaaggtaaaaacgtaaaaactacgtaggtacggtacttcgtaggtaggaacgggtacgtacgttaccgaacctactccctaccgaagaacgaaaccaaaccggaccaaaaggtaccgtacgtacttggtaactcgtacgaacgtaaatacgaacgacgacttacggaacggaccggaccgggaaggtaaccggacggtacgtacgttaacttaacccgtagttcgggtacggacggaaggtaaccgttattacccgtacgtttacctaccgtttacccgttagttttggtactttaccccggg

SEQ ID NO: 45731 - DNA, 705 bp, Homo sapiens
  misc_feature: GYAE6OF01CCNHV.27.57.F02.1.454.CMB.1.raw
  modified_base (184)..(184): a, c, t, g, unknown or other
  misc_feature (184)..(184): n is a, c, g, or t
  modified_base (691)..(691): a, c, t, g, unknown or other
  misc_feature (691)..(691): n is a, c, g, or t
tcagagcgtcgtctcacgaccggtgctcgatttagctcgatatagttgggtttgaggtctcagagaggagccttagccctggactccaaggtcctttccacttggtgatcagcacggagcacagacggacccacagtggaacgtgggctgagtcgttgggttttcctgtgcttagtttggagtntcagtgtgagtgacagtggtgattgtgggaggtaggtgcggtcaggtcgtaggaagtactccgtgaacgtactctcgtgtaccgcacgtcctgtagtactacgttacctttagtagttaggtgtatggacgtcgtccggtccgacacgtccgtaggaacggggaggtcggtacggtggtaccgtcggaaaccaaaacctaagtaaaccgaaggtaacgtaaagggtaaaagtaaaacggggtaaaacttaggtaaggtacgtacgtttacggaggtacgggaaaccgggtacctaacgtacccgaactctacccgtaacgaagaaaccgaaacccgtaaccgaacgaaagtactaccgtattatacgtataacgaataagacgaacgtcgtacgtagaaacggcggtaaccgaagtacggtacgtcgttaagtacctacggttagaccggtggtaacacggttaatccgttacgtaccgttcgttaacccttacgtttacggtttcncgggtttaacccgg

SEQ ID NO: 45732 - DNA, 733 bp, Homo sapiens
  misc_feature: GYAE6OF01BNMCF.27.57.F02.1.454.CMB.1.raw
  modified_base (717)..(717): a, c, t, g, unknown or other
  misc_feature (717)..(717): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactgggctgagcttggttttccttgttgcttattttagaaggtgtccagtgtggtaggtgcctaacgtggtaggtattcgtgggaaggtaggttgtcggtccagcccgtagggaagaaacgttccccgtaggacgtaccgttccgtccgtgtcgacgacgtcccttcggtaggtactttaccgttaccgttttaagttacgttttagttaggtagtacggaggtccggttaccggggtccccgaccgacgaccgtaccggaagggggacgggtcgtgggtagttccggtacgacccgtaaaagtaactaaaaccgaagtaggtaaggaaaggtaaaacgaaacttagtgtacgtactcgtaggacggaacgggtacctactaccgacctatccgacgaagaacgacaaaccgacgaaaggtactacaacgttagaacttcagtaactaatacgaacgtacgtaccgtaggaacggtaccggaccgaacggaaccggacgtccgtagttaaccttaacgtaccggtggtcgacggaaggtacgtacttacccttaagttacccttacgttaccccgtttntttacgtacttaccgg

SEQ ID NO: 45733 - DNA, 681 bp, Homo sapiens
  misc_feature: GYAE6OF01EKYI5.27.57.F02.1.454.CMB.1.raw
  modified_base (207)..(207): a, c, t, g, unknown or other
  misc_feature (207)..(207): n is a, c, g, or t
tcagagcgtcgtctcacgaccggtgctcgatttagctcgatatagttgggttgaggtctcagagaggagccttagccctggactccaaggcctttccacttggtgatcagcacggagcacagaggacccaccatggaactggggctgagctgggtttcctgttgctatttagaagtgtccagtgtgaggtgcaacgtggtggattcnggaggaggtgtggtccagcctggagaactcctgagactctcctgtgctagcctgtggattctacctttagtgttagtggactggagtcgtcggggtcccacctaagaccttccgaaggggtaacggggtctaggggagtttcggtacggacctaaacaaccgttaaaaccgaaggagttaacgggaaaggtaaaaacgaaaaaccgttgtacggtacggaaccttacgtggtaaggtaaacgggccctaatttccgaacctacgtacctaccgaagaacgaaccaaaccgaccaaaggtaacgtctaacgttacgtaactacgtacgaactaaacgtacgaaaccgcgtaaccgtacgaacgggacgtacccggaagggacccgtagggtaccttaggtaacgtaccgttaaccgttggagtaccgaagtacgtacgtcgtaacgtctaacgttccgtcttttagcgttaccgg

SEQ ID NO: 45734 - DNA, 835 bp, Homo sapiens
  misc_feature: GYAE6OF01AONWA.27.57.F02.1.454.CMB.1.raw
  modified_base (318)..(318): a, c, t, g, unknown or other
  misc_feature (318)..(318): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattcgtggaggaggtgtgggtccaggcctggagaactcctgagactctctgtgcacgcctcgtggacttctacctttagtagtttagtggattgagtccgtcggggtcccnccgaacgtacgtccggaagggggaacggggcgttagggtaacgtttcgggtaggaccccaaaacgtaacgtaaaaaccgaaaggtacgttaacggggtaaaaggttaaaaacggtaaaaaaccgtttaggttacgggttaacgggtaacctttcggtttacgggttaaaggggaaaaccgggggtccccgttaaacgtttaccccaacccggtaaacgtttccccgtaaccccggtaaagggaaaccggtaaaccccaaaaccgggaccccgtaaaaagggtaacccggttacctaaaccgttaacggttaacctttacggtaaccgtaacctaaaagttaccgggaaaactccggtacccgttaagggaacgacggaacccgggaggtaacccgacgggtaccgttagtaaaccttacgttccggtaggtccggtaacggaggaacccgttacgttacccgttaacggttaccgtaccttttaaccccggtttgttttacgtaaccgtttcccggg

SEQ ID NO: 45735 - DNA, 603 bp, Homo sapiens
  misc_feature: GYAE6OF01CBZYK.27.57.F02.1.454.CMB.1.raw
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (589)..(589): a, c, t, g, unknown or other
  misc_feature (589)..(589): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgttgctattttagaaggtgtccagtgtgaggtncaacgtggtggattcnggaggaggtgtggtccagcctggagaactccctgagactctcctgtgcagcctctggacttcaccttttagtagttattggatggagtcgtcgggtcccaccagtacctccggaaggggacggggctgggtacgttcggaggaccaagaactaaaaccgagagtagggaaagtaaaagaaactagtgtacggactcgtaggtaggaacgggccgtattaccactatccaccaagacacaacgcgaaagacgtcaacgtgtactactgaacaatacgtaacacgtaccgtaggacgacggtaccggaaggacctacggtctagtaactacgtaacgtggtcgacggaagtacgtacttaccgtactcttactttcccgtnttttacgcttccgg

SEQ ID NO: 45736 - DNA, 838 bp, Homo sapiens
  misc_feature: GYAE6OF01CFIIX.27.57.F02.1.454.CMB.1.raw
  modified_base (340)..(340): a, c, t, g, unknown or other
  misc_feature (340)..(340): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttcctgttgcttatttagaaggtgtcagtgtgaggtgcaacgtggtggattcgtgggaggtagggtgttcggtccagtcccgtgggaagtaactccccgtagacgtacctcctccgtggtcgcacgcctcgtggtacttcctaaccttttagtagttagtggtatgacgtcggtcgggtccnccgagtaccgtaccggaagggggaacgggtcgtagggtacggttccggtacggaaccaaaacgtaaacgtaaaaccgaaggtaacggtaagggtaaaacggtaaaaacgtaaaaacgttagtaggtacggtaaccttcgtaacggtaaggggaaccgggtaccgtaacgtttacccaaccgttacgttaccccgtaaccgaaggaaaccgaaacctaaacccgggaaccaaaaacggtaccgtaccttaacgttacggttaacttaccgtaacgaaacctaaaggttaaccgaaaccgtaaccggtccgtaacggtaaacgggacccggtaaccgggaacgggtaaacccgacgggttaccgttaacgtaaccgtttaaacccgtgggttacggtacgggtaccggtaaacgggtaacgttacccgttaacccgtttacggtaccgttttaacccgtttaccccggttttacgttttacgtaacccggttacccgggg

SEQ ID NO: 45737 - DNA, 779 bp, Homo sapiens
  misc_feature: GYAE6OF01D8T4I.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacagacgacccaccatggaacgtgggctgagtcgttgggttttccttgttgtcttattttagaggtgtccagtgtgaggtgacaaagtggtaggtattcgtgggaggaggttgtcggtccgagtccgtaggaacgaacttcccgtagacgtacctcctccgtggtcgaccacggtccctacgtggtacttccgttaaccgtttagttagtttagttaggtatggacgtccgtcggggtcccgaccgaggtacccgtaccggaagggggtacggggtcgttagggtacgtttccgggacgtaacccaaaacgtaaacgtaaaaccgaaggtaacggtaagggaaaacgggtaaaaacgtaaaacgttagttaacggtacggtaccttacggtagggtaacggaaccgggtacctaacgttaccgaaccgtaactcccgtaacgaacgtaacggaaccccaaaccgaacccggtaaagaacccgttaccaacgtttacgtaactacgtacgaaactaaaggtaccgaacgtaaccggtccgtaaaggacgtaccgggtacgaacggaccgtaccggtatagtaccttaacgtacggtggtcgaacggagtactacgttaccgtaacgttacttaccgttacgttctttacgccgttacggg

SEQ ID NO: 45738 - DNA, 787 bp, Homo sapiens
  misc_feature: GYAE6OF01CET1V.27.57.F02.1.454.CMB.1.raw
  modified_base (322)..(322): a, c, t, g, unknown or other
  misc_feature (322)..(322): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaagtgtccagtgtgaggtgcaactggtggattcgtggaggaggtgtcggtccagccgtaggagaactcccgtaggacgacctctcctgtgcacgcctctggacttcctacctttaggtagtttattggatgagtcgtcggggtcccnccaacgaccgtaccggaggggtaaggggcggtaggtacggttccggtggaccccaacgtaaactaaaacccgaaggtaacgtaggggtaaaaggtaaaaacggaaaacgttagttacgggtacggacgttcgtagggtaggaaaccggggtccggttaattacccgaaccctacgttacccgttaaccgaacggtaaacggaaaccccgaaaccggaacccgtaaaaggtaaacccggttaacctaaccgttagttaacttaccgtaggaaccttaaaacgtacgtaaacgaccgtaccgtaaggaacgggaaccggaacccgggaacggaaccgggaccggtacgttacggtaaaccttaaccggttaacgttgggtaccggaacgaaagggtaacgttaccgttaacccgttagttacccttaccggtttacccgtttccgttttagtcccggtttacccggg

SEQ ID NO: 45739 - DNA, 678 bp, Homo sapiens
  misc_feature: GYAE6OF01CMX05.27.57.F02.1.454.CMB.1.raw
  modified_base (123)..(123): a, c, t, g, unknown or other
  misc_feature (123)..(123): n is a, c, g, or t
  modified_base (187)..(187): a, c, t, g, unknown or other
  misc_feature (187)..(187): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (593)..(593): a, c, t, g, unknown or other
  misc_feature (593)..(593): n is a, c, g, or t
tcagagcgtcgtctcacgaccggtgctcgatttagctcgatatagttgggtttgaggtctcagagaggagccttagccctggactccaaggtcctttccacttggtgatcagcgacggagcanagacggacccacagtggaacgtgggctgagtcgttggtttcgtgtgtacttagtttagaaggtntcagtgtgngtncagtggtgnttcgagggagtggtgtcgccagtcgaggatacctccngactctctcgtgcgcncgtccgtagtcgtacttcttacgttagttagttagttaggacgtggtaccgtcggtccggtaccgcgacgtccgtacgggaaggggtcggtacgtaggtacggttacggaccgaacctaaactaaacgtaaacgaggaaggtaaggtaaaggtaaactaagtgtaggcgtacgtgtaggacggtacggtactacgacctacgtctacctacgaagaaccgaacaacgacaaggtactccgtaattgtaacctacgtacgaaataacgtacgaacgtcacggtacgacgggtcccgaagtacgaacgtccgttaggtaacccttaggttaccngggttacccggaatagggtaaaccgtattcccggtaccgttgtaaacccctttcggttactttacgtcgtaaccggttaccgggg

SEQ ID NO: 45740 - DNA, 669 bp, Homo sapiens
  misc_feature: GYAE6OF01EBA4D.27.57.F02.1.454.CMB.1.raw
  modified_base (213)..(213): a, c, t, g, unknown or other
  misc_feature (213)..(213): n is a, c, g, or t
  modified_base (539)..(539): a, c, t, g, unknown or other
  misc_feature (539)..(539): n is a, c, g, or t
tcagagcgtcgtctcacgaccggtgctcgatttagctcgatatagttgggtttgaggtctcagagaggagccttagccctggactccaaggccctttccacttggtgatcagcacggagcacagaggacccaccatggaactggggctgagcttgggttttccttgttgctattttagaggtgtccagtgtgaggtgacactggtggattcgnggaggaggttgtggtccagcctaggagaactccctgagactctcctgtcgcacgtccctcgtggactttcctaaccgttttaagtagtttattggaattggacgcgtggggtcccaccgagtacctccgggaagggggaacgggtctgggtacgttcgtacggaccaaacactaaaccgagtagtacgggaaagttaaacaaacgtagtcggtggacttcgtaggtacggaacgggcctaacttcaaccattcctaccgaggaacgaaccgtaaccgaacgaaagtaactctacgttagtactcgtagtaacaaacgtacaaacgngtacccgtaaggtaacggacgaccgggtaaggaccgacggtcttagtaaaccgttactacggtggtacgaagtacgtacgaccgttcttacgtacctttacgttcccggttcttttagccgttacccggg

SEQ ID NO: 45741 - DNA, 738 bp, Homo sapiens
  misc_feature: GYAE6OF01EQCH2.27.57.F02.1.454.CMB.1.raw
  modified_base (118)..(118): a, c, t, g, unknown or other
  misc_feature (118)..(118): n is a, c, g, or t
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (661)..(661): a, c, t, g, unknown or other
  misc_feature (661)..(661): n is a, c, g, or t
  modified_base (729)..(729): a, c, t, g, unknown or other
  misc_feature (729)..(729): n is a, c, g, or t
tcagagcgtcgtctcacgaccggtgctcgatttagctcgatatagttgggtttgaggtctcagagaggagccttagccctggactccaaggcctttccacttggtgatcagcacggancacagacggacccacagtggaacgtggggctgagtcttgggttttccttgttgtcttagttttaaggaaggttcgtcctagtggtgaggtnacaacgtggtaggtattcgngggaggaggtgtcggtccagccgtggaacgaactcccgtgacgactctccgtgtcgcacgtcctcgtagtacttacctaacgtttagtacgttagttggagttagacgtcgtccggggtcccaggtaacgtaccgtaccgggaagggggtacgggtcctagggtacgttcggtacgaacctaaacaaacgtaaacgaagagtaagggaaaagtaaaacgtaaatgtacggtacgtactagtaggtacggaacggcccttaattacccaaccgttagtacccgtaacgaacggtaaacgaaacccgtaaccgtaaccgaaaaggttaccgtaacttaacgtaagttaaccctacgtaacgtaaaccctaaagggtactaaacccgcgttaaacgacggtaacgaacccggacggtaacggtaaccgaccgttntaacggtaacctagtacgtggtacgaggtataaccggcttacgacgttcttaccgtttgttacgtttncggttccgg

SEQ ID NO: 45742 - DNA, 939 bp, Homo sapiens
  misc_feature: GYAE6OF01CAOXF.27.57.F02.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
  modified_base (833)..(833): a, c, t, g, unknown or other
  misc_feature (833)..(833): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactcggggctgagcgttgggtttcctgtgctatttagaagtgtccagtgtcgaggtncaacgtggtgattcgtggacggagtgnggtaccaggtccgtaggacaacgtcccgtagacgtaccttccgccgtggtcnctaacggtccctagtaggtactttaccgtaccgtttagtaagttcggttacggtagtagacgtccggttcgggtacccgtaccgtacggttaaccgtaccgggtaacgggggtaacgggtccgttacggggtacgtttaccgggtaccggaacccctaaaagtaacccgttaaaaaccggaaggttaaccggtaaaggggttaaaaccggtaaaaaaacggttaaacccggttaggtaaccggggtttaaccggtaaccgtttaccggttaaggggtaacggggtaaaacccgggtaccccgggtttaagttacccccgtaaaccgttaccgggtttaaccctaacccgggtaaagggtaaccccggtaaaacccgtaaacccccggggttaagaaaaacccgggttttaggtaacccccttaacgggtttaaccgttaacccgtacccggtttagggtaaaaacccttaaaccggtaccgggtaaaccgtaacccgttaccgggttaacggaaacgggtcccgggtaaccggaaacggggttacccctagttaacccgngttaaacccggttacccgaagtcccgggtctaaacgaaagggtcttaaacccgcggttaaccgttagtaccccgttaacgttgtttaaacccgggtttaccccggg

SEQ ID NO: 45743 - DNA, 681 bp, Homo sapiens
  misc_feature: GYAE6OF01AOCRW.27.57.F02.1.454.CMB.1.raw
  modified_base (556)..(556): a, c, t, g, unknown or other
  misc_feature (556)..(556): n is a, c, g, or t
  modified_base (623)..(623): a, c, t, g, unknown or other
  misc_feature (623)..(623): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttggtatttagaaggtgtccagtgtgaggtgcaactgggtggattcgtgggaggaggtgtggtccagccgtggagaactccctgacgactctcctgtgcagcctctaggtacttcctaacctttagtagtttagttggattggacgtcgttcgggggtcccaccgtaggaccgtaccgggaagggggtaacggggtctaggggtacgttccggtacgggaacccaaacgaacgtaaaaccgaagaagttagggaaaaggtaaaagaaacgttagtaggtacggtactacgtaggtacgggaacgggtcctattaccaactatccgaccaagtaacgaacctaacggacaacggactaccacgtaatctacgtacgaactaagtcgaaaccngtccgaagaacggtacgacggaagtaccgacggtagtaactactaccgtacgtggccggaacggtanagtaccttaccgtaacgttactaccggttttacctagtttagccgttccggtacgggg

SEQ ID NO: 45744 - DNA, 668 bp, Homo sapiens
  misc_feature: GYAE6OF01A9PR9.27.57.F02.1.454.CMB.1.raw
  modified_base (217)..(217): a, c, t, g, unknown or other
  misc_feature (217)..(217): n is a, c, g, or t
  modified_base (265)..(265): a, c, t, g, unknown or other
  misc_feature (265)..(265): n is a, c, g, or t
  modified_base (311)..(311): a, c, t, g, unknown or other
  misc_feature (311)..(311): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttagttttggaaggtgtcagtgtgagtgcaactggtgattctgggaggnggtgtggtccagcctggagatccctgagactctcctggtcgcagcctntggacttctaacctttagtagtttattggatgagtcgtcgggtccncgagaccgtccgagggggaagggctgggtagttcggtcggaccaacaacgtaaaccaaagacgtagggaaaggtaaaacgaaaagttagtaggtacggtaacttcgtacggtagggaaacgggtacccgtaattaccgtaacccgtacttaccctaccgaacggaacgtaaacccgaaccggaacccaaaaggtaaccgtacctaaacgttagtaacgttaccgtacgtaaccgtaaagtaacgaacgtacgaccgtaaggacgaacggaccggaacggaccgacgtcgtagtaactactagtcgtacggagagacgtaccgtactacgtctacgttccgttcgttttgcgtttccg

SEQ ID NO: 45745 - DNA, 732 bp, Homo sapiens
  misc_feature: GYAE6OF01BT8YT.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaacgtggtggattcgtgggaggaggtgtggtccagcctggagaactcccgtgagactctcctgtcgcagcctgtggtattcctactttagtagttagttggatggagcgtgggcccacgagaccgtaccggaggggacgggctagggtacgttcggtaggaccaaacgtaactaaaaccgaaggtacgtaagggtaaacggtaaaaagtaaactagtggtacggacttacggtaggtaggaacggggtccttaattaccacctacttccgtaaccgaaggtaccgaaaccgaaccgtaccgaaaaggtacgtactaacgttggtacttacgtacgaaccgtaaagtacgaaaccgcggtaaccccgagggaacgaaccgggtaccgggaaacgggtaaccggaccggtacttacggttaaacttacccgtacggttaggacccgggtaagggaacgtaacggttacccttaacccggttaacggttaccttacccgttttaccccggttacttttttaaggcgtttaaccccgggg

SEQ ID NO: 45746 - DNA, 728 bp, Homo sapiens
  misc_feature: GYAE6OF01BCVRD.27.57.F02.1.454.CMB.1.raw
  modified_base (708)..(708): a, c, t, g, unknown or other
  misc_feature (708)..(708): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgtgctattttagaggtgtccagtgtgaggtgcacgtggtggattcgtggaggaggtgtggtccagcctggagaactccctgagactctcctgtgcacgcctctggattctacctttagtagttagttggatggacgtcgtcggggtcccgccgacgaccgtccggaagggggaagggtcgttgggtacggttcggtcgggaacccaaacgtaacgtaaaaccgaaaggtagtaaggggtaaaggtaaaaacgaaaaacgttagtaggttaacgggacttacggtaggtagggtaaacgggtcccgtaagtttacccaacctacttccctacccgaaggtaacgtaaacccgaaaccgtaaccgaaaacgtaacggttacctacgttagttaccgtacttaggaacttaaagtacgaaaccgacgtacccgtaggaacggaccggtaaccggaacggacccggaggtcgttaacggttactaacgttaccgttgggtcgggacggaagacgtacttacccggttgttacctaccgttttcccgttnttttacggtcgtttcccggg

SEQ ID NO: 45747 - DNA, 872 bp, Homo sapiens
  misc_feature: GYAE6OF01BD0DB.27.57.F02.1.454.CMB.1.raw
  modified_base (218)..(218): a, c, t, g, unknown or other
  misc_feature (218)..(218): n is a, c, g, or t
tcagagcgtcgtctcacgaccggtgctcgatttagctcgatatagttgggtttgaggtctcagagaggagccttagccctggactccaaggcctttccacttggtgatcagcacggagcacaggacggacccacagtggaacgtggggctgagcttgggttttcctgtgcttagttttagaggtgtcagtgtgaggtgcgtaacgtggtggacttcgngggaggtaggttgtcggtaccagccgtaggaacgactcccgtaggactaccttccgtccgtggtcgcgtacgtcccttgtaggtactttaccgttaaccgttttaaggtacgtttagttagggtattacggtacgtccggttcgggtacccgtaccgtaacggtacccgtaccgggaagggggtaacggggtcgttacggggtacgtttccgggacggtaaccctaaaacgtaaaccgttaaaaccgaaaggttagggttaaacggggtaaaacggttaaaaacgtaaacgtttaggttaaccgggtaggtaaccttagggtagggtaacgggtaacgggtacccgttagttacccgaacccgttaacgtacccggtaccgtaaacggaacggaaacccgtaaaccgggtaaccgtaaaagtacccggttacctaaacggttacgttaacgttcccgtaaggaaaccctaaagtaccggaacgaaccggttccgtaaacgggacgaccgggttaccggaacggttaccggacggttactaagttaacgtaccgttaacgtcggtacggaacggaacggttaagtacccgtttcggttaaacgttcccgtttaacggtttaccccttttaggtttccgtaaacggtttcccgggg

SEQ ID NO: 45748 - DNA, 755 bp, Homo sapiens
  misc_feature: GYAE6OF01BWM3A.27.57.F02.1.454.CMB.1.raw
  modified_base (326)..(326): a, c, t, g, unknown or other
  misc_feature (326)..(326): n is a, c, g, or t
  modified_base (729)..(729): a, c, t, g, unknown or other
  misc_feature (729)..(729): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaactgggtggattcgtgggaggaggtgtcgggtccagccgtggaagaactccctgagactcctcctgtcgcacgcctcgtggtacttcctacctttagttagtttagttggatgagtcgtcgggtccnccacggaccgtccggaagggggtaacgggcgtgggtacggttccggtaggaccccaaacgtaaacgtaaaaccgaaaggtacggttaaagggaaagggtaaaaaacgaaaacgttagtagggtacggtaaccgttcgtagggtacgggaacgggtacccgtaatttacccaaccctaagttccccgtaacgaaggaacgtaaacccgaaaccgaaccgaaaagtacgttacctacgttagtactcgttagaaacctaagtaccgaaacgtcgaccgtaggacgacggaccggtaaggaccgtaccgggtattacgtaaacgttcgtaacggttggtccggaaggaacggtaagttaaccgtacccggttaactttacccggttacggtttaccccgggttttnttttaaccgggccggtttaacccggg

SEQ ID NO: 45749 - DNA, 966 bp, Homo sapiens
  misc_feature: GYAE6OF01DUFII.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtgggctgagcttcgggttttcttgttgtcttatttagaagtgtccagtgtgaggtgactaacgtggtgtattcgtagggaggtaggttggtcggtaccagtccgtggaacgtaacctcccgtagaacgtaccttccgtccgtagtcgactaccgtccgttcgtaggttacctttacccgtttaaccgtttttaaggtttaacgttttaggttagggtaacgttcggggaacggttcccgggtttacccgggggttaccccgacccggtaacgggtaaccccgggttacccgggggaaaggggggggtaaccggggtccggttaacgggggttaacggtttaccgggtaccgggaaaaccccctaaaacgtaaaaccggtaaaaacccgtaaacgggtaaagggttaaacggggtaaaaacggttaaaaaaccggtaaaaccgtttagttaacggggttaaccggttacgtacgggtacgggttaacgggaaccggggtttacccgtaacttaaccccgtaacctaacgttcccgtaaaccggaacggtaaaccgaaaaccccggaacccgtaaacggtaaaacggtacccgttaactacggttaaacgtaccttacggtaaccgaaacgtaaagtaaccggaaccgacggttaaccggaacgggtaaagggcccggtaaaccgggaacgtaacccgggttcgtaaacgttacgttaaccggttaccttagggtacggtaacgggaacggttaacggtaccttacccgttaccggttaacggtttccttaaccggtttcctttaacgggtttgcggtttacccgg

SEQ ID NO: 45750 - DNA, 878 bp, Homo sapiens
  misc_feature: GYAE6OF01A7VMN.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgtcttattttagaaggtgtccagtgtgaggtgcaacgtggtggattcgtgggaggtaggtgttcgggtccaggcctaggaagaactcccctgagtacctcctcctggtcgcacgcctgtcggtattcctaccttttaagtagtttagttaggatggacgtcgttcgggtcccgccgaagtaccgtaccgggaagggggtaacggggtccgttaggggttacggtttcgggtacgggaacccctaaaaccgtaaaaccgtaaaaaccgaaaggtaaaggttaacgggggtaaaaacgggttaaaaaaggtaaaaacgttagttagggtaacggtaaccgtttacgtaggggttaacgggaaaccggggtacccgttaacgtttacccgaacctaccgttacccgtaacccgaaacgggaaccggaaaaccccgaaaacccggtaaacccgtaaaaacggtaaacccggttaaccctaaaccgtttaacggttaaaccgttaccgttaacgtaaaccgttaaaagttaacgggaaacgtaccggtaacccgttaaggaaccgggtaacggaacccgggtaaacgggaacccggaaccgggttaccgttaacggttaaaccgttaaccgtaacggttggtacggaaccggtaaggtacgtaccttacgtacgttcttaacgtttcccgtttaacgtttttcgacgttacccggg

SEQ ID NO: 45751 - DNA, 663 bp, Homo sapiens
  misc_feature: GYAE6OF01CBQAR.27.57.F02.1.454.CMB.1.raw
  modified_base (259)..(259): a, c, t, g, unknown or other
  misc_feature (259)..(259): n is a, c, g, or t
  modified_base (505)..(505): a, c, t, g, unknown or other
  misc_feature (505)..(505): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaaggtgtccagtgtgaggtgcaactggtggattcgtggaggaggtgtggtccagcctggagaactccctagagactctcctgtncagcctcgtgacttctacctttagtagttatggtatgagcgtcgggtccgcagacctccggaaggggaagggctgggacgttcggtggaccaacaactaaaaccgaagacgtagggaaaggtaaaagaaaacgtagtggtacggtaactgtaggtaggaacgggtaccgtacttccaacctattacccgacgtaacggaacgaaacccgtaaccgacctaaaaggactcaacgttagtaactcganaaccgtaaatacgaacgtacgtccctaaggacggtacgaccggtaacggaccgacgggtcttaggtaactaccttaaggcggtacggacggtaaggtagtaccgtttacccgtaacgtaccttaacgtttccccggttattttccggaattcccgggg

SEQ ID NO: 45752 - DNA, 784 bp, Homo sapiens
  misc_feature: GYAE6OF01BG3BB.27.57.F02.1.454.CMB.1.raw
  modified_base (180)..(180): a, c, t, g, unknown or other
  misc_feature (180)..(180): n is a, c, g, or t
  modified_base (245)..(245): a, c, t, g, unknown or other
  misc_feature (245)..(245): n is a, c, g, or t
  modified_base (722)..(722): a, c, t, g, unknown or other
  misc_feature (722)..(722): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccctgttgcttattttagagtntccagtcgtgaggtcgacaacgtggtggtattcgtgggaggaggtgtcggtccaggtcctggganacttccccgtaggacgtaccttcctacctggtcgacgtacgtccgttcgtcggtattaccctaccgtttttaaggtagttttagttaggtagttcggacgtccggttaccggggttcccgaccaacggtaccgtaccggggaaggggggttaaccgggtccggttaaggtcggtttaccgaccgggtaacccaaacgtaaacgttaaaacccggaagtaacgtaaggggaaaaggttaaaaacaaaacggtttccgtagggtaaccgtacttccggtagggtacgggtaaccggccttaacggttaccaacccgttagtaccctacgggaacgtaacccggtaaccgaaccggtaacaaacggtacgtcctaacgttaggtacttcgagtaacgaacttggaaacgtccgtacggtaagcggttaacgacggtacgtagaccggctttaaggacttaccggtaacggtgtaaccggngtaacgggtcttcggtaaacttcggtaccttaggtttacccttgtttacgcccggtttacgg

SEQ ID NO: 45753 - DNA, 774 bp, Homo sapiens
  misc_feature: GYAE6OF01A4CN4.27.57.F02.1.454.CMB.1.raw
  modified_base (183)..(183): a, c, t, g, unknown or other
  misc_feature (183)..(183): n is a, c, g, or t
  modified_base (654)..(654): a, c, t, g, unknown or other
  misc_feature (654)..(654): n is a, c, g, or t
  modified_base (670)..(670): a, c, t, g, unknown or other
  misc_feature (670)..(670): n is a, c, g, or t
  modified_base (708)..(708): a, c, t, g, unknown or other
  misc_feature (708)..(708): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcttgggttttccttgttgctattttagaggtntccagtgtgaggtgcaacgtggtggattcgtagggaggtaggttggtcggtccgagcccgtaggagaactcccctggaacgtacctctccgtggtcgcacggtcccttcgtagggtaactttacccgttaaccgtttttaaggttaaggttttacgtttggggtaattaggacggtccgttcgggggtttccccgaccgtaacggtacccgtccgggaaacggggggaacgggggtcctaggggttaacggtttcgggtaccggaacccaaaacgtaactaaaaacccgaaaggtaacggtaagggtaaaacggtaaaaagtaaaaaccttaggttacggttacgggtaaccttcggtagggtaacggaaaccggggtccgtactttacccgaaacgtcttacccgtaccgaagtaaaccgaaccgtaaacccggactaaaacggacgtaccctagttagtactaccgtanaacgtaagtacgaacncgtaccggtagaacggacgaccggtaaggactaccggntagtaactactacgtagtcggacgaggacgtactaccgttataccttactccgtttcttgcttcgg

SEQ ID NO: 45754 - DNA, 629 bp, Homo sapiens
  misc_feature: GYAE6OF01BZGTW.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtgcagcctctggattctacctttagtacgttattggatgagtcgtcggggtcccgccagacctccggaaggggaacggggtctgggtagttcggtggaccaacaataaaccaagatagggaagtaaaagaaactagtaggtaggtactcgtggtaggaacgggccgtattccgacctactacctccgaagacgaaccgaacgaccaaaggacgtcaacgttatacttctcgaactaaatcgaacacgtacctaggacggacgaccggaaggaccgtacggcttagtaacttacgtacgtggtacggacgaggtacgtacgttcccgttaaggtccttaacggtttcccgttacgtttttgacgtttacccggg

SEQ ID NO: 45755 - DNA, 949 bp, Homo sapiens
  misc_feature: GYAE6OF01BO0Z0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactgggtgattctggaggaggtgtcggtccaggccttagggagaacttccccgtaggacgtaccttccttccgtagttcggacctaacggtcccgttaccgttacgggtaattttacccgtaaaccccgtttttttaaggtttaacggtttttaacggtttttagggggaaactttagggtaaacggggtcccggtttaccgggggggttacccccgaccccgaacgggtaaccccgttaccccgggtaaaaggggggggaaacgggggggttcccgttaggggggttaaaacccggggtttttccgggtaccgggggtaacccccgtaaaaaccgtaaacgtttaaaaaaccccaaagggtaaacgttaacgggggtaaaagggttaaaaaacggtaaaaaacctttacgttagggtacggttaacccgttacgtagggtaaccgggtaacggggtacccgtaatttaacccgaacccgtaacttcccgtaccgaagggactaaaccgaacccgtacccgaaaggtaacgtacctacgttaaggttaaccttcgtagtaaccctaaagtaccggtaaacacgtacccgtaggtaaacgggaccggacccgggaaaggaaccccgtacgggttaccttagggtaaccttaaccgttaccggtacggtacgtacggggaataaacgggtccgttaacccgttacgggttaccttactttaccccggttttagtttacgtcgtttaaccccggg

SEQ ID NO: 45756 - DNA, 913 bp, Homo sapiens
  misc_feature: GYAE6OF01DS2OK.27.57.F02.1.454.CMB.1.raw
tcagagcgtcgtctcacgaccggtgctcgatttagctcgatatagttgggtttgaggtctcagagaggagccttagccctggactccaaggccctttccactttggtgatcagcacggagcacagacggacccacatggaactgggctgagtcttgggttttccttgttcgtacttagttttaggaaggttcgtccaggtgtggaggtgactaacgtgggtaggtactttcggtaggggagggtagggttgtcgggtacccgaggtccgttagggaacgtaaccgttccccgtaggtaacgtacccttccgttcccgtggtaccgcctaccggtcccttcggttacggttacttttaccctttaaccgtttttaaggttaagttttagtttggaagtaggtccggtccggttcggggtacccccgtaccgaacgtacccggtaccgggtaagggggtaacggggtcttaggggttaccggtttcggtaccggtaacctaaaacgtaaaaccgttaaaaccgaaaggtaaggtaaacggggaaaacggtaaaaaacgttaaacgtaaggtacggttaacggtactttcgggtagggttacggaaccgggtaccgtacttacccaacgtcctactaccggaacgaacgaaaccgaaccgtaacgaaacgtacgtacctaagttgtaacttccgaagtaaactaaaggtaacctaaacggtctaaccggtggaacccgggtacggacccggttaacgggggaaccctccgggttaacgtaatttaacccggttaccttacgggacggttcggtaaacggggtaacccgttacgacccgttttaaacccgtaggtttaacccccgtttaccgttttaccccggttttaacgttttaggttccccttaccccgggggg

SEQ ID NO: 45757 - DNA, 1057 bp, Homo sapiens
  misc_feature: GYAE6OF01AS94L.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgttgggttttccttgttgtcttattttagaaggtgtccagtgtgaggtgcaacgtggtggtattcgtgggaggtaggtggtggtccaggtccgtaggaacgtaactcccgtaggacgtaccttccgttccgtggtcgaccgtacgtcccgttacgttacgggtaactttcccgttaaaccgtttttaagggtttaacggtttttaagtttaggggtaacgttacgggtaaccggttccggggtttaccgggggttcccccgaacccgtaaccggtaacccggtacccgggaaaacggggggggtaacgggggtaccgttacggggggtaaccggttttccggggtaccgggaaaacccctaaaaaccggttaaaaaccgttaaaaaccccggaaaaaggttaacgggttaaaacgggggggtaaaaaaacggggttaaaaaaaacgtaaaaaacccggttttaacgggttaacgggttaaccgggtaaacccggttttaccgggtaacgggttaaacgggggtaaaacccggggtaccccggtttaaaccgttttaaccccgaaaccgtttaacccgttaacccgttacccggaaaagggtaacccggaaaaccccgtaaacccggaaacccgaaaaacgggttaacccggtaacccttaacggttacggttaaaccttacccggtaagaaaacccgtttaaaagaacccggaaacgtaaccgttacccgggaaaggaaccggggtaacccggggtaaccgaaacggggtaacccctacgggttaacgtttacgaaaccgttttaccggaacgttgggtaaccgacgggtaaacggtacttaacccgtcccgttaaaggttcctttacccggtttacgtttaccggtttacgtccgtttaccgggg

SEQ ID NO: 45758 - DNA, 693 bp, Homo sapiens
  misc_feature: GYAE6OF01CWKSO.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctggttttccttgtgcttatttagaagtgtccagtgtgaggtgcaacgtgggtggattcgtgggaggaggtgtggtccagccgtggagaactccctgagactctcctgtgcagcctcgtggtattctaccgttttagtagtttatggattggagtcgtgggtcccgccaacgtacctaccggaaggggtaacgggcttagggtaggttccgtcgggaaccaaaacgaaacttaaaaaccgaaaggtaagtaaggggaaaggtaaaaaaacgaaaaacttagtacggtaggtaaccttcgttacggaacggaaacgggtccctaagttaccaaccaattccaccaaggaacgaaacgaacgaccaaaagaacgtaccaacgtgtacgttacagtaacaaacgtagaaaccgtacggacctggaacgaacgtacccggaagaaccggtacggcttagtaactaaccgttactggtccggaggtaacgaagttaccgtaccgttaacgtccgtaactttcccgttacgttttaacgacgtttcccgg

SEQ ID NO: 45759 - DNA, 905 bp, Homo sapiens
  misc_feature: GYAE6OF01CKXZU.27.57.F02.1.454.CMB.1.raw
tcagagcgtcgtctcacgaccggtgctcgatttagctcgatatagttgggtttgaggtctcagagaggagccttagccctggactccaaggtcctttccacttggtgatcagcacggagcacagacggacccacatggaacgtgggctgagtcgttgggtttttccttgttgtcttattttagaaggttcgtccagtgtgaggtgacaacgtggtggtattcgtgggaggtaggttggtcggtaccaggtccgtagggaacgtaacctcccgttaggaacgtaccttccgttcccgttggtcgaccgacgtcccttcggttaggtaccttttaccgtttaaccgtttttaaggtttagttttaaggtttagggtagtaggtacggttccgggttccggggtccccgaccgtaacggtacccggttaccggggaaagggggggtaacggggtccgtttaggggttaccgggtttaccgggtaccggaaaccccaaaaacgttaaaaccgtaaaaaaccggtaaggtaaacgggtttaaaaggggtaaaaaacggggttaaaaaaacgttaaaaccgtttacggttaacggggttaacggttaacctttccgggttaaagggttaacgggggtaaacccgggtaccgtttaaacttaccccgaacccgtttaaccgttacccgtaaccggaacgtaaaccggaaaccccgtaaccggaaccgtaaaagtaccgtacctaacgttacgttacttacgtaacgtaaaccgtaagtacgacgtacggtacgtaggaacggtaccgtaccggaacgtaccgtacggtacttagttaaccgttacgtagttacgggcgtacgagttacgtaccgtactacgttactaccgtttgttacgtttcagttcccgg

SEQ ID NO: 45760 - DNA, 834 bp, Homo sapiens
  misc_feature: GYAE6OF01CFPD7.27.57.F02.1.454.CMB.1.raw
  modified_base (222)..(222): a, c, t, g, unknown or other
  misc_feature (222)..(222): n is a, c, g, or t
  modified_base (822)..(822): a, c, t, g, unknown or other
  misc_feature (822)..(822): n is a, c, g, or t
tcagagcgtcgtctcacgaccggtgctcgatttagctcgatatagttgggtttgacggtctcagagaggagccttagccctggactccgaaggcctttccacttggtgatcagcacggaggacagaggacccaccatcggaacgtggggctggagcgttgggttttccttgttgcttattttagaaggtgtcctagtgtgaggtgcaacgtggtgtattcgnggagggtaggtgtcggtccaggccgtggaagaactcccctaggacgtactcctccgtggtacgcctacggtcccgttcgtcggttactttccttaaccgtttttaaggttaacgtttagttgggtagttcggtacggtccggttcggggtccccaccgtacggtaacccgttccgggaagggggtaacgggggtcgttacggggtacggtttccgggacggtaacccaaaagtaaaccgtaaaaacccgaaaggtaaggtaaacggggaaaacggttaaaaacgtaaaaaccgttaggtacgggtaaccgggtaaccttcggtacgggtaacggggaaacccggggtccctaaacgtttaccccaacccgtaactttcccgtaaacccggaaggtaaccggaaaccccgtaaaccggaaacccaaaagggtaaccgtacctaccgttaggtaactccgtaagaacccaaaagtccggaaaacgtcggccgttaagggaccgacggtcccggaaggaccgtacgtacgtacgtaactaccgttagtaccggtggaaccgtagtagtccctacgttagtcctacggtttcccttagtttcgngttcggtacggg

SEQ ID NO: 45761 - DNA, 785 bp, Homo sapiens
  misc_feature: GYAE6OF01AJ538.27.57.F02.1.454.CMB.1.raw
  modified_base (213)..(213): a, c, t, g, unknown or other
  misc_feature (213)..(213): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaagtggtgattcgnggaggaggtgtgtccagccgtggacgaactcccgtgacgacctctccgtgtcgcacgcctcgtaggtacttcctacttttagtagtttatggatgaggtcggtcgggtcccgccacggtaccgtaccgggaagggggacggggtcgtggggtacgttccggtacggtaacccaaaacgtaacaaaacccgtaaggtaacgttaagggtaaaacgggtaaaaacgtaaaacgttagttaggtacggtaaccttggtacgggttaacgggaaacgggtacccttaacgttaacccgaaccctacttacccgtaaccgaacggaaccggtaaacccaaaccccggaacccgtaaaaggtaaccgtaacccgtaacgtttacgtacgttacgtaacgaaacgttaaaagtaccgaaacgtaccgaccgtaggaaacgggtaccgggaacgggtaaccggaaccggtaccgtccgttaagttacccgtaaccgttcgtagggtacccgaggtaaacgaccgttctaacttacggtacccttacggttttaccccttagttttccgcggttacccggg

SEQ ID NO: 45762 - DNA, 867 bp, Homo sapiens
  misc_feature: GYAE6OF01DTYS8.27.57.F02.1.454.CMB.1.raw
  modified_base (746)..(746): a, c, t, g, unknown or other
  misc_feature (746)..(746): n is a, c, g, or t
tcagagcgtcgtctcacgaccggtgctcgatttagctcgatatagttgggtttgaggtctcagagaggagccttagccctggacctccaaggcctttccacttggtgatcagcacggagcacagaggacccaccatggaactgggctgagctgggttttcctgttgctatttagaaggtgtccagtgtgaggtgcaactgggtggtatttcgtgggagggtaggtgtcgggtccaaggcctgggagaactcccgtagagacctctcctgtcgcaggtcctcgtaggtactttacgtaccgtttttaagtacgtttaagttggtactaggtaggtccgtcgggggtccccgaccaaggtacccgtacccgggaagggggtaaacggggtcgtggggtaacgtttcgggtaccgggaaccctaaacgtaaacgttaaaacccgaaaggtaacggttaacgggggtaaaaacggtaaaaagtaaaaaaccggttagtaacgggttacggtaacccgtttacgggttacggtaacgggtaaacgggggtacccttaacggtttaacccaacccgttaacgttcccgtaacccgtaagggaaaccgtaacccgtaaaccggtaaccaaaacgggtaaacgttacctaaccgttaggtaacgttacgtaacgtaactaaaagtaacgggtaaaccctaggaaccccttagggaaccggacgggtaaccccgaagggtaccgtaacccgggtntaacggtttacaaaccggtttcgttagggtaccgaaggtaaaggtacgtaaccccgtttaccgtaaacggttccgtttaaccgttttaccgggtttccttttaaaggtccccgttaacggg

SEQ ID NO: 45763 - DNA, 713 bp, Homo sapiens
  misc_feature: GYAE6OF01D2ULA.27.57.F02.1.454.CMB.1.raw
  modified_base (184)..(184): a, c, t, g, unknown or other
  misc_feature (184)..(184): n is a, c, g, or t
tcagagcgtcgtctcacgaccggtgctcgatttagctcgatatagttgggtttgaggtctcagagaggagccttagccctggacctccaaggccctttccacttggtgatcagcacggagcacagagacccaccatggaacgtgggctgagcttgggttttccttgttgcttattttagaggtntccagtgtgagtgcaacgtggtgattcgtggaggtaggtgtcggtccagtccgtggagtaactcccgtgagtacctctccgtgtgccacgccttcgtcggtacttccttaaccgtttaagttaagtttagttaggatggtacgtccgtcggggtacccgccgacgtaccgtaccggaaggggacggggtcgtgggacgttccggtacggacccaaacaactaaaccgaagagtaaggaaagtaaaagaaactagtgtacgtactgtacgtaggaacgggtccctaacgttaccaaccgtacttcccgaacgtaacgaacgaaccgaaacccgacgaaaacgtaacgtacctaacgttgtaactcgtaacgaactaaagtacgaacgtaacgaccgtaacggaacggtaccggaccggtaaccggacaccgggtacttaagtacgttaaccgttacgtacggtcggaacgtagtacgtaaccgttcctaagttccttaacgtttccctttcggtttacgtcggttacccg

SEQ ID NO: 45764 - DNA, 654 bp, Homo sapiens
  misc_feature: GYAE6OF01DBJQS.27.57.F02.1.454.CMB.1.raw
  modified_base (219)..(219): a, c, t, g, unknown or other
  misc_feature (219)..(219): n is a, c, g, or t
  modified_base (426)..(426): a, c, t, g, unknown or other
  misc_feature (426)..(426): n is a, c, g, or t
tcagagcgtcgtctcacgaccggtgctcgatttagctcgatatagttgggtttgaggtctcagagaggagccttagccctggactccaaggccctttccacttggtgatcagcacggagcacagaggacccacatggaactgtggctgagcgttgggttttccttgttgcttattttaggaaggtgtccagtgtggaggtgctaacgtgggtgattcgnggaggaggtgtcggtccagccgtggagaactcccgtagacgactctccgtgtcgctacgtcctcgttcggtactttccgtaccttttaggttagtttagttgggtatggacggtccggtcgggtcccgacgacgtaccgtccggaggggacgggtcgtgggtacgttcgacggaccaaagaactaaacaagtagaggaaaggtaaanaaacgtgtgtagtactgtggtaggacggcgactcacactcacgagaacgacgaaccgacaagtacgtacacttagtacgttcgtagaactaagtacgaacacgtaccgaggtacgacggaccgaacggactaccggtaacgttataaccgttacgtacgtaggtacggacggtaagaacgttactacccgttacgttaccttaccgtttcccgttgttttggtacccg

SEQ ID NO: 45765 - DNA, 904 bp, Homo sapiens
  misc_feature: GYAE6OF01B75VQ.27.57.F02.1.454.CMB.1.raw
  modified_base (324)..(324): a, c, t, g, unknown or other
  misc_feature (324)..(324): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaacgtggtggattctggaggaggtgtggtccagccgtggagaactcccgtgacgactctccgtgtgcacgcctcgtggtacttcctaccgtttagtagtttattggatggacgtcgtcggggtccnccgagacctacggaaggggaacgggtctagggtacgtttcggtacggaccctaaaacgaacgtaaaaccgaaaggtaagtaacggggtaaaagggttaaaaaacgaaaaacgtttacgtagggttaaccggtacttaccggtagggtaacgggtaaaccggggtacccgtaagtttacccgaaacccgttacttacccgttaaccgaaagggaaaccgtaaaccccggtaaaacccggtaacccgtaaaaagggttaacccggttaccctaaaccggttttaacggttaaaccgttacccggttaaacgggtaaacccttaaaacggttaccggtaaaacccgtacgggtaaccccttaaggggaaccgggtaaacccggggaacccggggttaaaacggaacccggtacccgggggttaactttaaacgggttaaccgtttaaacccgttaaccgggtttagggtaacgggaaccgggtaaacgggtaacttacccgttaaaccccgttaaacggtttaccgtttaacccgttttacccggttttaccggtttttaagggtcccgtttaaccccggggg

SEQ ID NO: 45766 - DNA, 694 bp, Homo sapiens
  misc_feature: GYAE6OF01ECZQL.27.57.F02.1.454.CMB.1.raw
  modified_base (198)..(198): a, c, t, g, unknown or other
  misc_feature (198)..(198): n is a, c, g, or t
  modified_base (577)..(577): a, c, t, g, unknown or other
  misc_feature (577)..(577): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcttgggttttcctgttgcttattttagaaggtgtccagtgtgaggtncaacgtggtggattcgtgggaggtaggtgtcggtccagccgtgggaacgaactcccgtaggacgtaccttccgtccgttgtcgcacgtcccttcgtggtacttctaccgttttaagtagtttaagttggtactgacgcgtcgggtcccaccgacggaccgtaccggaaggggaacgggtcttagggaacggttccgggtacggaaccctaaaacgaaacgtaaaaacccggaaaaggtaggttaacggggaaaaggttaaaaaacgaaaaaccgtttagtaacgggtacggtaaccttcggtaggtaacggaacgggtactacgttaccacgtacttccgacgagaacgacgaacgacaagtactctaatcgactcganaactaatcgaacgtcgactaggagacggacgaacggactacggtctaagtactaactctggcgtaagcggaagtacctacggttataccctagtttaccctgtttagtctacccggg

SEQ ID NO: 45767 - DNA, 907 bp, Homo sapiens
  misc_feature: GYAE6OF01BK15H.27.57.F02.1.454.CMB.1.raw
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
  modified_base (894)..(894): a, c, t, g, unknown or other
  misc_feature (894)..(894): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactgggggctgagtcttggggttttccttgttgcttattttagaggtgtccagtgtgaggtgcaactggtggattcgtgggaggaggtgtggtccagtcctgganaactcccgtgagacttctcctggtcncgacgtccttcgtcggtatttccctaccgtttttaagttaagtttagttagggtaatcggtaagtccggtttcgggggttccccgaccgtaacggacccgttacccggaagggggggtaaacggggtccggttaaggggtggttttacccgggtaccggggacccctaaaaccgtaaaaccgttaaaaaaccccgaaaagggtaacgggtttaaaggggaaaaacggggtttaaaaaaacggtaaaaaaccgtttaggtttaacggggttaacgggtaaccctttaccggttagggtttacggggaaaccggggggtaccttacggtttaccccaaccgtacttaccctaaccgaaggtaaaccggaaacccgtaaacccggtaacccgtaaaagggtaaaccgttccgtaaaccgtttaaggtttacctacgttaacggtaacctaaaacgtaccggtaaacgacgtaaccccgttaggaacggtaccgggaaccggaacgggtaaccgtccgggttacttacggttaactaaccgtttaacggttaccggtcggaaacggttacggtaacggtaccttaccggttaacgttcccttagttttacccccgtgtttttaaccgngtttaccccgggg

SEQ ID NO: 45768 - DNA, 831 bp, Homo sapiens
  misc_feature: GYAE6OF01AYSMV.27.57.F02.1.454.CMB.1.raw
  modified_base (149)..(149): a, c, t, g, unknown or other
  misc_feature (149)..(149): n is a, c, g, or t
  modified_base (167)..(167): a, c, t, g, unknown or other
  misc_feature (167)..(167): n is a, c, g, or t
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
  modified_base (308)..(308): a, c, t, g, unknown or other
  misc_feature (308)..(308): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactgggctganctgggttttccttgttgntattttagaaggtgtccagtgtgaggtncaacgtggtgtattcgtggagggaggtgtcggtccagccgtgggaanaacgtccctggacgtactctccgtgtnacgacgccttcgtggtacttctacctttaggtaagtttnttggatggacgccggttcgggtcccactacgtaccgtccggaagggggtaacggggcttgggtaacggtttcggacgggtaacccaaactaaacggttaaaaaccccggaggtaagttaagggggtaaaaacggggttaaaaaaacgtaaaacttacgttagggtaccggggtaacccttgttagggtaaaccggggggtaaacgggtaaccctaaccgttacctaaacccggtaactaccccgtttaaccggaagtaaaccggaaacccggtaaacccgtaacccgtaaaagggtaaaccgtacgttaacgtagttaacgttaccgacgttaaacgtaaagtaacgtaaccgtaccggtactacgggtaaagacccgggtaaaccggaacgggaacgtccgggtaacttaacgttaagttaaacccggttaacgtaccgggtggaccgaagggtactaacgttacccgttgtaaaccggtttaccgtttaaccggttgtttttccggaacgtttacccgggg

SEQ ID NO: 45769 - DNA, 829 bp, Homo sapiens
  misc_feature: GYAE6OF01CWF5Q.27.57.F02.1.454.CMB.1.raw
  modified_base (266)..(266): a, c, t, g, unknown or other
  misc_feature (266)..(266): n is a, c, g, or t
tcagagcgtcgtctcacgaccggtgctcgatttagctcgatatagttgggtttgaggtctcagagaggagccttagccctggactccaagggcctttccacttggtgatcagcacggagcacagacggacccaccatggaacgtggggctggagcttgggttttccttggttgcttattttagaggtgtccagtgtgaggtgcaacgtggtggattcgtgggaggaggtgtggtccagcctggagaatccctgacgcctctcctgngcacgcctcgtggtacttcctacctttaggtacgtttagtggatggagtcgtcgggtccgacaggtacctaccggaagggggaacgggtccgttagggtacggtttcggtacggaacccctaaacaacgttaaaacccgaaggtaacggtaaggggtaaaacgggtaaaaacgtaaaacgttaggtaggtagggtaaccttcggttagggtaacggtaacggggtaccctaacgtttacccgaaaccttaacgttcccgttaaccgaacggaaacgaaacctaaacccggaaccgaaaaaggtaccggttacctaaccggttagttaaccgtcgtaacgtaacgtaaacgttaacgaaccgtacggtacccggttacggaacgggaccgggtaacccgggaagggtaaccccggtacgggttaccgtttaacggttaacgttaaaccccgtttgggttacggtaacgggacccggtaaagggtaaccgttaaaccggtttccccgttaaacgtacccgtttaaccgtttcccggttttacgtttacggaacccgtttaccggg

SEQ ID NO: 45770 - DNA, 710 bp, Homo sapiens
  misc_feature: GYAE6OF01DLYU7.27.57.F02.1.454.CMB.1.raw
  modified_base (118)..(118): a, c, t, g, unknown or other
  misc_feature (118)..(118): n is a, c, g, or t
  modified_base (282)..(282): a, c, t, g, unknown or other
  misc_feature (282)..(282): n is a, c, g, or t
tcagagcgtcgtctcacgaccggtgctcgatttagctcgatatagttgggtttgaggtctcagagaggagccttagccctggactccaaggcctttccacttggtgatcagcacggancacagacggacccaccatggaacgtgggctgagtcgttgggtttttccttgttgtcttattttaagaggtgtccaggtgtgaggtgcaactgggtgtattcgtggaggtaggtggtcggtccagccgtggaacgtaacctcccgtgaacgtcctctccgtgtcncgacgtccctgtcgtacttaccgttaccgtttagttagtttgtaggtatggacggtcgtcgggccctacgacgtaccgtacgggaaggggtacgggtcgtgggtacgtcgtacgacaaactaactaaacgagtagtaaggtaaagtaaaacaaacgtagtggtagtactgtacggtaaggacggtcgtacttaccacgtactacgacctaagacgaaaccgaccgaacgaagtacgtacagttcgtaactcaacgtacaaacgtacaacgtaacgcgtaagaaccggaacggaccggtacgaaccgtacggtacgttacgttaactaccggttagtaacgggtcgtagggaagttcccgttaacgttccgttaacccgttactttaacccggtttacctttacggttttaccgaccggttacccgggg

SEQ ID NO: 45771 - DNA, 790 bp, Homo sapiens
  misc_feature: GYAE6OF01DG2NP.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaactgggctgagctgggttttccttgttgctattttagagtgtccagtgtgaggtgcaacgtggtggattcgtaggaggtaggtcgtcggtccaggtcccgtaggacgtaaccttccccgtagaacgtaccttccgtcctggtcgacctacggtcccttcgtggttaactttaccgtaaccctttttaaggttaacgtttagttagggaatggacgtccggtcggggttacccgacccgtaaggacccgttaccgggaagggggtaacggggtcttacggggtaacgtttccggacggaaccctaaaacgaaactaaaccgaaggtagttacggggaaaacggttaaaaacgtaaaacttagttggtaacggtaccttgttagggtacgggaaaccggggttcctaacgtttcccaacccgtatcccgttaaccgaagaacgaacccaaccggaaccgtaaaggtacgtaccgtacgttacgttactacgtacgtaacgtaacgtacgaaccgtacggtacctaggaacggacgacccgggaaggacccgacgggtacgtacgttaacgtacgtacgtggtagtaaccgggacgtaaggtaccgtaccgttaggtaccttacggttacccttagttttacgacctttaccgg

SEQ ID NO: 45772 - DNA, 778 bp, Homo sapiens
  misc_feature: GYAE6OF01CYIYK.27.57.F02.1.454.CMB.1.raw
tcagagcgtcgtctcacgaccggtgctcgatttagctcgatatagttgggtttgaggtctcagagaggagccttagccctggactccaaggtcctttccacttggtgatcagcacggagcacagacggacccacatggaacgtgggctgagtcgttgggttttccttgttgtcttagttttaagaaggtgtccgagtgtggaggtgctaacgtggtggtattcgtggaggtggtgtcggtccaggccgtaggtaacgaacttcccgtaggaagtaccttccttccgtggtacgcgtacgccttcgtacggtacttacttaccgtttaagttagttagttaggtagtaggaggtcggtcggtccggtaccgacgaccgtaccggaacggggtaacgggtaggtacgggtacggtcggtacggaaccgtaaaacgtaaacgtaaaaccgtaaaggtaaggtaaggggtaaaaggtaaaaacgtaacgttaaaaaaaaaggttcggtaacggtacgttacggttaggtaacggtaacggtaaccggtacgtaaccgtacctaacgtaccgtaaccgacgaaacgaacgaaaccgaacgaaacggtaacactacgtacgtactacgtaagtaactaacgtaacgtaacgaccgtacgtacggtaggaccggacggaacggacgtacgtacgttaacgtaacgtaacgttacctaggtcgtacggtaacgtacgtacttaccgtacgttacgttacttacgtttactttacgtacgttaccgg

SEQ ID NO: 45773 - DNA, 600 bp, Homo sapiens
  misc_feature: GYAE6OF01AUVMD.27.57.F02.1.454.CMB.1.raw
  modified_base (311)..(311): a, c, t, g, unknown or other
  misc_feature (311)..(311): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
tcagagcgtcgtctcacgaccggtgctcgatttagctcgatatagttgggtttgaggtctcagagaggagtccttagccctggactccaaggcctttccacttggtgatcagcacggagcacagaggacccaccatggaactggggctgagctgggttttcctgttgctattttagaaggtgtccagtgtgaggtgcaactggtggattctgggaggtaggtggtcggtccaggcctggagaatccctgacgactctcctgtgcagcctctggattccactttagtagttattggatgagcgtgggtcccnccagacgtccgaaggggaacgggctgggagttcgtggaccaacactaaaccaaggagtagggaagtaaacgaaactgtggngactgtggtagagggccatccacntcncaagagaaacncaagaagtcactgtactctagaacctaaatacgaacacgtaccgtaggaacggacgcccggtaaggacctacgggtacctagggtaactaccgttacgtggtacggacggtagaggtaaccttcccgtaaggtcctaacttttcccgtcttttggattccccggttaggg

SEQ ID NO: 45774 - DNA, 883 bp, Homo sapiens
  misc_feature: GYAE6OF01DKVN3.27.57.F02.1.454.CMB.1.raw
tcagagcgtcgtctcacgaccggtgctcgatttagctcgatatagttgggtttgaggtctcagagaggagccttagccctggactccaaggtcctttccacttggtgatcagcacggagcacagacggacccacatggaacgtgggctgagtcgttcgggttttccttgttgtacttagttttaggaaggttcgtacctagtgtaggaggtgacgtaacgtggtagtattcgtagggacggtaggttggtcggtaccaggtcccgtagggaacgtaacgtccccgtaggaaccgtccgttccgtaccgttggtcgaccgtacggtccgttcgtacggttactttaaccgttaaccgttttaggttacgtttacggttaggtaacgtcggtaacggtccgggttaccggtacccggtaccgtaacggtaacccggttaccggggaaacggggggtaacggggtcgtttacggggttacgggttaccggtacggtaaaacccgtaaaccgtaaaaccgtaaaaccgtaaaggtacggttaaaggggtaaaaacggtaaaacgtaaaaaccgtttggttaccggtaacggtaaccgttcggtaacggttaaccgggaaccgggtaccttaacgttccaaaccgttaacctcccgtaacgaacggtaaacgaaccccttaaacggaacctaaacggtaacctacgtaacgttagtaccgttacgacgtaactaaacgtacgaacgaccgtacgtacggaacgtcgggaaccgtacgtacggtacgacgtttaaacgtcgttacgtacgtacgggtaacgagtaacggttcgaccgttaacgttacggttcccgttacgttaccgtttacgttagtcccgttaacggg

SEQ ID NO: 45775 - DNA, 773 bp, Homo sapiens
  misc_feature: GYAE6OF01DG8PI.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaacgtgggctgagtcttgggttttccttgttgcttattttagaaggtgtccagtgtgaggtgcaacgtggtgtattcgaggaggtaggtgtggtccagccgtaggacgtaactccctagacgtactcctcctgtgccacgtcctctggtacttactaaccttttaggttaacgttagttaggtatggacgtcggttcgggtcccaccgacgtaccgtaccgggaaggggaacggggtcgtagggtacgttcggtacggtaaccccaaactaaacgtaaaaccgaaaggtaacggtaaagggtaaaaacggtaaaaagtaaaaacgtaaggtcggtaagggtaacttcggttaggtaacgggtaacgggtacccgtaacttaccgaaccgtaacttcccgaccgtaaagaacccgtaaaccgaaaccgaacccaaaggtaaccgttacgtaacgttcgtaaacttcgtaagaaacgtaaacgtacgaacgtacgtacgtagaacggaacgtaccggacggaacggtaccgtacgttaacgtactaaccgttacgtaggtacggaggaaacggtattacccgttacgttaacttaccgttacgtttccggttttaccgttttaggtcccgtttaccggg

SEQ ID NO: 45776 - DNA, 842 bp, Homo sapiens
  misc_feature: GYAE6OF01EYB2C.27.57.F02.1.454.CMB.1.raw
tcagagcgtcgtctcacgaccggtgctcgatttagctcgatatagttgggtttgaggtctcagagaggagccttagccctggacctccaaggcctttccacgttggtgatcagcacggagcacagacggacccaccagtggaacgtgggctgagtcgttggttttccttgttgtcttagttttggaaggtgtcgagttgaggaggtgacaacgtgggtacgtagttcgtggggaggtaggtggttcgtaccgacggtccgtaggaagtaacctcccgtagaacgtccttcgtcccgtgtcgaccgacgtccttcgtaggtacctttccttaaccgtttgtagttaagttggatggagtcggtcggtccaccgacgtaccgacggaaggggcggtagtcgggtcggttgaccgactaaacgtaaacgtaaccgaaagtggtaaacgggaaaggttaaaaacgtaaaagtggttacggtagtaaccgttggtaacgggtacggtaaacgggtaccctacggttaacccaccgtaacgttacccgtaacgaaacgaacccgaaacccgaaaccgaaaccgtaaacggtaaccgttaactacggtttaaccgtaaacgttcccggtaaccgaaaacgttaaacggtacgaaaccggttccgtaaacgtacgggaacgggtaacccggaacgggtaaacgaaccccggttacggtaacggtttaacgttaaaccgttcccggttaaacggtggtaaccgggaggttaacgtaaacggttaccttacccgggttattaaccccccggttgttttacccccttaggttttaacgcccgttaaccccggg

SEQ ID NO: 45777 - DNA, 891 bp, Homo sapiens
  misc_feature: GYAE6OF01CR7Y0.27.57.F02.1.454.CMB.1.raw
tcagagcgtcgtctcacgaccggtgctcgatttagctcgatatagtttgggtttggaggtcctcagacgaggagtcccttagccctggtacctccaaggtcctttccacttggtgatcagcacgagcacgagacgacccaccagtggaacgtgggcgtgagtcgttcgggtttttccgttgttagtcttagttttaagtaaggttgtccgtaggtgtggaggtcgacgtaagttgggtggtagtttccggagggtaggtacggttgtcgggtacccgtaggtcccgttaggaagaaaccgttccccgtagtaacggttacctccgttccgttggtagacctacgtccgttaccgtaggttacgttacctttaaccgtttaggttaacgttacgtttaggtatacggtacgtccggtaccggggtaccccacgggtaaccggtcccgtacggggtagggggtaacggggttcctagggttacggttaccggtacggaacccctaacggtaaacttaaacccggaaggtaaccggtaaaggggtaaaacggtaaaaacggtaaacgttaggtacgggttacggtaaccgttcggtagggttaaccggaccgggttacctaacgtttcccaccgtaacgtcctaaccggaagaacggaaaccctaaaccggaactaaacgggtactaccgacgtttagttacgtacgtaacgtaacgaaacgttacgaacgtaccgtacggtaacggaaccggtaccgtaccgggaacgtaccggtaccgggtacctagttaacccgttagttacggttagtaccgggacgttaggtaaccgttaccgttacgttaacccgttcgtttaaccggttcccgttttagtccgttacggttacccgg

SEQ ID NO: 45778 - DNA, 759 bp, Homo sapiens
  misc_feature: GYAE6OF01EK6BY.27.57.F02.1.454.CMB.1.raw
  modified_base (120)..(120): a, c, t, g, unknown or other
  misc_feature (120)..(120): n is a, c, g, or t
  modified_base (204)..(204): a, c, t, g, unknown or other
  misc_feature (204)..(204): n is a, c, g, or t
  modified_base (225)..(225): a, c, t, g, unknown or other
  misc_feature (225)..(225): n is a, c, g, or t
tcagagcgtcgtctcacgaccggtgctcgatttagctcgatatagttgggtttgaggtctcagagaggagccttagccctggactccaaggtccctttccacttggtgatcagcacggancacagacgacccacagtggaacgtggggctgagtcgttggttttccttgttgtcttattttaggaggttcgtcagtgtgaggtnactacgtggtaggtattcggngggaggtggttggtcggtccacggtccgtaggactaaccttcccgtaggacgtccttccgttaccgtggtaccgtacgaccgttcccgttacggttacggttacttttacccgtttaacgtttttaaaggttaacggttttaggttacggacgttacgggacggttccggttccggggttaccccaccggtacggtaccggtaccggggaaggggtacgggtcctagggtacgttccgtacgaacctaaacgaactaaacgaagtaggaaggtaaagtaaaacgtacgtagtcggtacgtacttaggtggtaaggaccgtctaactccaacgtactaccgagaacgtaccgaacgaaccgtagaacgtacgtactagtacgtactacaagtaactaagaccgaacgtcgtaccgaaggacgacggtaccggacggtacacggtcgtaactagtcctaggtcggtacgacgtaattccgggtacttaccggttacgtccgtttacgttacccgtttgtttcggacgttcccgggg

SEQ ID NO: 45779 - DNA, 740 bp, Homo sapiens
  misc_feature: GYAE6OF01EEAGE.27.57.F02.1.454.CMB.1.raw
  modified_base (571)..(571): a, c, t, g, unknown or other
  misc_feature (571)..(571): n is a, c, g, or t
  modified_base (578)..(578): a, c, t, g, unknown or other
  misc_feature (578)..(578): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccaatggaactggggctgagctgggttttcctgttgctatttagaggtgtcagtgtgagtgcaatggtggattcgtggaggaggtgtcggtccagcctggagaatcccgtgagactcgtcctgtcgcgagtcctcgtggatttacccgtaaccgtttttaaggtaacgttttaattgggattaggaaggtccgttagggggtccccgtaccgaagggaccgttaccggaaggggggaacgggggttcctaggggtacgtttccgggtacggaaccaaaacgaaactaaaacccgaaaggtaagttaacggggaaaggttaaaacggaaaaacgttagtacggtagtaactcgtaggtacgggaaagggtcctaattccgaactatcctacgagaacgtaacaacgtaccgaaagactctatagtacatcggacctaaagnggaaacncgaccgttagacgtacgaccgggacgaacggtacgacgttacgtaaacgttacccgttagttcggaaccggttaagggaacctaaaggtaacctttaccccggaaagtttcccttaaacggtttttccccggtttaacggtttttcaaccggtttacccggg

SEQ ID NO: 45780 - DNA, 597 bp, Homo sapiens
  misc_feature: GYAE6OF01A04RS.27.57.F02.1.454.CMB.1.raw
  modified_base (463)..(463): a, c, t, g, unknown or other
  misc_feature (463)..(463): n is a, c, g, or t
  modified_base (478)..(478): a, c, t, g, unknown or other
  misc_feature (478)..(478): n is a, c, g, or t
  modified_base (580)..(580): a, c, t, g, unknown or other
  misc_feature (580)..(580): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggacttcctacctttagtagttattggatgagcgtcgggtccgccagactccgaggggaaggggctagggacgttcggcggaccaaacaactaaaccaagagtagggaaggtaaaagaaaactagtagtaggtactgtgtaggacgggccgtactcacatactcaagacgacaacgaccaaagatacacgttgtatcngacaaagtacgaacncgacctaggacgacgaccggaacgacgacggtctagttaactaccgttacgtggtacggacggtaagacgtacttacccgtagtacctacgtttacccggtnttttcggacttaccggg

SEQ ID NO: 45781 - DNA, 715 bp, Homo sapiens
  misc_feature: GYAE6OF01C4IWA.27.57.F02.1.454.CMB.1.raw
  modified_base (118)..(118): a, c, t, g, unknown or other
  misc_feature (118)..(118): n is a, c, g, or t
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (703)..(703): a, c, t, g, unknown or other
  misc_feature (703)..(703): n is a, c, g, or t
tcagagcgtcgtctcacgaccggtgctcgatttagctcgatatagttgggtttgaggtctcagagaggagccttagccctggactccaaggcctttccacttggtgatcagcacggancacagaggacccacatggaactggggctgagcgtggtttctgtagctatttagaaggtgtcagtgtgagtgcaacgtggtgattcnggagaggtcgtggccagcctgganactcctgaagcctctccgtgtgacacgcctcgtgacttcctactttagtattattggattgaggccgtcgggtccacctaggacctaccgaagggggagggccgttagggagttttcggcgaccaaactaacgttaaaaccaagtagtagggtaaaagggtaaaactaaaacgttagtagggtacgtaaccgtcgtttaggacggtaaaacgggtccctaaaggttccaaccgtaactccctaaccgaaggaaacgtaaccgaaacgaacctaaaacgggaatttaccgaacgtttacgtaacgtcctacggaactaaacggtagtaaaccgtaacgaccgttaggaaagtacgaccggaacggtaaaccgcccggggtaattacgttaaacggtactttaaccggaggtacccgaaggtaaggtacggaaaccttccgttaaggttcccttaagggttttccccttaccgtttnacccggttaccg

SEQ ID NO: 45782 - DNA, 836 bp, Homo sapiens
  misc_feature: GYAE6OF01B2C0Q.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcgactggtggattcgtgggaggtaggtggtcggtcccaggtccgtggaagaactccccgtgacgactctcctgtgcagcctcgtggtacttcctaccgtttagtagtttatcggtatggagtcgtcggggtcccgccaaggaccgtaccggaagggggaacggggtcgtaggggtaacggtttccggtacgggaccccaaaactaaacgtaaaaaccccgaaaggtaacgttaagggggaaaacgggttaaaaaacggtaaaaactttaggttacgggttacggtaaccttacggtagggttaacgggaaaccgggggtccccgtaactttacccgaaccctaacgtttaccccttaacccggaaagggtaaaccggaaacccctaaaacccgggaacccctaaaaagggttaaaccgtcctaaaccgtttaggtaacttaccgtacgaaactaaaacttaaaccgacgtaccgtaaggaacggaccggtaacccgggaacgggtaaccgaaccgggtcgttaacgttaaccgttaaacccgttacgtacgggttagaaccgggtaaagtacggtaccgttaccgttacgttaccgttacgtttacccgtttacgttttgaaccgttccggtaccggggg

SEQ ID NO: 45783 - DNA, 815 bp, Homo sapiens
  misc_feature: GYAE6OF01DTARG.27.57.F02.1.454.CMB.1.raw
  modified_base (751)..(751): a, c, t, g, unknown or other
  misc_feature (751)..(751): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagtcgttcggttttccttgttagcttagttttggaaggtgtcagtgtgaggtgctaacgtggtggtattcgtggaggtaggtggtggtcccgaacgtccgtaggacgtaactcccgtagacgtacctccgtcctggtcgcacgtccttcggttaggtacctttaccgttaaccgttttagttaggtttagttggtagttcggtagtccggttcggggtcccgtaccgaacggtacccggttaccggggaaacgggggtaacggggtcggttaacgggtacggttaccgggtaccggaaaccgaaaaccgtaaacgtaaaaacccgaaaggtaagggttaaacgggtaaaaagggttaaaaaccgtaaaacgttaagtacggttaggtaccgttcgtacggtaacggggtaaccgggtaccctaacgtttcccgaactaccgttacccgtaaccgtaaggaaacccgtaacccgaaaccgaaccgtaaaaggtaaccgtaccttaacgttacggttactacgtacgaaactaagacgtaacgaccgtacgtaggaaccgtcggaccgaacgtacggacgttactaccgtactaacgtgttcggngtaacgggattaggaccctttcgacgtttacctacgttttccgtttacgtcgtaccgttacggg

SEQ ID NO: 45784 - DNA, 867 bp, Homo sapiens
  misc_feature: GYAE6OF01A0J45.27.57.F02.1.454.CMB.1.raw
tcagagcgtcgtctcacgaccggtgctcgatttagctcgatatagttgggtttgaggtctcagagaggagcccttagccctggactccaaggcctttccacttggtgatcagcacggagcacagacggacccaccatggaactggggctgagctggtttcctgttgcttattttagaggtgtcagtgtgaggtgcaacgtggtggattcgtgggaggaggtgtcggtccaggcctggaagaactcccgtagagtacctctccgtggtcgacacgcccttcgtaggtactttacctaaccctttttaaggttaagttttagttgggattaggacggtccggtttcgggggtccccgaccgtaacggaccctaccgggaacgggggaacggggtccttagggtacggtttaccgggtacggaaacccctaaacgtaaacttaaaaaccccggaaaggtaacggttaacgggggtaaaaacggttaaaaaacgtaaaaaccgtttaggttacgggttaacgggtaacctttaccgggttagggttaacggggaaacgggtcccggttaactttacccgaacccgttacgttacccgtaacccgaaaggaaaccggtaaacccaaaccggaacctaaaaaggtaaccgttaccgtaacgttacggtaactacgtacgaactaaagtacgaactcgggtacctaagggaacgtaccggaaccgggaaggtaacccgtacgggtactttaggtaaaccttacggttaacccggtaggttacgggaaacgtacggtaacgttaaccgttacccgttagggttaaccctttaacgggttttccccgtttaaagttttcggtaacgtttacccggg

SEQ ID NO: 45785 - DNA, 870 bp, Homo sapiens
  misc_feature: GYAE6OF01EVMKA.27.57.F02.1.454.CMB.1.raw
  modified_base (235)..(235): a, c, t, g, unknown or other
  misc_feature (235)..(235): n is a, c, g, or t
tcagagcgtcgtctcacgaccggtgctcgatttagctcgatatagttgggtttgaggtctcagagaggagccttagccctggactccaaggtcctttccacttggtgatcagcacggagcacagacggaccccacatggaacgtggggctgagtcgttgggttttcctggttgtcttagttttaggaaggttcgtccagtggtggaggtagacctaacgttgggtggactttcgnggggacggtaggtggtcggtcccaacggtcccgtgggtaacgtaaccgttccccgtagacgttacccttcgtcccgttaggtcgccgacgtccctcgttacggtacttaccttaaccttttaaggttagtttacgttagggtaattgggacggtcggtccggggtcccaccgtaaccggaccggtaccgggaacgggggtacggggtcgtagggttacgggtttaccggcggtaaaccccaaacgtaaaacgtaaaaccgaaggtaacggtaaggggtaaaaggttaaaaacggtaaacgtttaacgttacgggtagggtaaccctttacggtacgggttaaacggggtaaccgggtaacccgtaacgttacccgaaccctaaccgtttacccgaacccggaacgggtaaaccgaacccgtaaaacccggaaccgtaaaggtaaccggttacccttaacgttacgttaccgtacgtaacgtaacgtaaacgtaaccgaagtcccgtaagtacgggaacgacggtacccggaaggaacccggcggtaactacggttaacgtaccgtacgttggaccgtaggacgttagcccttaccgtcgttaccttacgttccctttcgtttagcgtttacccgg

SEQ ID NO: 45786 - DNA, 872 bp, Homo sapiens
  misc_feature: GYAE6OF01DILG5.27.57.F02.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (853)..(853): a, c, t, g, unknown or other
  misc_feature (853)..(853): n is a, c, g, or t
tcagagcgtcgtctcacgaccggtgctcgatttagctcgatatagttgggtttgaggtctcagagaggagccttagccctggacctccaaggcctttccacttggtgatcagcacggagcacagacggacccaccatggaacgtgggctgagtcttgggtttttccttgttgcttaattttagagtgtccagtgtgaggtnacaacgtggtgtattcgngggaggtaggttggtcggtcccgaggcccgtaggaacgaacgttccccgtaggaaccgtacctcgtaccagttggtcaccgacgtcccgtcgttaggtaactttccttaacgttttagttaacgtttagttaggattggacgtcgtacgggtcccacgacgtacctccggaaggggacgggtctaggtacgttccgacgacctaaacgaactaaacgaagagtaacgggaaaggttaaaagaaaacgttcgtaggtacggtacgtttcgtaaggtaggaaaccgggtccgtttaactaccccggtaacctcttaaccgtaacccggaaacggtaaacggaaacccctaaacgggtaaacccgggtaaaagttaaccgtttaccggtaaacgtttacgttaaccgtaccggtttaaacgaaaccgtaaaacggttaacggtaaaccccccggtaaggttcccccggaaagggaaccgggttacccggggaaccggtaaaccgggaccccgttaccgggtaacgtttaaccggtacccctttaaagggttcccgtaaggggtaaccgaacggggtaaacaccggtttaaaccccgtttcccgttaaagttttcccttcccgtttttaacccggttntttttaacccggggacccg

SEQ ID NO: 45787 - DNA, 926 bp, Homo sapiens
  misc_feature: GYAE6OF01DC8C0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttccttgttgcttattttagagtgtccagtgtgaggtgcaactggtggattctgggaggagggtgtgggtcccagccctgggaagtaactccctagacgtactctcctgtgcacgcccttgtaggtactttccgtaacctttaaggttagtttagtttaggattggagtcgtacggggttccgccaaggtacccgtaccggaagggggtaaggggccgtagggtacggttttcggcgggaaccccaaacgtaaactaaaaaccgaaggtaagttaggggaaaagggttaaaaacgaaaaactttagttagggtacggtaaccttcggttaggtacggaaaacggggtcccgtaatttacccgaacccttaacgtcccgttaacccaagggtaaacgaaacccgtaaaccgaaacccgaaaaggtaaccgttaccgaacgttacggttaaatcccgttaacggtaaactaaaacgttacggaaaacccgtaaacggttaccccgtaacgggaaacgggtaaccccgggtaccccggggaaaacgggggtaaccccggtaaccgggggttaccgttttaaaccggttaaaaccgtttaaaccccgggttaaaccgttccgggtttaaacggggggtaaccgaaacgggggttaaaagtaaccccgggttttaaacccccgttaaacggttttaaccccggttttaaaccggttttcccccccggggtttttaaccttttttaaacgggttcccgtttttaaaccccggggg

SEQ ID NO: 45788 - DNA, 636 bp, Homo sapiens
  misc_feature: GYAE6OF01C8XM1.27.57.F02.1.454.CMB.1.raw
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (488)..(488): a, c, t, g, unknown or other
  misc_feature (488)..(488): n is a, c, g, or t
  modified_base (561)..(561): a, c, t, g, unknown or other
  misc_feature (561)..(561): n is a, c, g, or t
tcagagcgtcgtctcacgaccggtgctcgatttagctcgatatagtttgggtttgaggtctcagagaggagccttagccctggactccaaggccttttccacttggtgatcagcacggagcacagaggacccacatggaactgggctgagcgtggtttcgtgtagctatttagaaggtgtcagtntgagtnacacgtggtgattcgnggaggtaggttcgtgggtacccagcccgtaggactaaactcccgtagagtacctcttccgtggacgaccacgaccctcgtaggtactttacccttaacgtttagttaacgttagttggaattcgacggtccgttacggggtcccaccgaagcccgtacggaggggaagggctaggtcgttggtcgaacccaataacaaaaccgagtaaggtagggaaagtaaaacgaaaacttgtcggagtaacctgttaggaggacggacctatcaactagtctacaganaccaacacgaaagctactacgtatacgctacgaataagcgaactcgacagaacgcgcggtaagacgaccggtntagtaacgtaccttgacggagagacgtaacgatttcccgaattaccgtaacctttccggtattgggtactacggg

SEQ ID NO: 45789 - DNA, 1016 bp, Homo sapiens
  misc_feature: GYAE6OF01CNYSN.27.57.F02.1.454.CMB.1.raw
  modified_base (215)..(215): a, c, t, g, unknown or other
  misc_feature (215)..(215): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaacgtgggctgagtcttgggttttccttgttgcttagttttagaaggtgtccagtgtgagtgcaacgtggtgattcgnggaggaggtgtggtccagtcccgtagggacgtaactcccgtaggtacgtaccttccgtccgttcgtagccgtaacgtcccgttcgttagggttactttaccgttaaacccgttttttaaggttagttttacgtttagggtagtacggtacggtccggttccggggttcccgacccgtaacggtaccgtacccgggaacggggggtaaacggggtcggtacggggttacggttttacccgggaccggaaaccccgtaaaaccgtaaacgttaaaaccccggaaaggttaaacgggttaaacgggggtaaaaacggggttaaaaaacggtaaaaaaccgtttaggttaccggggttaaacggttaacccgtttaccgggtttaacggggttaacggggtaaaccggggttaccccgtaaacgtttacccgtaaaccccggttacttaccccggtaccccgtaaaacgggtaaccggaaaacccgtaaaacccggtaaccccggtaaaaagggtaaacccgttaccggttaaacccggtttaggttaaccccgtttacggttaaaccgtaaacccgttaaaacgttaacgggtaaaaccccgtaacgtaacccgggttaacggaaacgggtaacgggaaaccccgggggaagttaaaccccggggtaccggttacgttaaccgttaacgttaaaccccggttaggttaacggttacgggaccggttaaaggtaaccggttaccgtttaccgtaagtttacccgttaacctttcccgtttaacggtttactcggtttacccgggg

SEQ ID NO: 45790 - DNA, 809 bp, Homo sapiens
  misc_feature: GYAE6OF01C0INV.27.57.F02.1.454.CMB.1.raw
tcagagcgtcgtctcacgaccggtgctcgatttagctcgatatagttgggtttgaggtctcagagaggagccttagccctggacctccaaggcctttccacttggtgatcagcacggagcacagacggacccacatggaacgtgggctgagcgttgggttttcctgttgcttatttagaggtgtcagtgtgaggtgactaacgtggtgtattcggagggaggtaggtggtcggtaccaggtccgtaggaacgtaactcccgtagaccgtacctccgtcgttgcgccacgtcctcgtaggttacttaccttacgtttagttacgttagttaggcgtacggtacggtcgggtccggtacccgacgtaacggtaccgtaccgggaagggggtaacgggtcgtaacgggttcggttccgggacgaacctaaacgtaaacgtaaaaccgaggtaaaggtaacgggaaaaaggtaaaaccgtaaacgttaggtacgggtaacggtaaccttcgggtagggtaacgggtaaacccgggtccttaacgttacccgaacgttaccttacccgtacgaaggaccgtaaacccgaccgtaaccgtaaaggacccgttacacgttacgtaccgtacgtacgaactaaggccgtaaaccggcgtaaccggaaggtacggaaccggaccggtacggtaccgtaccggttacgttaaacgtacccgtaacggtcgtaagggtcccggtaggtaacggttaaaccgtccgttaacctacggttacccttacggtttaccggttactttccgggtccggttccggg

SEQ ID NO: 45791 - DNA, 789 bp, Homo sapiens
  misc_feature: GYAE6OF01COPEO.27.57.F02.1.454.CMB.1.raw
  modified_base (254)..(254): a, c, t, g, unknown or other
  misc_feature (254)..(254): n is a, c, g, or t
  modified_base (290)..(290): a, c, t, g, unknown or other
  misc_feature (290)..(290): n is a, c, g, or t
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
tcagagcgtcgtctcacgaccggtgctcgatttagctcgatatagttgggtttgaggtctcagagaggagccttacgccctggactccaaggtcctttccacttggtgatcagcacggagcacagacggacccacagtggaacgtgggctgagtcgttgggtttttccttgttgtcttaagttttaggaaggtcgtacctagtgtggaggtcgactaacgtgggtgtattcggagggaggtggtgtcggtaccngccgtaggacaactccgtagacgtcctccgtctggngctacgccttcgtggttacttaccgttactttagttagttagtaggntaggcgtcggtccgggtcccncgaacgtaccggtacggagggggtaggtcgtacgggtcggttcgacgaacccctaaaagtaaaccgtaaaccgaaggtaacggtaagggtaaaacgggtaaaataaacgttaggtacggtacgtaaccggttggtacggtaaacggggtaccggtacccgtaattacccccgaaccttactaccccgtaaccgaagtaaacccggtaaaaccccgaaacgaaacccgtaaagggttaaccctacttaacggtttagttaaccacgtaacgaaaccgttaaagaaaccccgaaggtccgtaaccgagggacccggtaacggacccgggaaagtacccgggacttaaccggttattaaaccgcgttagtacggacggagtaacgactcgttaacgtccttacgttaccttccggttattcgtacgtcccgggg

SEQ ID NO: 45792 - DNA, 898 bp, Homo sapiens
  misc_feature: GYAE6OF01A58F2.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaactggtggattcgtggaggaggtgtggtccaggcctggagaactccctgacgactctcctgtcgcacgcctctggtacttctaacctttagtagtttagtggatgagtcgtcgggtccgccgacgacgtccggaagggggtaacggggtcgtacgggtacggttccggtacggaaccctaaacaaacgtaaaaccgaaaggtacgtaaggggtaaacggtaaaaacgtaaaacgttagttacgggtacggtaccttacggttagggtaacggggtaaacggggtcccgtaacgtttacccgaaacccgttacttacccgtacccgaaacgggtaaacccaaaccccggaaacccggtaacccgaaaaggtaaaccggttccctaaaaccggtttaggttaaaccttacccggttaacgaaacccgtaaaaagttaccgggtaaaacccacccgggttaacccgtaacgggtaaacgggtacccccggggaaacccggggtaaacgggtaaacccggtaacccggggttacctttaacggtttaaacccgttaaacccggtttaaccggtacggggttaccgggtaacccgggaaagggttaaacccggttacccgtttaacccggtttaacggtttacccgtttaacccgggttttccccggttttaacggtttttacggtaacccggttttcccgggg

SEQ ID NO: 45793 - DNA, 912 bp, Homo sapiens
  misc_feature: GYAE6OF01BV9DU.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccagtggaacgtggggctgagtcgttcgggtttttccttgttgtcttagttttaagaaggtgtccagtgtggaggtgactaacgttgggtggtacttcggtgggagggtaggttggttcggtaccgacgtccgtaggaacgtaacctcccgtagacgttaccttcctcgttaggtcgaccgtacgtcccgttcgttacggtacctttaccgtttaaccgtttttaagtttagtttaagttggattagggtacggtccggttaccggggtcccgacccgtaacggtacccggtaacgggaaggggggtacgggtacggttacgggttaacgggtttccgggtaaccggaaccctaaaaccgtaaaaccgtaaaacgtaacggtaaggttaaaacggggtaaaaaggtaaaaacggttaaaacgtttaggttaacgggttacggtaccgttaaggtacgggttaacggggaacggtacccgttaaccttacccggaaccttacgttaccccgaaccggtaacggtaaaacaacccccgtaaacggaacccgtaaaaaggtttaccccgtacgtaacccgttttagaaccgttaacgaccgtaaaactaaacgtacgggaaaccttaaccggccggttaaggaacccgggacggtaaacccggtcggaacccgttacggttagttacccggttaaacttaaaccggtggtaacgtacggagaaaccggttctacccggtaactttggtcctttacgtttccgttaagttttgacccggttcgg

SEQ ID NO: 45794 - DNA, 575 bp, Homo sapiens
  misc_feature: GYAE6OF01D3TR7.27.57.F02.1.454.CMB.1.raw
  modified_base (341)..(341): a, c, t, g, unknown or other
  misc_feature (341)..(341): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagtcgtgggtccgcagactccgaggggagggctggagttcgtgaccaanactaaaccagataggaagtaaagaaactatgtggactgtgtaggaagggccgtattcaacctatcctaccgagacgaaccaacgaccaaagacgtcacgttgtactctagacaaagtgaaccagccgtagaacgacggaccggaaggaccgacgggtctaggtactaccgtacgttggtcgacgaggtacgacttcccgttaagtcctaacgtttccggttcttttgcttccgg

SEQ ID NO: 45795 - DNA, 809 bp, Homo sapiens
  misc_feature: GYAE6OF01AFS1B.27.57.F02.1.454.CMB.1.raw
  modified_base (348)..(348): a, c, t, g, unknown or other
  misc_feature (348)..(348): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactgggctgagctgggttttcctgtgctatttagaggtgtccagtgtgaggtgcaacgtggtggattctgggaggtaggtgtcgggtccaggcctaggagaactcccgtaggacgtaccttctccgtagtcgcctacggccttcgtgggtactttcctaaccgttttaggttagtttagttacgggattgacggtcgtcggggtacccnccgtaaggacctccggaagggggtaacggggtccttaggggtacgtttcggacggaacccaaaacgtaacgtaaaaacccgaagtaacggtaaaggggtaaacggttaaaaacgtaaaaaccgttgtagggttacggtaacttccggttagggtaacggaaacgggtacccgtactttacccaccgtaacttcccgtaacccggaaggtaacgaacccgtaaaccggaccgaaaggtaacctccgtaattaggtaacctcgtacgaacgtaaagaccgtaaacaccggttaccagggaaccggtaaccggaccgggtaacgacccgtaaccgggtacttaacgggttaactaacccggttagtacgggtaccgaacgggtaacgtaaacgtacccgtttcccggttaaacgttcccgttaccgtttacccgtttaacgtttttccgccgtttaacccgggg

SEQ ID NO: 45796 - DNA, 820 bp, Homo sapiens
  misc_feature: GYAE6OF01DG9BN.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctggagctgggttttccttgttgctattttagaggtgtcagtgtgaggtgcaacgtggtggattctgggagtagggtgtggtccaggcctgggagaaatcccttggagactcgtcctggtagccaggaccttcgagggtatttcaaccctttttagagtttaattggaattggaagtcgtgggtacccgccaaggacctacccgaagggggaacggggcttacgggaagtttccggtaggaccccaaaaccaagttaaaacccgaaggtacttgggaaaacggtaaaaggaaaaacttaagtcgttgggaaactcgttaggtagggaacgggaccctaagtttaccaaccctaagttccaccgtaaggaacgaactaaaccggacccgaaaagaacgtttaccgaacgttacgttaacgtaccttgaactaaaacggttagtaaaaccgaacggacccgtttaggaaaccgggttaacgggaacccccggtaaacgggtaaacccgggaacccgggttaccgtaaacggtttaacgtaaacccttaacccgttagggttaacgttaacgggaaaccggaaacggttaaaccggttaccccttaaaagggttacccggtaaaaccttttttccccgggttaaacccgttttttgggtaaccctttttaaaccccggg

SEQ ID NO: 45797 - DNA, 875 bp, Homo sapiens
  misc_feature: GYAE6OF01C52B8.27.57.F02.1.454.CMB.1.raw
tcagagcgtcgtctcacgaccggtgctcgatttagctcgatatagttgggtttgaggtctcagagaggagccttagccctggactccaaggtcctttccacttggtgatcagcacggagcacagacggacccacatggaacgtggggctggagtcgttgggttttccttgttgtcttaagttttaaggaaggttgtccgaggtggtggaggtcgacaacgtgggtggtagttcggtagggagggtagggttggtcgggtccgaggtccgtagggaacgtaacgtcccgtaggaacgtaccttccgttccgttgtcgaccgtacgtccttacggttacggtaacctttaccgtttaaccgtttttaaggtttagttttaggttaggtaagttcggaacgtccggtttccgggtaccccgaccgaacggtacccgtaccggggaagggggtaacgggtcgttagggttacggttccggtacggaaccctaaaacgtaaaacgtaaaaccggaaacggtaaggtaaaggggtaaaaacgggttaaaaacgtaaaaccgtttaggttagggtacggttaaccgttcgttaggggtaaacgggaacccgggttaaccttaacgtttacccaaccgttatcccggtaacgaacgtaacgaacccgtaaaccggacgaaaaggtaccgttacgacgttagtacgtacaaggaaaccttaagtaacgactaccgggacggtaacgaacggggtacccgaaccggaacggtaacccgtacgggttcttaaacgttactaaacccggttgacgggacggaaccggtaatacggttaccttactacggttactcctttaaccggtttgttaagccggttaccgggg

SEQ ID NO: 45798 - DNA, 810 bp, Homo sapiens
  misc_feature: GYAE6OF01AY3GF.27.57.F02.1.454.CMB.1.raw
  modified_base (260)..(260): a, c, t, g, unknown or other
  misc_feature (260)..(260): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgtgctattttagaaggtgtccagtgtgaggtgcaactggtggattctgggaggaggtgtggtccaggcctggagaactccctgacgactctcctggtncgacgccttcgtggtattctacctttagtagttatggatgagcgttcggggtccaccgagtacctacggaagggggaacgggtcgtaggagttcggtacggacccaaacaacgtaaaaccaaggacttagggaaaaggtaaaaacgaaaaacttagtgggtacgtaacttcggtaggttagggaaacggggtacccctaagttacccgtaaccctagttacccgtaccccgaaaggaaaccggaaaccccaaaaccggaacccgaaaaagggtaaacgttacccgtaacgtttaaacgggttaacttaccccggttaacgaaacccgttaaaaacggtacgggtaaaaccctaacggtaccccgtaagggaaacgacccggggtaacccgggaacgggtaacccggaaccgggtacccgtttaaggttaaacccctaacggttacggttcggttaacgggaccggtaaaggtacgtttaaccgtacccgtttaaacgggtaccttacccgttttaccccggttgtttttaacgaccggtttacccccggg

SEQ ID NO: 45799 - DNA, 856 bp, Homo sapiens
  misc_feature: GYAE6OF01C8XJJ.27.57.F02.1.454.CMB.1.raw
  modified_base (180)..(180): a, c, t, g, unknown or other
  misc_feature (180)..(180): n is a, c, g, or t
  modified_base (332)..(332): a, c, t, g, unknown or other
  misc_feature (332)..(332): n is a, c, g, or t
tcagagcgtcgtctcacgaccggtgctcgatttagctcgatatagttgggtttgaggtctcagagaggagccttagccctggactccaaggccctttccacttggtgatcagcacggagcacagaggacccacatggaactgggctgagcttgggttttcctgttgcttatttagaggtntccagtgtgaggtgacaacgtggtggattcgtgggaggtaggtgtggtcccaggccgtaggagaactcccgtagacgactcctcctgtgcagcccttcgtaggtactttaccgttaactttagtagttagttggatggagtcgtcgggtccnccgagaccgtaccgggaaggggaacgggtcgtagggtacggtttacggacggaacccaaaacgtaaacttaaaaacccgaaggtaaacggttaacggggtaaaaaggtaaaaaacgtaaaaactttaggttaacgggtacggtaactacggttaggggttaaaccggggaaccgggggtacccttaacgtttacccgaaacccgttacgttaccccgtaaccgaaacgggtaacgaaaaccccgaaacccggaaaccgtaaaaagggtacccttaccgtaacgtttacgtaacttaccgttaaccggaaactaaaacgttaccggaaaccgaaccggttaccgtaacgggaacggaccgggaaccccggggaaaggtaaccccggtacgggttaaccttaacggttaaaccgttaccgttaacggtacgggttaacggaccggttaaaggacgttaacccgttaacggttacccgttaccgtttacccgttttccgtttcgtttaaggtcccgtttaaccgggg

SEQ ID NO: 45800 - DNA, 946 bp, Homo sapiens
  misc_feature: GYAE6OF01EK9KG.27.57.F02.1.454.CMB.1.raw
tcagagcgtcgtctcacgaccggtgctcgatttagctcgatatagttgggtttgaggtctcagagaggagccttagccctggacctccaaggcctttccacttggtgatcagcacggagcacagaggacccacatggaacgtggggctggagtcgttgggtttttccctttggttgtctttaagtttttaaggaaggttgtcccgtaaggttggtggaagggtgaccaaacgttgggtaggtatttcgtggggaagggacgggttgtacggtccaagtccgtagggaacgtaacctccccgtagacgtaccttccgtccgtgtcgtcgacgtcccgttacgtgggtaacctttaccgttaaccgttttaaggtttaagttttaacggttaggggtaagttcgggaacggttcccgggtttaccgggggttaccccgaacccggtaacggtaacccccggttacccggggaaaacggggggggtacggggttccggttaagggggttaccgggttttaccgggtaacccggggtaaaacccctaaaaaaccggttaaaaccgttaaaaaaaccccggaaaagggttaacggtttaaaagggggaaaaacggtttaaaaaaaaaccggaaaaacgttttagggtaaacggggttacggtaaaccgtttcgggttaacggggtaaaggggtaaacccggaccggtttaacttacccgaaccgttaacttacccgtacgaaacggtaacccgaaacgaaaccgtaaaccgtaaacggtaacgttacctaacggtagtactacgttacgaactaaacgtacgaacgcgtaccgagtacgaccgacggtagtacacggtacgttactagttaaaccgagttacgcggtagaaacggtacttacccgtgttaccgttaacttccggtttacctttacgtttcgacgttacggg

SEQ ID NO: 45801 - DNA, 768 bp, Homo sapiens
  misc_feature: GYAE6OF01DRJ2R.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacgagacggacccaccatggaacgtgggctgagtcgttgggttttccttgttgcttattttaagagtgtcagtgtgaggtcgacaacgtggtggtacttcgtgggaggtaggttgtcggtccacggtcctgggaacgacttccccgtagacgaccttctccgtgtcgcgacgccctcgtaggactttcctaacgttttagtacgtttatggactggtacgcggttcgggcccgtccgagtaccgtaccgggaaggggaacggggtcttgggtaaccgttcggtcggaacccaaacgtaacctaaaccgaaggtaacgtaggggtaaaacgtaaaacgtaaaacgttagttacggtacggtacccttaggtagggtacggtaaacgggtaccccgtaagttaccctaaccgtaacgttacccgtaccgaaggtaaaccggaaaccaacccggaaaccgtaaaggtaaccgtacctaacgtttgtaacgttcgtaaccgtaactaaagtacgtaacgaccgtacgtaggaacggacgaaccggtacggacgtaccgtacggttataaccttacgtacttaggtcggaaagtacggaactaccgttaccaacggttacttacgttccgtttcgttttaagcccgtttacggg

SEQ ID NO: 45802 - DNA, 878 bp, Homo sapiens
  misc_feature: GYAE6OF01EBYXZ.27.57.F02.1.454.CMB.1.raw
  modified_base (697)..(697): a, c, t, g, unknown or other
  misc_feature (697)..(697): n is a, c, g, or t
  modified_base (863)..(863): a, c, t, g, unknown or other
  misc_feature (863)..(863): n is a, c, g, or t
tcagagcgtcgtctcacgaccggtgctcgatttagctcgatatagttgggtttgaggtctcagagaggagccttagccctggactccaaggtccctttccacttggtgatcagcacggagcacagacggacccacagtggaacgtggggctgagtcgttcgggtttttccttgttgtcttagttttaaggtaaggttcgtccgtaggtggtcggtagggttgaccgtaacggttgggtggtatttcggtaggggtaagggtagggttggtcgggtacccgacggtcccgttagggaacgtaaccgttccccgttggaaccggtaccttccttccgtggtcgccgtaccgtcccgttcgttcggttacctttaccgttaaccgtttttaggttaagttttagttaggagttacggtcggtccgggttcggggtaccccgaccgtacggtacccggtaccggggaaggggggtacgggtcgttacggggttacggttccggaccggtaaccctaaaacgtaaaaccgtaaaaccggaaggtaacggttaaaggggaaaacggtaaaaacttaaaggtttgtacgggtacgtaccgttaggtacgggtaacgggaaccgggttactacgttaccaaccgttaccgtaccgaacggaaacgaaaaccggtaaacccgaacgtaaagtaccgtacctagttntaccttaacgctaaaagtaagtaccgaaccgacggtaccgtaaggaccggaaccgggtacggaaacggtaccgtagttaccgttaacggtacttaccggtaggtcgtagggaacgtaggtacccttagcccgttattacccgtttcgtttcccttaagttttccgngttccggtacggggg

SEQ ID NO: 45803 - DNA, 694 bp, Homo sapiens
  misc_feature: GYAE6OF01EK0G6.27.57.F02.1.454.CMB.1.raw
  modified_base (119)..(119): a, c, t, g, unknown or other
  misc_feature (119)..(119): n is a, c, g, or t
  modified_base (163)..(163): a, c, t, g, unknown or other
  misc_feature (163)..(163): n is a, c, g, or t
  modified_base (176)..(176): a, c, t, g, unknown or other
  misc_feature (176)..(176): n is a, c, g, or t
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
tcagagcgtcgtctcacgaccggtgctcgatttagctcgatatagttgggtttgaggtctacagagaggagccttagccctggactccaaggcctttccacttggtgatcagcacggancacagagacccacatggaactgggctgagctggttttctgttgnttatttagaggtntcgagtgtgaggtgcacgtggtggattcgngggaggnggtgtcggtccagccgtggagtactccctgacgcttctcctgtcgcacgccttgtggtacttaccttaccttttaaggtacgtttagttggataggaggtcgtccggggtcccgaccacggtaccgtaccgggaagggggtacgggcgtgggtacggttacggtcggaacccaagtaaacctaaacgaaagtcggtaaggtaaaacggtaaaagtaaactggtaggtacggtattaccgaggtacggaacgggtcttacgttccaacgtacttccctacgaacgtaacgaaccgtaaacgaccgaaacgtacgtaccgtaacgttcgtacttaccggtataaactaagtacgaacgtaccgtccgtaaggacgaccggtacgggaacgacgtacgggtacttagaccttacgtacgtagggtcgagtaaggcgtacctacgttacgtacccttctaccggtttagtttcgcgttaccgggg

SEQ ID NO: 45804 - DNA, 647 bp, Homo sapiens
  misc_feature: GYAE6OF01AOQE8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcttgttgctattttagaaggtgtccagtgtgaggtgcaactggtggattctggaggaggtgtgggtccagccgtggagaactcccctgagactctcctgtcgcacgcctcgtggacttctaccgtttagtagttagttggatgagcgttcgggtccgcagactccgagggagggctggtacgttcggcggaccaacgaactaaaccgaaggagtaacgggaaaggtaaaagaaaacgtagtaggtaggtaacttcgtaggtacggtaagggacccgtattccgaaccctagttccctaccgaggtaacgaaaccgaaaccgaccaaaggtaacgtacctacgttagtactacctagactaaatacgaaacacgtacgaacggcgtaacggccggtaagaccgacggcgtattacgtaccgtagttggtacgtaggtaaggacgtacgtacccttagtccttacgttccgttcttttggcgttaccggg

SEQ ID NO: 45805 - DNA, 861 bp, Homo sapiens
  misc_feature: GYAE6OF01DCC8C.27.57.F02.1.454.CMB.1.raw
  modified_base (181)..(181): a, c, t, g, unknown or other
  misc_feature (181)..(181): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtgggctgagcttgggttttcctgttgctattttagagtntcagtgtgagtgcaacgtggtggattcgtgggaggtaggtgtcggtccagcctaggataactccccgtagacgtacctctccgtaggtcgcctacggtcccttcgtaggtactttcccgttaaaccgtttttaaggttaacgttttagtttggagttcggtacggtccgtcggggtccccaccgtaaggtacccgtaccgggaagggggtaacggggtcctagggttacggttcccggacggaacccctaaaactaaacgttaaaaacccgaaggtaacggtaaacggggtaaaaacggtaaaaaacgttaaaaccgttaggttacgggtacggtaaaccgttcggttagggtaacggggtaaaccggggtccttaacgtttacccgaaacccgtaacgttcccgttaaccggaacggaaaccgtaaaccccgaaccgtaaaccgaaaaggtaacgttacccgtacggttaacggttactcgtttaaccggaaactaaacgtaccggaaaccgacgttaaccgaaggaccggtaacggacccgaagggaaccccacggggtacttaacggttaacctaaccgttcgaggttacgacgggttaaacgtaacgtacccgttaccgttacggttaaccttaaccgtttcccggtttaacgttttcggaccgtttaacccgggg

SEQ ID NO: 45806 - DNA, 706 bp, Homo sapiens
  misc_feature: GYAE6OF01AWY4R.27.57.F02.1.454.CMB.1.raw
  modified_base (215)..(215): a, c, t, g, unknown or other
  misc_feature (215)..(215): n is a, c, g, or t
  modified_base (336)..(336): a, c, t, g, unknown or other
  misc_feature (336)..(336): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtggattcgngggagggaggtggtggtccaggccgtaggagtaactcccgtgacgacctcctccgtagtcgccacggtcctacgtaggtacttcctaccttttagtagtttatggatggagcgtcggcccnccgaggaccgtccggaggggtacgggtcgtagggtcgttcggcgaccaaacaactaaaccgaaggacgtaaggaaaacggtaaaaagtaaacgtagtagggtaacgtacttacggtaggtaacggaacgggtacccgttaagttacccaaccttatacccgtaaccgaaggaaacccgtaaacccgaaaccggaacccaaaaggtaaccttccgaaaactttggtacctactacggaaacttaaacgtaccgaaacgtccaacgggttacgaaccggacgggtaccgaacggaccgtacggtattacgtaccttcgaaggtgacgtacggagactactccgttagaccttcgttacctgtttagctacgg

SEQ ID NO: 45807 - DNA, 727 bp, Homo sapiens
  misc_feature: GYAE6OF01DFRIF.27.57.F02.1.454.CMB.1.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaacgtgggctgagtcttgggtttttccttgttgtcttattttagaggtgtccagtgtgaggtgacacgtgggtgattcgtggaggnggtgtgggtccagcctagganaactccctgacgtactctccgtgtgcacgccttcgtaggtacttaccttaccttttagttagttagttaggatggagtcgttacgggtcccgcaaggccgtaccggaaggggagggtcgtgggtagttcggcgaaccaaactaacgtaaaacgagtaaggtaagggaaaacggttaaaaagtaaaaccgttagttagggtagtaacccgtggtttaggaacgggtaaaccgggtcctaacgttacccgaaccctaacgtccctaacgaacgaaccgaaccaacggaaccgtaaaagaccgttacgtacgttagttactacgtacgtaaactaaatacgtaaacgtacgccgtaaaggacggtacccggaccggaacggtaaccggaccgttcgttaaacgttacgtaccgttagtcggtaagtacggaaggtaacgtacgttccttaagtccttacgtttccgtttacgtttgtcgttaccgg

SEQ ID NO: 45808 - DNA, 764 bp, Homo sapiens
  misc_feature: GYAE6OF01ASZS5.27.57.F02.1.454.CMB.1.raw
tcagagcgtcgtctcacgaccggtgctcgatttagctcgatatagttgggtttggaggtctcagagaggagccttagccctggactccaaggcctttccacttggtgatcagcacggagcacagaggacccaccatggaactggggctgagcgttggttttccttgttgcttatttagaggtgtcagtgtgagtgcagtggtagtatcgtgggaggtaggtgtaggtccacggtccgttgggaacgtaacttcccgtaggtaacgtaccgttccttaccggtgtcgaccgtacggtcccttcgttacggtactttaccttaaccggttttaaggttaacgttttgttacgggtaatcggtaaggtccggtttacgggaccccggacccgtaacggtaccgtaccgggtaagggggaacggggtccgttgggtacggtttccggacgtaccgaaacgtaaacgtaaacgaaacggagtaagggaaagtaaagtaaaacgtgtaacggtggtactgtaggttagggacggtactacgttaccacctagtcctacgaggaacacgtaaccgaacaaacggtaactccgtaatacgtacgtactacgaacgtaaacgtacgtaaacgcgtacggacgggtaacgcgggaaccggtaacaacgggtacctaagttataaccgtagttaaccgtggacggaacgtagggaatttcccgttagggttaactaccggtttacgtttccggtaactttgcccgtttaaacggg

SEQ ID NO: 45809 - DNA, 848 bp, Homo sapiens
  misc_feature: GYAE6OF01BS406.27.57.F02.1.454.CMB.1.raw
  modified_base (269)..(269): a, c, t, g, unknown or other
  misc_feature (269)..(269): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattcgtggaggaggtgtggtccagcctggagaactcccgtgagactctcctgtgacagcctntggatttcaccttttagtagttattggatcgtagtcgtcggggtcccaccgtagaccgtacccgaagggggaaggggtcctagggtaacggttttccggacgggaccccaaaaataacctaaaaaccgtaaggtaacgttaggggtaaaagggttaaaaaagaaaaacctttaggttagggtacggtaaacttccggtaggttaacgggaaacgggggtccctaagtttcccaaacccgttattacccaccgtaaggaacgttaaacccaaaccggacccctaaaaaaggaaacggttaccctaagtttaccggttaaatcccgtttaacgggaacttaaaagttacgaaaacgtccggtacttaaccgggaaggttaaaccgggacccgggtaaagggaaccgtaacccggggtactttagggttaaaaaccttaccccgttttaaacggtgggtaacccggttaaaggggaaacgttaacggttaacccccgtttaacccgttaaaagggttcccctttaaaaccggtttttaccccgggtttcttttttttaaaccggggacttttacccccgggg

SEQ ID NO: 45810 - DNA, 757 bp, Homo sapiens
  misc_feature: GYAE6OF01BQHMD.27.57.F02.1.454.CMB.1.raw
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattcgtggaggaggtgtggtccagccgtggagaatccctgagactctcctgtgcagcctcgtggattctacctttagtacgttatggatgagtcgtgggtccncagtacctacgaggggacgggtctgggngttcggaggaccaacgtactaaaaccgaagagtagggaaggtaaaagtaaaactagtaggtaggtacctcgtaggtaggtaacgggtcccgtaatttccgaaccctacgttacccgtaaccgaacggtaaacgaaacccgaaacccggtaacccgaaaagggtaaacgttcccgtaaaccgttacggttaaccttaccgttaggaaaccctaaaaggtaccggaaaactaccgggtacctaacgggtaacggaccgggtaacccgggaagggaacccgtaaccgggtccgtttaggtaaacctttaacccgttaaccgttaggggtaccggtaacgggaacggtaaccggtaaccgttcccgttaaacggttaccttacccgttttaccccggtttctttttacgggaacctttcccgggg

SEQ ID NO: 45811 - DNA, 860 bp, Homo sapiens
  misc_feature: GYAE6OF01BBWJE.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacaggacggacccaccatggaacgtggggctgagcgttgggttttccttgttgcttagttttagaaggtcgtaccgagttgtaggaggtcgacaacgtggtggtattcgtagggaggtaggtgtcggtccgagccgtggaagaacgtcccgtgagtacctcctcgtgtcgcgacgtcctgtacgtacttcgttactttagttagttagtcggtatagacgtcggtcggtacccgcgtaagaccgtaccggaaggggtacgggtcgtagggtacgttcgggacgaaccctaaacgtaaacgtaaaccgtaaaggtacgtaaacggggtaaaacgttaaaaacgaaacgtttaaggtacggttaacggaccgttacgtacgggtacggaaccgggtaccgtaccttaaccgaacgtacttacccgtaacgaaccgtaaacggtaaccccgaaaccggtaaaccgtaaacggtaacgtaccttaacgttacgttaacgtactaaggtaaacctaaagtaccggtaaacgtaccgtaaccggttaaggtaacccggacccgggttaaccggaaacggtacccgggtaacgggttacccgttaagggttaacctttaaccggtaacggtttacgggaccggtaacgggttaacgtaacccgggtaccctttaacggtaacccgtttcccggttaaaccgtttttaccccggttacggttttaacccggtccggtttaaacccgggg

SEQ ID NO: 45812 - DNA, 808 bp, Homo sapiens
  misc_feature: GYAE6OF01E0H0R.27.57.F02.1.454.CMB.1.raw
  modified_base (186)..(186): a, c, t, g, unknown or other
  misc_feature (186)..(186): n is a, c, g, or t
  modified_base (220)..(220): a, c, t, g, unknown or other
  misc_feature (220)..(220): n is a, c, g, or t
  modified_base (365)..(365): a, c, t, g, unknown or other
  misc_feature (365)..(365): n is a, c, g, or t
  modified_base (739)..(739): a, c, t, g, unknown or other
  misc_feature (739)..(739): n is a, c, g, or t
  modified_base (800)..(800): a, c, t, g, unknown or other
  misc_feature (800)..(800): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagtcttgggttttccttgttgcttagttttagaggttntccagtgtgaggtgactaacgtggtggtattcgngggaggtagggttgtcggtccaggtcccgtaggaacgtaaccttccccgtaggaacgtccttcctcctaggtcgacacgtccctgtcggtacttcccgtaacgttttagtagtttacgtgggtatgtacggtccgtcgggtaccncgacgtacgtaccggggaaggggacgggtcttacgggtacggttacccggtacggtaaccccaaaactaaacgtaaaccggaaaacggtaagggttaaagggtaaaacggttaaaaaaccggaaaaaccgttttaggaccgggttaacggtaccgttaccgggttacgggtaaacggggaacccgggtaaccgttaaccgtacccaaacccgtacgtacccgtaccgaacggaacccgaaaccgaaaccgtacccggaaagtaacccgtaccgtacttacgaacttaccgacgtaaactaaacgaccgaacgaccgttacgaacggacggaacggtcccggaaggtaccgtaccgtcgttaacgtacttaaccncggttagacggacggtagtaccgtacttaccgtaagttccttagttaccgttcgtttacgngttaccgg

SEQ ID NO: 45813 - DNA, 1085 bp, Homo sapiens
  misc_feature: GYAE6OF01DWMT9.27.57.F02.1.454.CMB.1.raw
  modified_base (221)..(221): a, c, t, g, unknown or other
  misc_feature (221)..(221): n is a, c, g, or t
tcagagcgtcgtctcacgaccggtgctcgatttagctcgatatagttgggtttgaggtctcagagaggagccttagccctggactccaaggcctttcacttggtgatcagcacggagcacagagacccacatggaacgtgggctgagtcgttgggttttccttgttgtcttagtttttagaaggttgtccagtgtgaggtgacaacgtggtggtatttcgngggaggtaggtggtcggtaccacggtccgtaggaacgaaccttcccgtaggaacgtaccttccgttccgtgtcgaccgtacgtccttacggtggttactttacccttttaaccgttttaaggtttaacgtttaggttagggtaacgttcgggtaacggttcccgggtttaccgggggtaccccgtaccgtaacggtacccggtaaccggggacggggggtaaacgggggttcggttaacggggttacggtttaccggggtaccgtaaaaccccgaaacgtaaaaaaccgtaaaaccgggtaaaggttaaacggggttaaacgggggtaaaaaaacggggttaaaaaaaccggtaaaaaccggttttagggtttaaacgggttaccgggtaaacccgtttcgggggtttaacgggtaacgggggtaaaacccgggttaccccggttaacctttaacccgggaaaccccgtttaacgtttaccccgaaccggaaacggtaaaccgaaaaccccggaaaaccggtaaccggaaaaagggtaccgttaaccgttaaccgttacggtttaacgttaccggttaacccggtaaaacgtaaacgggtaacccgggtaaaccgtaccgggtaaccgttaacggggaaccgggttaacccgggtaaaccggggtaacccgggtaaccggtacccggggttaactttaaggttttaaacccggtaccccgtttaaaggttaccgggttacgggaaacccggggttacggttaaaaccgtaaccccgttttaccccggtaaaacgtttttcccgtttaaaccccggtttttccccggttttaacggtttttccggaacccggttttaccccgggg

SEQ ID NO: 45814 - DNA, 152 bp, Homo sapiens
  misc_feature: GYAE6OF01B7EVR.27.57.F02.1.454.CMB.1.raw
  modified_base (119)..(152): a, c, t, g, unknown or other
  misc_feature (119)..(152): n is a, c, g, or t
tcagagcgtcgtctcacgaccggtgctcgatttagctcgatatagttgggtttgaggtctcagagaggagccttagccctggactccaaggtcctttccacttggtgatcagcacggannnnnnnnnnnnnnnnnnnnnnnnnnnnnnnnnn

SEQ ID NO: 45815 - DNA, 634 bp, Homo sapiens
  misc_feature: GYAE6OF01E1MD9.27.57.F02.1.454.CMB.1.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
  modified_base (483)..(483): a, c, t, g, unknown or other
  misc_feature (483)..(483): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtcagtgtgaggtgcaactggnggtattcgtgggaggaggtgtggtccgagcctgggaagaactccctgagactcttcctgtgcacgcctcgtggattcctacctttagtagttagttggatgagctgggtccncagcgtccgaggggagggntggagttcgtggaccaacaactaaaccaagagtagggaaaggtaaaaacgaaactagtcggtacggacttcgaggttacggaacgggtccgtagtttaccacctactcctaccgagacgaactaaccgacgaagaactcacgtgtactgngaacaatcgaacgcgaccgtaggagtaccggaccgaacggaaccgacgggtcctaggttaacttaaccgtagttagggtacgaggaacggtagtaaccttaccgttaacggtacttaacggtttccgttacgttttcggcgtttacccggg

SEQ ID NO: 45816 - DNA, 781 bp, Homo sapiens
  misc_feature: GYAE6OF01BP3Q9.27.57.F02.1.454.CMB.1.raw
  modified_base (205)..(205): a, c, t, g, unknown or other
  misc_feature (205)..(205): n is a, c, g, or t
tcagagcgtcgtctcacgaccggtgctcgatttagctcgatatagttgggtttgaggtctcagagaggagccttagccctggactccaaggcctttccacttggtgatcagcgacggagcacagacggacccacagtaggaacgtgggctgagtcgttgggttttccttgttgacttagttttagaaggtgtcagtgtggaggtnacaagtggtgtattcgagggaggtaggtgtcggtaccaggtccgtaggaacgtaactcccgtagacgtaccttcctccgtgtcgacctcggtccttaggtgtacttaccgttaacgtttagttagtttagttggattcggtacggtcggtccgggtacccgacgtacgtacccggtacggaaggggtacggtcgtaggtaggttcgacggaaccaaaagaacgtaaaccaggtaggtaaaggtaaagtaaaaacgtagtagtacggtagacgttagtaggtacggaacggtcctatccgactacgtaccgacgtaagaacgaacgaaccgaacgtaaagtactaacgtccgtaagtacgtacaacggtaactaaacgtacgaacgtacggtaaccggtaacgaacgtaccggggaccggtaaacggtacccggtaagggtaaccttacggtaaaccgttacggttaacggttcggaacccggttagggaaccgttaacgggtactttaacccgggttacgttacccgtttacggttttacccggtttccggttttacgttaccgggttaacccggg

SEQ ID NO: 45817 - DNA, 841 bp, Homo sapiens
  misc_feature: GYAE6OF01CXIPG.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccacatggaacgtggggctgagtcgttgggttttccttgttgtcttagttttagaaggtgtccagtgtggaggtgctaacgtggtgattcgtgggagggtaggtgtggtccagtccgtaggacgtaactcccgtgacgtacctccgtccgtggtcgccaccgtccgtacgtaggttacctttacccgttaacgttttaaggttagtttacgttaggtagttaggcggttaccggggttcccggtacccgaccgtacggtaccggtacggggtaaggggggtaacgggtcggttagggttaccggttccgggtaccggaaacccgtaaaactaaacggtaaaaccgtaagggtaaacgggttaaagggtaaaaacggtaaaaacgtaaaacttagggttaggtaccggtacgttacggtaagggaacggtaccgggtacgtaacttcccgtaaaccgtctacccgaacgtaaacggaaccgtaaacccgaacccgaacgtaaaagccgttaccgtacttaacggttactacgaagaacgttaagaacgtaaacggcgtaacgtaacgggaaccgtacgggaacccggaacgacgtaccgggttattaacggtctaaaccgtcgtagggacgtagggaaacgtccgttacgttaacccgtacgtttacccttacccgttttggtttaacgtttaacggtcgttaaccccggggg

SEQ ID NO: 45818 - DNA, 974 bp, Homo sapiens
  misc_feature: GYAE6OF01CIG4M.27.57.F02.1.454.CMB.1.raw
  modified_base (169)..(169): a, c, t, g, unknown or other
  misc_feature (169)..(169): n is a, c, g, or t
tcagagcgtcgtctcacgaccggtgctcgatttagctcgatatagttgggtttgaggtctcagagaggagccttagccctggactcccaaggccctttccacttggtgatcagcacggagcacagaggacccaccatggaactgggctgagcttgggttttccttgttncttattttaggaaggtgtccagtgtgaggtgacaacgtgggtaggactttcgtgggaagggaggttcggtacgggtacccaaggtcccgttagggaacgaatccccgtagaacgtaccttcctcccgttagacgccacggtcccttaccgttgggtaacttttaccctaaaccctttttaaggtttaagttttaagttagggacttagggtacgtaccggtttaccggggttacccgaccctaaaccggtaccgtacccggaaaggggggaacggggtccttagggtacgggtttacccgggtaggaaacccctaaaacgaaaaccgttaaaaacccgaaaggaaacggttaaggggaaaaacgggtaaaaaagtaaaaaaccgttaggtacggtaacgggaaccctttaggtaaggttaccgggaaaacgggtacccgtaactttaccccgaacccgttaactcccgttaaacccgaaaggaaaccggaaaaccctaaacccgggaaacccttaaaaagggaaacccgtttaaccgtaacgtttaacccgggtaattaccgtaacgtaaaacccgtaaataaaccgggaaacgaaaccgtaccccgggtaagaaaacccgggtacccgggaaccggtaaaccgggaacccggtaacccgggtatttaacggtaaaacccgtttaaccgtttaacctaggggtacgtaaacccggggtaataaacccggtactttaccccggtaaaaggttcccctttaaaagtttcccccgtttaacgtttttaagaccgttttaaaccccggg

SEQ ID NO: 45819 - DNA, 829 bp, Homo sapiens
  misc_feature: GYAE6OF01DO7CU.27.57.F02.1.454.CMB.1.raw
tcagagcgtcgtctcacgaccggtgctcgatttagctcgatatagttgggtttgaggtctcagagaggagccgttagccctggactccaaggtccctttccacttggtgatcagcacggagcacagacggacccacagtggaacgtggggctgagtcgttgggttttcctgttgcttatttagaggtgtccagtgtgaggtgactaacgtgggtaggtattcgtgggagggaggtcggtcggtaccgaggtccgtagggaacgtaaccgtcccgtaggaacgtccttccgttcggtcggtcgaccgtaccgtccgtacggtcggttaacctttaccgtttaaccggttttaaggtttaagtttaggttaggtaagtaggggtacccggttccgggttaccgggaccccgtaccgaaccggtacccggtaaccgggggaaggggggtaaccgggtcgttacggggttacggttacggaccggtaaaccaaaacgtaaaacgttaaaaccggaaaggttaacggtaaaggggaaaaaccgttaaaaagtaaacggttcggtaaggtacgtacgtagtacggggtaacggtaccggactttaacgtacccaacgtccttaacgaccgtaagaaccgaaacccgaccgtaaccggtaaaggtaacctcctaagttcggtaactacgaacgaaactaagacgtaacgtacgacgtaggaacggaccgtacggaagcccgtagtactaggttactaccggttagacggtacgagtagtcctaacgttcccgttaagtccgtttacgttaccgttttattccgacggtttcccggg

SEQ ID NO: 45820 - DNA, 909 bp, Homo sapiens
  misc_feature: GYAE6OF01C9JCF.27.57.F02.1.454.CMB.1.raw
tcagagcgtcgtctcacgaccggtgctcgatttagctcgatatagttgggtttgaggtctcagagaggagccttagccctggactaccaaggtcctttccacttggtgatcagcacggagcacagaggacccacatggaactggggctgagtcgtgggttttcctgttgctattttagaggtgtccagtgtgaggtgcaacgtggtaggatttcgtagggaggtgggttggtcggtacccaggtccctaggggaacgtaactccccgtaggaacgtaccttacctccgtgtgacctacggtccccttacgtacggttactttcccttaacccgttttaaggttacgtttaagttcggtaattcggacggtccggttcggggttacccacccgtaaggacccgtacccggggtaaggggggaaggggtccggttaggggtacggtttccggaccgggaaacccctaaacgtaaacgtaaaaccgaagggtaagtaaggggaaaaggtaaaacgtaaaacgtttgtagggtacggtacttcgggttagaacggggaaccgggtcctaacttccgaacctacgttcccgtaaccgaaggaaaccgaaacccgtaaccgaaacccgaaaggtaacccggttacctaacgggttaccgtttaagtcccgtttaaaggaaaccgtaaaaccggttcgggaaaacctaccggtttaccccgtaaagggggaaacgggtaccccgggaaccgggttaacccgggaacccgtaaccggggttactttaaaccgggttaacgtaaccctttacgggtccgggttaaacggaccgggtaacgtacggtttaacccttacccggtcggtttacttaaaccccggttcccgtttttaacgtttcggaactttccccgggggg

SEQ ID NO: 45821 - DNA, 700 bp, Homo sapiens
  misc_feature: GYAE6OF01CKEQB.27.57.F02.1.454.CMB.1.raw
  modified_base (255)..(255): a, c, t, g, unknown or other
  misc_feature (255)..(255): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttctgttgctattttagaaggtgtccagtgtgaggtgcaactggtgattctggaggaggtgtggtccagcctggagaatccctgagactctccgtgtncagcctctggattcaccgtttagtagttattggatggagtcgttcggggtccgacccgagaccgtaccgaagggggaaacggggtcctgggtagttcggtacggaccctaaaacgaaactaaaaccaaaggtaactaggggaaaacggtaaaaagtaaaaacgtaagttcggtaggacctcgtggtaacggaaagggtcccgatttaccacctaactacctaccgagtaacaacgaaaacgaacccgaaaggaaacgtaccgaacgttacgtaatcgttacaacgaaaacttaacgaacggaacgtacccggtaagacgggtaaccggaccggaacgggaaccgtaacgggccttaggtaactaacttaacgtaggtcggtacaaggtaggtaaaccttcccgtaaagtccctaacgtttccgttaacctttttgtacgttaccg

SEQ ID NO: 45822 - DNA, 816 bp, Homo sapiens
  misc_feature: GYAE6OF01A0GUG.27.57.F02.1.454.CMB.1.raw
  modified_base (315)..(315): a, c, t, g, unknown or other
  misc_feature (315)..(315): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggtttccttgtgctatttagaggtgtccagtgtgaggtgcaacgtggtgattcgtggaggaggtgtggtccagcctggagaactcctgacgctcctcgtgtgctagtcctgtggtacttctaccgtttagtacgtttacgtggatggacgtcgtacgggtccncacgaccgtacggaggggtaacgggtcctagggtacgtttcggtacggaacctaaacgtaacgtaaaccgaaggacgtagggtaaaacggtaaaaagaaacgttgtagggtacggtactacggtaggttaacgggaacgggtccgtaacttaccgaaccgtacgtacccgtacgaacggtaaaccctaaaccggaaaccggaccgtaaaaaggttaaaccggttccctaaacgggttacgttaaccgttaaccgtaggaaacccgttaaaaggttacccgtaaaaaccggtacggttaacccctaacgggaacggtacccggggtaacccgggaaacgtaccgggtaaaccgggtcgttaaccggttaaacgtacccgttaaacggttggggtaaaccgtccggggaaaaacgttaccggggtaacctttacccggtaaaacggttttcccgtaaaccttttaccccggggtttacttttacggtaacccgttttaccggg

SEQ ID NO: 45823 - DNA, 811 bp, Homo sapiens
  misc_feature: GYAE6OF01A81F1.27.57.F02.1.454.CMB.1.raw
  modified_base (794)..(794): a, c, t, g, unknown or other
  misc_feature (794)..(794): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaactggtggattcgtggaggaggtgtcggtccaggcctagggagtaactccccgtagacgtaccttcctccgtggtcgcctaggcccttcgtggacttcctaaccgttttagtagtttattggattggacgtcgttcggggtcccgaccgaacggtacccgtaccggaaggggggtaacggggtccgttaggggtaacgtttccggtacggaccccaaaacgtaaacgttaaaacccgaaaggtacgtaaggggtaaacggttaaaaagtaaaaccgtttgttacgggtacggtaccttacggtaggtaacggggaaacggggtccctaagtttacccaaccctagttacccctaccgaacggaaacgaaaccccgaaaccggaaccccgtaaaaagggtaacccggttacctaaacccggtttaggttaacccgttacgtacgtaaaccgtaaaagtccggaaaaccgtcggtacccgtagggaaacgtaccgggacccggtaagggacccgaccggtcgttaagtaccgttaaccgttcgttaggcggacgtaaggtaccgtactaccgttacgtaccttacgtttacccgttntttacgacgttcccggg

SEQ ID NO: 45824 - DNA, 841 bp, Homo sapiens
  misc_feature: GYAE6OF01B0EAS.27.57.F02.1.454.CMB.1.raw
  modified_base (336)..(336): a, c, t, g, unknown or other
  misc_feature (336)..(336): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtcagtgtgaggtgcaacgtggtggattcgtgggagggaggtgtggtccagtccgtaggagtaactccccgtgaacgtaccttctccgtgtcgcacgtcctacgtggattcctacgttttagtagtttagttggatgagtccgtcggggtcccnccgacggtaccgtccggaagggggaacgggtccgttagggtacggttcggtacggaacccaaaacgtaaactaaaaccgaaggtaaggtaacgggaaagggttaaaaaacgtaaaacttacggtaggtacggacttacggtagggtacgggaacgggtacccgtaagtttacccgaaacctacgttacccgttaaccgaaaggaaccgaaaccccgaaaccggaacccgaaaaggtaaccggtccctaagtttacggttaaacctccgtaacggaaacctaaaaggttaccgaaactccggtacccgtaaggggtaaccgaccggacccgggaaacggtaaccggaaccgggtaccgttaaagttaaaccgttaaccgttaaccggtaggggttaccgggaacgttaaacgggtacgggtttaacccctttacccggttaacggttacccctttaccggttttacccccggttttagttttttaagggacccccgttttaccggg

SEQ ID NO: 45825 - DNA, 642 bp, Homo sapiens
  misc_feature: GYAE6OF01DF7K5.27.57.F02.1.454.CMB.1.raw
  modified_base (119)..(119): a, c, t, g, unknown or other
  misc_feature (119)..(119): n is a, c, g, or t
  modified_base (153)..(153): a, c, t, g, unknown or other
  misc_feature (153)..(153): n is a, c, g, or t
  modified_base (155)..(155): a, c, t, g, unknown or other
  misc_feature (155)..(155): n is a, c, g, or t
  modified_base (174)..(174): a, c, t, g, unknown or other
  misc_feature (174)..(174): n is a, c, g, or t
  modified_base (179)..(179): a, c, t, g, unknown or other
  misc_feature (179)..(179): n is a, c, g, or t
  modified_base (185)..(185): a, c, t, g, unknown or other
  misc_feature (185)..(185): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
tcagagcgtcgtctcacgaccggtgctcgatttagctcgatatagtttgggtttgaggtctcagagaggagccttagccctggactccaaggcctttccacttggtgatcagcacggancacagacggacccaccatggaactggggctgagngngtttcgtgtaggctattanaggtntcagtntgagttnacagtggtgnttgnggagtgtgcgacntcgagactacncnactctctctgcgcancntatcttcttacgttattattagtgtagngngtcgtcgcgacacacgacggagggaggngtaggtcgtcgtacgaccaactaactaaactaacgtaagtaagtaaacgttaaacgtaacgttaagtagtacgtacgtagtaggaggtacggtacgtactactactacgtactaccgaacgaacgaaccgtaaccgaacgtaacgtaacgtacgtaacgtactaacttacgtaccgtaaccgtaacgtaaccgaacgaacgtaccgtaacggacgaccgacggtaacggtacgtacgtacgtactacgttaccgtagtacgtaacgtagtacggtacgttaccgttaccgttaccgttacgttaccgttaccgtttacgtttcgttacgttacgg

SEQ ID NO: 45826 - DNA, 619 bp, Homo sapiens
  misc_feature: GYAE6OF01EV9K2.27.57.F02.1.454.CMB.1.raw
  modified_base (344)..(344): a, c, t, g, unknown or other
  misc_feature (344)..(344): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaacgtggtggattctggaggaggtgtggtccagcctggagaatccctgagactctcctgtgcagcctcgtggattctacctttagtagttattggattggagtcgtggggtcccgcgagactccgaggggaagggctgggagtttcgnggaccaatataaaccaagactagggaaggtaaaagaaactataggtggactcgtaggtaggaaaggggtcccgtaatttccgaacctaagttcctacccgaaggtaacgaaccgaaaccgacccgaaagaacgtccaacttgtacttacgacgtactaaaatcggaaacacgaccgttagaacgacggaccggaaggaccacgggctaggttactactacgtggtagcggaagagtactacctagtacctacttacccggtcttttgacttccgg

SEQ ID NO: 45827 - DNA, 710 bp, Homo sapiens
  misc_feature: GYAE6OF01CAYRG.27.57.F02.1.454.CMB.1.raw
  modified_base (556)..(556): a, c, t, g, unknown or other
  misc_feature (556)..(556): n is a, c, g, or t
  modified_base (569)..(569): a, c, t, g, unknown or other
  misc_feature (569)..(569): n is a, c, g, or t
  modified_base (698)..(698): a, c, t, g, unknown or other
  misc_feature (698)..(698): n is a, c, g, or t
tcagagcgtcgtctcacgaccggtgctcgatttagctcgatatagtttgggtttgaggtctcagagaggagccttagccctggactccaaggcctttccacttggtgatcagcacggagcacagacggacccacatggaactgggctgagcgttggttttcctgttcgtcttatttaggaaggtcgtccgtagtgtggaggtgactacgtggtgattcgtgggagggaggtcggccggtaccgagtccgtaggaacgtacctccgagacgtaccttcctcgtggtgccgtacgccttcgtggttaccttccgttaacgttttagttagtttagtggtatgacgtcggttacggcccgtacacgtaccgacgggaggggacgggtcgtagggttacggtcggaacgaccaaacgtaacgtaaaaccgaggtacggtaaaggaaaaggtaaaacgtaaacgtaggttggaggtaactcggttaggtaacggaacggtctactacccgaactacgtcaacgagaaccgaaccgaacgaacgaacgacgtacgtaacgtnttaaccgtcgaanaacctaagtaaccacgtacgtcgagggacgtaacggaccgtacgacggacgtacgttacgtaacgtaccgtggtacgcggtaacggtaactacgccgttaacgttcgtcccgttatttacccgttgttnccgggttacggg

SEQ ID NO: 45828 - DNA, 845 bp, Homo sapiens
  misc_feature: GYAE6OF01DCDBS.27.57.F02.1.454.CMB.1.raw
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
  modified_base (347)..(347): a, c, t, g, unknown or other
  misc_feature (347)..(347): n is a, c, g, or t
tcagagcgtcgtctcacgaccggtgctcgatttagctcgatatagttgggtttgaggtctcagagaggagccttagccctggactccaaggccctttccacttggtgatcgagcacggagccacagaggacccacagtggaacgtggggctgagtcgttgggtttttccttgttgtacttattttaagacggttgtaccagtgtgagggtnacacgttgggtgactttcgngggacgngggtagtcggtccagtcgtgggaactaaccgtcccctaggacgcctcgtccgtgtncgcgtaccttcgtggtactttaccttaacgtttagttaggttacgtggtacgnggtacgtcggtttaccggggccccagtaccggtacccggtacggaaggggggtacgggtcgttagggttacgttccggacggaaccctaacgaaaacgtaaaccggaggtaaggttacggggaaaaataaacggtaaaacgttagttacggtacgtacgttaccgtagggaaccgggtaacggaccgggtttactcccgttaaaacgtcccgtacgtaacccgtaaggaaacggtaaccccaaacgtaaaccccggtaagaaacccggtttctaacgtcgttaaacggttcaaccgttacgaaacgtttaacgacgtacctaccgggtacggaaaccccgggaggtaccccggggtaagaaaccgggtaccgggccttaaacgggttacgtaaccgtttagccgggttagacccggtaaacgtagggtaccccgttaccttacggttaacccgttcgttttacccggtttttaaccgttcggtacttttccccggggg

SEQ ID NO: 45829 - DNA, 1111 bp, Homo sapiens
  misc_feature: GYAE6OF01CHS6F.27.57.F02.1.454.CMB.1.raw
  modified_base (126)..(126): a, c, t, g, unknown or other
  misc_feature (126)..(126): n is a, c, g, or t
tcagagcgtcgtctcacgaccggtgctcgatttagctcgatatagttgggtttgaggtctcagagaggagccttagccctggactccgaacggtcctttccactttggtgactccgagcgacgganccacacgacgaccccacatcggaacgtgggctgagtctttgggtttttaccttgttgtcttaagttttagaggttgtcagtgtaggaggtgaccgtaagttgggtgtacgttacggtggggtaggtacggtgttacggtccgtaggtcccggtaggaaccgtaccgttacccgtggaacgtcccgttcctcgttggtccgtaccgtaccgtccctttacggtacgttacgtttacccgtttaacccggttttttaaggttaagttttaacggttaggtagttaaccggggtacggtcccggggttttaccgggtacccccgtacggtaacccggttaaccccggtaccggggtaaacggggggtaaccggggttcgtttaacggggtaccgggtttaccgggaccccggtaaaaccccgtaaaaaccgtaaaaccgtaaaaaccgggtaaaaggttaaacgggttaaaaacgggggtaaaaaacggggttaaaaaaacgttaaaaaccggttacggtttaacgggtttaaccggttaacccgtttacggggttaaccggttaacggggtaaaacccggtacccggtttaaaccgtaacccggttaaacccttaacggtcccccgtaaaacggtaaccgggtaaaccctaaaacccggaaacccggtaaacgaaaaccggtttacctaaccgtaccggtttaaacgtaccccgttaaggtaaccggtttaaaacgtaaacggttaacccgtaacggggttaacccggttaaccggaagggttaaaccccgggaaccggggttaaacccggggtaaacccgtaaccgggttaccgggtttaacctaccgggttttaaaccttacgggtttaacccggtaaggtaccccgggaacggtaacggtttcccgttaaagttccccgtttaaggttaccccctttaggtttacccccggttttatttaacccggggtcgttaaaccccgggg

SEQ ID NO: 45830 - DNA, 719 bp, Homo sapiens
  misc_feature: GYAE6OF01EBTAN.27.57.F02.1.454.CMB.1.raw
  modified_base (118)..(118): a, c, t, g, unknown or other
  misc_feature (118)..(118): n is a, c, g, or t
  modified_base (581)..(581): a, c, t, g, unknown or other
  misc_feature (581)..(581): n is a, c, g, or t
  modified_base (588)..(588): a, c, t, g, unknown or other
  misc_feature (588)..(588): n is a, c, g, or t
  modified_base (605)..(605): a, c, t, g, unknown or other
  misc_feature (605)..(605): n is a, c, g, or t
tcagagcgtcgtctcacgaccggtgctcgatttagctcgatatagttgggtttgaggtctcagagaggagccttagccctggactccaaggcctttccacttggtgatcagcacggancacaggacgacccacagtacggaacgtggggctagacgttcgtttcggttttcttgttgtactttattttaacggaggttcgtacctaggttggtaggtacggtctactaaacggttgggtacggtatttcgggtagggaagggtgggttcggtaacggtccgacgtcggtaggaatacctccgtgacgtcctccgtcgtgtcgcacggtccttgtagttacttaccttaacgtttagttattagtggtagtggtacgtcggtcggggtcccacgacgtaccgacgggaagggggtacggtgttacgggtacgtcggtacgaaactaaacaaacgttaaaacgaggtacgtaaggtaaaacgtaaaacgtaactaggtaggtacgtactagggtggaacggacggtctactacgtactataccagaacaacgaacaacgaacaacgacacttacgtacagtanacgtaanacacgtaacgctaacgngtacggacgacgtaacgtcgacgttaacgtacgttagtaaccgtggttaccgagacggtcgttaaacacggttaccttaggtccttaacgttcgtttaacgtcgtcgttccggg

SEQ ID NO: 45831 - DNA, 594 bp, Homo sapiens
  misc_feature: GYAE6OF01BWDAB.27.57.F02.1.454.CMB.1.raw
  modified_base (303)..(303): a, c, t, g, unknown or other
  misc_feature (303)..(303): n is a, c, g, or t
  modified_base (326)..(326): a, c, t, g, unknown or other
  misc_feature (326)..(326): n is a, c, g, or t
  modified_base (478)..(478): a, c, t, g, unknown or other
  misc_feature (478)..(478): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttctgtgctatttagaaggtgtccagtgtgaggtgcaactggtggattctgggaggaggtgtggtccagcctggagaatccctgagactctcctgtgcagcctctggtattcgaccttttagtagttattggatgagcgtgggtccncagactccgaggggagggctggngttcgtgaccaacataaaccagatggaaggtaaagaaactgtaggtagactcgtgtaggaagggtccgtattaccaccgtactcctaccaggtacgaaccaaacgcccaaagaacgtccaacgttagtactactaggactaaacgtagaacncgtacctaggagaacggaccggacgacggacggtctagttactactacgttggacgcggaagcgtacttacccgtagttaccgttactttaccggttactttttggcgtttaccgg

SEQ ID NO: 45832 - DNA, 808 bp, Homo sapiens
  misc_feature: GYAE6OF01BBQEG.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtggggctgagcttgggttttccttgttgcttattttagaaggtgtccagtgtgaggtgcaacgtggtggatttcgtgggaggaggtggtcggtccgagtccgtaggagaactcccgtgacgtactctcctgtgcaggcccttcgtggtactttcctaacccgtttttaagttagtttaacgttgggtattggacgggtcgttccgggggtcccgtccgaacggaaccgttaccggaagggggaacggggtccgtaggggtagttcgggtacgtaccgaaacaacgtaaaaccgaagagtaagggtaaacgtaaaagtaaacgtagtacggtaggaccgtacgtgggtaacggaacgggtaccgtacttaccgacctactcccgaaccgtaacggtaacgaaacccgtaaaccgaacccgtaaaaaggaaccgtttaccgaccgtttagttaaccttaccgtaaggtaaacctaaaagtaaccgtaaaaccgtccggaacccgttaggggaacccggtaacgggaccggtaaacgggaccccgtaacgggtactttacggttaaaccgtaaacccgttcggtaaggttacccgggaggttaacggtaacgaccttttacccgaggttaccttccggttaccttttactttcgggttaacgtcccggg

SEQ ID NO: 45833 - DNA, 740 bp, Homo sapiens
  misc_feature: GYAE6OF01B1DU0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtgggaggaggtgtcggtccagccgtggagaatcccctgagactctcctgtcgcagcctcgtggtattccacctttagtacgttagttggatgagtcgtgggtcccgccaggacctccgaggggaacgggctagggtagttcggtggaccaaaacgaacgtaaaaccggaagtaacgtaaggggaaaggtaaaacgaaaaacgttgtacggtacggtaaccttcgtagggtaaggaaaccggggtcccgtaagtttacccaacccgtagttccccttaaccgaaggaacggtaaaccctaaaccggaccctaaaaggtaacgttaccaaaccgttaggttaactcgtaacgtaacctaaaagtccggaaacaccggtaccctagggaacggaccggtacccgggaaggtacccgaacgggtcgttaaggtaaccttaccgtacggttggtacggacggtaaaggacgtacttacccccgttaaggttccctaaacggttttcccctacgttttttcgaacctttcccggg

SEQ ID NO: 45834 - DNA, 675 bp, Homo sapiens
  misc_feature: GYAE6OF01AWZPQ.27.57.F02.1.454.CMB.1.raw
  modified_base (551)..(551): a, c, t, g, unknown or other
  misc_feature (551)..(551): n is a, c, g, or t
  modified_base (562)..(562): a, c, t, g, unknown or other
  misc_feature (562)..(562): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttattttagaagtgtccagtgtgaggtgcaacgtggtggtattcgtgggaggaggtgtcggtccaggcctgggagaacctcccgtgacgtacctcctcctgtcgcacgcctgtggtacttctacctttagtacgttattggatggacgtcgtcgggtcccgccgacgaccgtccgggaagggggaacggggtccgttagggtacggttcggtacggacccaaaacgtaaactaaaaccgaaggtaacgtagggaaagtaaaagaaaactgtaggtagtactgtaggtaggacggtacgacttacgaacctactaccgtacaaggaacgaaccgaaaccgacgtaaacgtaacgtccgtaacgttatacctcgtacaacgtaanaaccggaaacncggtacctagggaccgacggaccggtagacggaccgtagttacgtaactacgtcctaggtgacgagtcgacgtaccttcgttactaccgttccgttatttcgtgttacccggg

SEQ ID NO: 45835 - DNA, 840 bp, Homo sapiens
  misc_feature: GYAE6OF01CQTEH.27.57.F02.1.454.CMB.1.raw
  modified_base (181)..(181): a, c, t, g, unknown or other
  misc_feature (181)..(181): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtgggctgagcttgggttttccttgttgcttatttagagtntccagtgtgaggtgacaacgtggtggtattcgtgggaggtaggtgtcggtccaggtcctaggacgtaactcccgtgacgtaccttcctccgttgtcgaccgtacgtcccttcgtaggttactttacccgtttaaccgtttttaaggttagttttaagttgggagttggacggtccgggtccgggtaccccgaccgtacggacccgtaccgggaggggggtaacgggtcgtagggtacggtttaccggtacggaaccccgtaaaactaaacgtaaaacccgtaaggtaacggttaaaacggggttaaaacgttaaaaaacgttaaaaccgttaggttaagggtaccgggttaacttaccgggtttagggtaaacggggaacggggttaccctaacttccccgaacctaaccgttcctaacccggaagaacccgtaaacccgaaacccgaaccgtaaaacggtacgtaccgtacgtacgttacttacggtaacgtaaactaacgtaaccggtaacgacgggtcccgttaagggaaccggaccggtaaccgggacgaacggtcgtacgtttaacgaacgttccgttaagtcgggtaacgacgggataactaccccgtttataacgttaccctttacgttccgtttcttcggacgttcccggg

SEQ ID NO: 45836 - DNA, 792 bp, Homo sapiens
  misc_feature: GYAE6OF01AEIWQ.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacagacggacccacatggaactggggctgagtcgttgggttttccttgttgacttattttaggaaggtgtccagttggtagtaggtgacacgttgggtggtattcggtgggagggtagggttgtcggttaccaggtcctagggtaacgacttcccgtagacgtaccttccgtaccgtgtcgacgcgtcccttcgttacggtacttacctttaccggttttagtacgttagtggtagtcgtagtccggtcggtaccgaccgtacgtacgtccgggaaggggacggtcgtggtcgttcggtacgacctaaacaacgtaaaccgaaaggtcgttaaggggaaacgtaaaaacgtaaagtaggtacggtacgtacgttacggtaagggacggtaaccggggtacctacgtttaccgaaccgtactacccggtagaacggacgaaacccgtaaccgaacgtaagggaaccttcgttacgtacgtttacgaacggttactaaacgaacgtacgtaaacggccgtacggtaaggtaccgggaacggtaaccggaggtacccgtacgggtaaccgttcgtaaaccttaccggttagtaccggtaacggtacggacgttacgtaacccgttacttcggttacttaacccgtttcccgttagttacgtcggttaacccgggg

SEQ ID NO: 45837 - DNA, 755 bp, Homo sapiens
  misc_feature: GYAE6OF01EFB3Q.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaggtgtccagtgtgaggtgcaacgtggtggattcgtgggagggaggtggtcggtccagccgtggaagaactccctagacgtaccttctccgtggtcgcacgccctcgtggtactttcctaaccgttttaggtagtttacgttggattggacggtccgttcggggtcccgaccgaacggtaccgtacccggaaggggggaacggggtcgtaggggtacggtttcggacgggtaacccaaaacgaacgtaaaaccgaaaggtacgtaaggggaaaagttaaaaacgtaaaacttggtaggtacggtacttacggtaggtaacgggaaccgggtcctaacttacccgactacttccgaacgaagaaccgaacccgaacggtaaccaaaggtaaccgtacctaacgtttgtaacttacgagaaacttaaacgaccggtaacaccggtctaacgggaacgaccggggtaccggaacggtaccggtaccggtcgtaagttaccgtactaccggttggacggagacggtaacgttacccttaggtaccttgttaacccttccgtttgtttacgcgttacccggg

SEQ ID NO: 45838 - DNA, 751 bp, Homo sapiens
  misc_feature: GYAE6OF01AXNB2.27.57.F02.1.454.CMB.1.raw
  modified_base (190)..(190): a, c, t, g, unknown or other
  misc_feature (190)..(190): n is a, c, g, or t
  modified_base (614)..(614): a, c, t, g, unknown or other
  misc_feature (614)..(614): n is a, c, g, or t
  modified_base (738)..(738): a, c, t, g, unknown or other
  misc_feature (738)..(738): n is a, c, g, or t
tcagagcgtcgtctcacgaccggtgctcgatttagctcgatatagttggggtttggtaggtctcagaggaggaggccttagccctcggactccaacggcctttcctacttggtgatcagcacggagcacagacggacccaccatggacgtgggctgagctgggttttccttgttgctattttagaaggtntccgagtgtgaggtgcaacgtgggtggtattcgtggggagggtagggtgtcgggtccacggccgttagggaagtaactcccgttgagtacctcctccgtggtacgtcacgtcctcgtaggtacttacttaccgtttacgttagtttagttggtactaggtcggtcggttcggggtcccgtaccgaacgtaccgtccggaggggggtaacggggtcgtacgggtcgggtttccggacggtacccgaaactaaacgtaaaaccggtaacgtaaggtaagggtaaagggtaaaacgtaaaacgttacggtaggtacgtacggttacgtaggtacgggaaacgggtcctacggttaccaacgtactccgtacgaacggagaaccgaaacggactaaggaacgtactactgtaactcgaaggaactaanaggtaacacgtctaggcgtaacgggtccgaaaggtccgtaacgacgtacgtactaacgtacggtcggagtacgggaaactgtaaccgtcggtaactcgggttaactttccgggttactttaccngtttaaccccggg

SEQ ID NO: 45839 - DNA, 887 bp, Homo sapiens
  misc_feature: GYAE6OF01CGPPT.27.57.F02.1.454.CMB.1.raw
tcagagcgtcgtctcacgaccggtgctcgatttagctcgatatagttgggtttgaggtctcagagaggagccttagccctggactccaaggtcctttccacttggtgatcagcgacggagcacaggacggacccaccatggaactgggctgagtcgttggttttccttgttgtacttattttagaggtgtcagtgtgaggtgacaacgtggtgtattcgtgggaggtaggtgtcggtccagccgtggagaactccgtagacgtacctccgtctggtgacgtacgtcctgtggtacttcttacttttagttagttagttaggataggacgtcggtcgggtcccgccgtacggacccgtacgggaacgggggtacgggtcgtcgggtacggttacggtccggaaccaaaacgtaaacgtaaaaccgaaggtaacggtaaaggggtaaaacggtaaaaaccgttaaaagttacggttaacgggtaccgtaacgtttcggtaacgggttaacgggaaaccgggttacccttaacgtttaccccgaaaccgttaccgttacccgtaacccggttaaagaacggtaaaccccgtaaaccgggaacccgtaaaaaggttaacccgttacgaaacccgggttttaactaaccgtttacctaaacggtaaacgttaaaacggtaaccggtaacggtcccggtaaccgttaacgggaaacccgggacgggtaaacccgggacggtaacccggtacggttaaccgttacgggttaaacctaaccggggttacgttacgggtccgggtaaagtaacccggttaggaacccccttttaacgggtcgtttaacccgttacgtttacccccttttggtttacccgtacggttaacccggggg

SEQ ID NO: 45840 - DNA, 831 bp, Homo sapiens
  misc_feature: GYAE6OF01BNWGM.27.57.F02.1.454.CMB.1.raw
  modified_base (617)..(617): a, c, t, g, unknown or other
  misc_feature (617)..(617): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactgggctgagtcgttggttttcctgttgcttatttagagtgtcagtgtgaggtgcgacgtggtgtattgtggaggacggtgtcggtccagtcgtaggaacgtaactcccgtagacgtacctccgttccgtgtcgcgtacgtcctcgtacggtactttaccgttaaccgttttagttaggtttagttaggtattcggacggtccggtaccgggccgtacccgaacggtaccggtaccgggaagggggtaagggcgttagggtacggttacggtcgaaaccaaacgtaacgtaaaaccgaaggtaagtaaggggtaaaaggtaaaaacgtaaacgttcggtaggtaacggtaccgtttcggtagggttaacggtaaccggggtacctaacgttacccaaaccgtacggtttacccaacggtaaacggacgaaaaccctaacccgggtaaactaaacggaaccttacgtaaccggtttanaaacctttaccgagtaaaacgttaacccggataaacccgtccgaaccggtagggaaacggaccggtaccgggtaaagaacccggtacgggttacgttaaacggttaccttaaggttccggtagggacgtaaccggttagaaaccgtttcccgttaaccgtacggttttaccctaccgggtttaccggttttctttaggtacccgttacccgggg

SEQ ID NO: 45841 - DNA, 798 bp, Homo sapiens
  misc_feature: GYAE6OF01BZDI3.27.57.F02.1.454.CMB.1.raw
tcagagcgtcgtctcacgaccggtgctcgatttagctcgatatagttgggttgaggtctcagagaggagcccttagccctggactccaaggcctttccacttggtgatcagcacggagcgacagaggacccaccatggaacgtggggctgagctgggttttccttgttgctattttagaaggtgtccagtgtgaggtgcaacgtggtggattctgggaggaggtgtgggtccagcctggagatccctgagactctcctgtgcacgcctcgtgattctacctttagtagttagttggatgagtcgtcgggtcccaccgggggacaccgtccggagggggaacggggtcgtagggtaggttccggttacggacccgtaaaacaacgttaaaacccgaaaggtacggttaaggggtaaacgggtaaaaacggtaaaaccgtttaacggtaggttaaccgggtaaccgttaccggttaggttacgggtaaaccggggtacccgttaagttacccgaacccgtaacgttacccttaccgaaaccggaacgtaaaccccgaaaccggacccgtaaaaggtaacgtacctaacgttagtacgttcgtacgaactaaacgtacgaacaacggtccgtaaggaacggtaccggtaccgggaacggtaaccggtaccggtaccgttacggttaacgttaaccgttaaccgttacgggtacggtacggtaaggtaccgtaccgttaccccgtaaggtttacccgttacgtttaccccggtttacgtttttacggtccgtttacccgggg

SEQ ID NO: 45842 - DNA, 724 bp, Homo sapiens
  misc_feature: GYAE6OF01AMEO3.27.57.F02.1.454.CMB.1.raw
  modified_base (118)..(118): a, c, t, g, unknown or other
  misc_feature (118)..(118): n is a, c, g, or t
  modified_base (147)..(147): a, c, t, g, unknown or other
  misc_feature (147)..(147): n is a, c, g, or t
  modified_base (174)..(174): a, c, t, g, unknown or other
  misc_feature (174)..(174): n is a, c, g, or t
  modified_base (583)..(583): a, c, t, g, unknown or other
  misc_feature (583)..(583): n is a, c, g, or t
  modified_base (625)..(625): a, c, t, g, unknown or other
  misc_feature (625)..(625): n is a, c, g, or t
tcagagcgtcgtctcacgaccggtgctcgatttagctcgatatagttgggtttgaggtctcagagaggagccttagccctggactccaaggcctttccacttggtgatcagcacggancacagaggacccacagtggactgggctgngcttggttttctgtgcttatttgagtntcagtgtgaggtgctagtggtagatttcgtaggaggtaggttcgttcgggtaccctaggccgtggaacgtaacttcctagacgtactccgttccgtaggtcgctacgtccttcgtcggtacttacctaccgtttttaggtagtttagttggaagtggacgtcggttacgggcccacgtacgtcggtaccggaggggaacgggttctagggtacgtcggtcgaaccgtaaacaacgtaaacgaggtacgtacggtaaaggaaacgtaaagtcgtcggtcggtaacttcggtaggaaccgggtaacgacccgttatacccgaacgttcgtaccgtacgaagaacgtaacccgaaccgaactaaagttacccgaactcgtagttacctcgaaccgaactaaacacgaacgtnaaccgtggaacgttccgaacggttcggaacgtacgtcggtanaccggttacgtacgtaggtccaggaactcggtaccctaaaggttacccgttacttaccggttttacccgggttttacttaacggtttcccgttacgggg

SEQ ID NO: 45843 - DNA, 847 bp, Homo sapiens
  misc_feature: GYAE6OF01AJ0D5.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttggtttccttgttgctatttagaggtgtccagtgtgaggtgcaacgtggtggattcgtgggaggaggtggtcggtccagtccgtggagaactcccgtgacgtaccttcgtccgtgtcgccacggtccctacgtggtactttccgtaaccgtttttaagttacgttttagttgggaattcggacggtccggtttacggggtccccgaccgtaacgtaccgtacccgggaaggggggtaacgggggtcgttacggggtacggtttcccggacgggtaacccaaaacgtaaacgtaaaaaccgaaggtaacggtaaggggtaaaacgggttaaaaaacgaaaacgtttaggtacgggtaaggtaccttacggttagggtaacgggaaccgggtacccgttaattacccgaaccctacgttaccccgtaccgaaggtaaccgaaaccccgtaaaccggaacccgtaaaaggtaaccggttacctaacggttaagttaccttacccggtaacgaaaccttaaaggtaccgaaaacccggtacgtacccgttaaggaaccgggtaaccgggaacccgggaagggtaaccccgtacgggtaccgttaggtaacccttaacgtaacggtcgggttacggacggtaagtacctaacgttcccggtacttaccgttacgtttcccgttatttcggacctttcggg

SEQ ID NO: 45844 - DNA, 765 bp, Homo sapiens
  misc_feature: GYAE6OF01BK186.27.57.F02.1.454.CMB.1.raw
  modified_base (124)..(124): a, c, t, g, unknown or other
  misc_feature (124)..(124): n is a, c, g, or t
tcagagcgtcgtctcacgaccggtgctcgatttagctcgatatagttgggtttgaggtctcagagaggagccttagccctggactccaaggcctttccacttggtgatcagcacggagcacagnggacccaccatcggaactggggctgagcgttgggtttttccttgttgtcttagttttaggaaggtcgtcctaggtgtgaggtgacgacgtggtggtattcgtggaggtaggtggtcggtccgagccgtggagaacgtccccgtgacgtaccttctaccgttgtcgcgtacgtccgttcgtacgttaccgtttaccgttaaccgtttttaggttaacgtttagttaggtagtacggtcggtcggttcgggtacccgaccgtacgtacggacggagggagggtcgtaggtacggttacgacgaaccgtaacgtaacgtaaacgaaggtacgtaaggaaacgtaaacgtaagtacggtaggtacgtacgttaggtacggtaacgggtaccggtaccgttacgtacctaacgtacgtaccgtaacgacgaacgtaacccgaaaccgtaaccgtaaacgtaccgtactaacgtttacgtacgttacgtaacgtaaacgtaacgtacgaacgtccggtaaccgtaaggacgggtacggtaccgtaacggaaccgtacgttacgttaacgtacgtacgtacgtcgtaggtaacggagttaccgacgttaccgtacgttccgttacgttcgtttcgtttagacggtccg

SEQ ID NO: 45845 - DNA, 738 bp, Homo sapiens
  misc_feature: GYAE6OF01B5IP4.27.57.F02.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (610)..(610): a, c, t, g, unknown or other
  misc_feature (610)..(610): n is a, c, g, or t
tcagagcgtcgtctcacgaccggtgctcgatttagctcgatatagttgggtttgaggtctcagagaggagccttagccctggacctccgaaggtcccttttccactttggtgatcagcacggagcacagaggaccccacagtggaacgtggggctgagctttgggttttccttgttgcttagttttagaggtctcagtgngaggtncagttggtgnttcgnggaggnggtgtgtcagcgtaggatactccgtgacacttcctcgtagcgcacgctcgttcgtacttctaactttagtatttagcgtatgcgcgttcggaccgcacggaccgtcgggtaaggggaggcgtaggtacgttcggaacgaccaaacaacgtaaacgagtagtaagggaaacgtaaaagtaaactggttaggacgtactcgtaggttaacggacgggtactacgttacccaacgtacttccgtaacacgggtaaacaaccccgtacgaacctaaaggtacgtcccgtaggtttaactaacgttaccgactaaacggtaaaccgttacggaacgtccggaacggttcggaaacggtaccggacgggtaaaccgggccgttacggtnttaaaacccggttcgtttaccgaaccgggttggaaccgtaacccgggtaaaaaccccgggtttacttaacccggttatttacccgttacccggtttttacggttcgtttcgtaccccggtttacgggg

SEQ ID NO: 45846 - DNA, 705 bp, Homo sapiens
  misc_feature: GYAE6OF01DMY7S.27.57.F02.1.454.CMB.1.raw
  modified_base (317)..(317): a, c, t, g, unknown or other
  misc_feature (317)..(317): n is a, c, g, or t
  modified_base (557)..(557): a, c, t, g, unknown or other
  misc_feature (557)..(557): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcttgggttttccttgttgcttatttagagtgtccagtgtgaggtgcaactggtggattcgtgggaggaggtgtggtccagccgtaggagaactccctgacgtactcctcctgtgcagccctgtgtacttcctacttttagtagttagtgatgagtcgtcgggtccncagctaccggaggggacggcgtgggtacgttcggcgaccaaacaactaaaccgaagtagtagggaaaaggtaaaagtaaacgtgtaggtacgtactcggtaggtaagggaacggtacctaattcccgaaccgtacttcccgtaccggaaaggtacctaaacccgaaacccggtaacaaaagggtaaccgttccgaaactttggtaaactacccgtaagaaacctaaacgttacggaaacncggttacctaaggaaccgggtaccggtacccggaaggtaacccggacggttacttaacggttaactacccgtgtcgggtaacgacggaggtaaacgtccttaaccggttatacccgttacggtttcttacgttcggactttacccggg

SEQ ID NO: 45847 - DNA, 937 bp, Homo sapiens
  misc_feature: GYAE6OF01EFEDJ.27.57.F02.1.454.CMB.1.raw
  modified_base (193)..(193): a, c, t, g, unknown or other
  misc_feature (193)..(193): n is a, c, g, or t
  modified_base (235)..(235): a, c, t, g, unknown or other
  misc_feature (235)..(235): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacagtaggaacgtggggctgagtcgttgggtttttccttgttgtcttattttaaggaaggtntccgagttgtaggaggtgactaacgttgggtggtatttcggngggaggaggttggtcggtcccagccgtgggaactaacttcccgtagacgtaccttccttccgtagtcgcctacgcccttcgtaggtacttccgttaaccgtttttagttagttttagttggtacgtaggtacgtcgtttcggggtcccaccgtaaggtaccgtaccgggaagggggacgggtcggttaggggtacgttcgggtaccggtaacccctaaaacgtaaaacgtaaaaccgaaaggtaaagggttaaggggaaaaaacgggttaaaaacgtaaaaacgtttagggttaacggtttaccgggtaacctttcgggtaacggggttaacgggttaaaaccgggggtacccgtttaacgtttaacccccaacccgtaacgtttccccgtaaacccggaacggaaaacccggtaaaccccgtaaaccggaaaccccgtaaaagggttaacccgttaacgttaaccgttaatttaccgtaacttaccggaaaacctaaagttaacggaaaccggtaaccgtaacccggtaacggggaaccggtaaccggacccggggtaaaccgacgggtaaccggttaccgttaaggttaacccttaccgttacggtacggtacgggacgttaaggtaaccggtactttacccggttaaccggtttaccttaccggttttaccgtttacgtttttccgtcggttacccggg

SEQ ID NO: 45848 - DNA, 886 bp, Homo sapiens
  misc_feature: GYAE6OF01CNAD7.27.57.F02.1.454.CMB.1.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacagtggaactggggctagacgtcgttgggttttccttgttcgtcttaagttttaggaagtcgtcaggtgtggaggtnacgagtgggtgattcggngggaggtggtgtggtccagccgtggacgactccctagaacgtcctccttcgtaggtcgaactcggtcccttggtacggtaactttaccgtttaaccgtttaggtttaagtttagttacggtaagtcggtaggtccgggtaccggtcccgacgtaacgtaccggtaccggaaggggggacggtcggtagggtaacggttccgaacggaaccaaacgtaaagtaaaccgaaggtaaggtaacgggaaaagggttaaaaactaaacgtttaggtcgggttaacggtactttaccggggttagtaaacggggggtaaccggtacttacggttaaccctaacctacgttacccggtaccgaacggaccgtaaaccaaccggtaaccgaaacggttaaacgtccaaacgtttggttaaacctacgttaacggaaaaccctaaaggttaaaccgaaccgtaacgtccggttaacgaaacggggtcggtaaacccgggaacgttaaccggaccggttacgtaacgggtttaaccttaacccggtagtttaacgggacccggtaacgaaaacggggttcccttaaacggttaccccggtttaattaccccgttttaaacggttccccccgggtttttaattacccgggtccgttttaaccccgggggg

SEQ ID NO: 45849 - DNA, 780 bp, Homo sapiens
  misc_feature: GYAE6OF01B4HR4.27.57.F02.1.454.CMB.1.raw
  modified_base (201)..(201): a, c, t, g, unknown or other
  misc_feature (201)..(201): n is a, c, g, or t
  modified_base (280)..(280): a, c, t, g, unknown or other
  misc_feature (280)..(280): n is a, c, g, or t
  modified_base (548)..(548): a, c, t, g, unknown or other
  misc_feature (548)..(548): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctggagcgttgggttttcctgttgcttatttagaggtgcagtgtgagtgcaagtgggnggtattgtgggaggagggtcgtggtaccagccgtggagtaactcccgtagaacgctcctcgttggcgcgacgtcctcgngtacttcttaacctttagtagttagtcggatggtagtcggtcgggtccgaccgtagtaccgtccggaagggggaacgggtcgtacgggtacggttcgggtacggaaccaaaagaactaaaaccggaagtaacgtaggggtaaaagtaaaacgtaaaaacgtagttaggtaacggtacgtaccgttagggtaaggaaccggggtactacgtttaccgaaccctcgttaccgaccgaacgaacgaaaccgaaccgaaacgaaaggtaacnccgtaaccttaggtaaccttagtacgaacgtaaagtaacgaaccgttacgaaccggtagaaaccgggacgaacccggaaggtaacccgagggttacctaacggtttaaagacccggtttaaagacggggttacgaaccgggtaggttaaacccggtacgtttaaacccggttaacgtaacccgttacgtttttaccccggtttagttttaaacccgtggtttaaccccgggg

SEQ ID NO: 45850 - DNA, 705 bp, Homo sapiens
  misc_feature: GYAE6OF01DPO0B.27.57.F02.1.454.CMB.1.raw
tcagagcgtcgtctcacgaccggtgctcgatttagctcgatatagttgggttgaggtctcagagaggagccttagccctggactccaaaggcctttccacttggtgatcagcacggagcacagaggaaccaccatggaactggggctgagctggttttccttgttgctattttagaggtgtccagtgtgaggtgcaactggtggattcgtggaggaggtgtggtccagcctggagaactcccgtgacgtactcctcctgtgacacgtcccttcgtacggtactttccgtaaccgtttttaaggttaacgtttagttaggtatcggacggtccggtcggggtcccgaccgacggtaaccgtacccggagggggtaacggggcgtagggtacgttcggtcggaccaacaactaaaaccgaagtaagtacgggtaaaaggtaaaagtaaaaactagtaggtacggtacctcgttacggtaaggaacggggacccgtaacttccgaaccctacttacccgtaccgaagaacgaaaccaaccggaacaaacggaacgtccgtaacgtagtaactcgtacgtaacaagtacgtacgaacgcgtaagaggaccgaccgggagtaacgacggctaagttacacgttagacgtccggagtacgtacgtaatccgttaaacgtccttacgttccgttctttcgtacggttaccgg

SEQ ID NO: 45851 - DNA, 727 bp, Homo sapiens
  misc_feature: GYAE6OF01EO5NC.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaactggtggattcgtggaggaggtgtggtccagcctggagaactccctgacgactctcctgtcgcacgcctcgtggattcctaccttttagtagtttattggatgagcgtcgggtcccaccgacgaccgtaccggaaggggaacggggtctagggtagttcggacggaccaaacgaactaaaaccgaagaagtagggaaaggtaaaaacgaaaacgtgtaggtacggacttcgtaggtaggtaacgggccgtaattccaaccgtattcccgtaaccgaaggtaacgaaaccgaaaccggtaacccgaaaaggtaaccgtacctaacgttacgttaactccgtagaaactaaagtaccgaaaacgacgtacccgtaggaaccgggtaaccggaccggggtaaacggaccggaaccgggttacttaggttaaaccgttacgtaccggttggtaggacccggtaaaggtaccgtaacgttcccgtaacgtttaccgttaccgttttcccggttacgttttggaacctttccggg

SEQ ID NO: 45852 - DNA, 736 bp, Homo sapiens
  misc_feature: GYAE6OF01EAHHQ.27.57.F02.1.454.CMB.1.raw
  modified_base (595)..(595): a, c, t, g, unknown or other
  misc_feature (595)..(595): n is a, c, g, or t
  modified_base (723)..(723): a, c, t, g, unknown or other
  misc_feature (723)..(723): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagtcttgggttttcttgttgcttattttagaaggtgtccagtgtgaggtgctaacgtggtggattcgtggaggtaggtgtcggtccagcctaggagactccctgagacttcgtactgtgctacgccttcgtaggactttacctacgtttagtacgttattaggtagtcggtagtccggttcggggtacccacgaacggaccgtaccgggaaggggaacggggtccgttagggtacggtttaccgggtacggaacccctaaacgtaaacgtaaaaccgaaaggtacgtaacggggaaaaggttaaaacgaaaacttggttacggacgtacgttacgtgggtacggaaacgggtacctaagttaccgaacctagtcccgtaccgaaggaacgtaacccgaaccgaacgaaagtaacgtacttacgtagtactacgtagacaatacgaacncgacgtacgagtaccggaccgtaggaaccgtacggtacgttaacgtacgttacctaacggttggtacgacgggtaacgtacgtaccgttacccgtaacgttcccttacgtttccgttaactttttcgnggtttaaccccgg

SEQ ID NO: 45853 - DNA, 818 bp, Homo sapiens
  misc_feature: GYAE6OF01CCIL2.27.57.F02.1.454.CMB.1.raw
  modified_base (283)..(283): a, c, t, g, unknown or other
  misc_feature (283)..(283): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttccttgttgctattttagaggtgtccagtgtgaggtgcaacgtggtggattcgtgggagggaggttggtgggtcccaggtcccgttgggacgaactccccgtgacgtacctcttcctggtgccncgtccctcgttggtactttcctaaccgttttaggttaagtttatttgggatggaggtcgttcggggtcccgccgaacggtaccgtaccggaaggggggaacggggtctggggtaacgtttccgggtacggaccccaaaaacgtaacgttaaaaacccgaaggtaagttacggggaaaaacgggttaaaaaacgtaaaaacgttacggttagggttacggtaaccttcgtagggttaacggaaggttcccgtaactttaccaacccgttacgttcccgtaaccgaaaggaaaccgaaaccccgaaaccggaacccgtaaaaaggtaaacccgttcccgtaaacgtttacgttaaacgttccgtaacggtaaacccttaaaggtaccgtaaaaccgaccgggttaccctaggggaaaccggtccgggaacccgggtaaacgacccgtaccgggtacttacgtaacgtacgtaccgtggcggtacgaaggtaccgtattaccgtagtaccttactttcccgtttcttgtacgttccgg

SEQ ID NO: 45854 - DNA, 816 bp, Homo sapiens
  misc_feature: GYAE6OF01CUROJ.27.57.F02.1.454.CMB.1.raw
  modified_base (732)..(732): a, c, t, g, unknown or other
  misc_feature (732)..(732): n is a, c, g, or t
tcagagcgtcgtctcacgaccggtgctcgatttagctcgatatagttgggtttgaggtctcagagaggagccttagccctggactccaaggtcctttccacttggtgatcagcacggagcacagacggacccaccagtggaacgtggggctgagtcgttgggttttccttggttgtcgttaatttttaggaaggttcgtcgaggtggtaggaggtgactaacgtgggtaggtattcggtaggggaggtagggttcgtcggtaccgacggtccgttaggaacgtaacctcccgtaggaacgtccgttcctcgtgcgcacgtcttcgtggtaacttccgttactttaagttacgttagtaggtacgtggacgtcgggtccgggtcccgaccgaacggtaccctacggggaagggggtaacgggtcgtacgggtacgttacggaccgaaccgaaactaacgtaaacgaaggtaagtaaggtaaaaggtaaaacgtaaacgttagtacggacggttactaggtagggtaggtaaccgggtaccacgtttaccacgttacctaccgtaacgaacggaccgtaaaccgaaccggtaacaaaacggtacctacgtaaccggtagttacctaacgtacgtaaacgtaacgtaacgaacgtaccgacgtacggaacggtacggaccggaacgtaaccggtcgtacgttaggtaaaccttacgtacggtagtaccgggtaanaaccggggtacttaaccggttactaaccggtttacctttaacccggttttcccgttttaagttccggttcccttaacccggggg

SEQ ID NO: 45855 - DNA, 813 bp, Homo sapiens
  misc_feature: GYAE6OF01DQY8C.27.57.F02.1.454.CMB.1.raw
  modified_base (213)..(213): a, c, t, g, unknown or other
  misc_feature (213)..(213): n is a, c, g, or t
tcagagcgtcgtctcacgaccggtgctcgatttagctcgatatagttgggtttgaggtctcagagaggagccttagccttggactccaaggcctttccacttggtgatcagcacggagcacagaggacccacatggaacgtggggctgagtcttggtttccttgttgcttattttagaaggtgtcagtgtagaggtgcaagtggtggattcgnggaggtggtgtcggtccagtccgtaggactaactcccgagacgacttctccgtgtcgcacgtccgtgtaggtatttacctaccgtttttaagtagtttatggaagtgaagtcgttcggggtcccgactaaacggacctccgggaaggggtaacggggtcgttacgggtacggtttccggtaacggaaccctaaaacgaaccgttaaaaccgaagtaaggtaaagggggtaaaaggtaaaaaaacttaaaccgtaagttagggtaacggtaacccgttagtttaaggggacggtaaaaccgggtcccgtaattaaccccgtaacgtaaccgttaccgtaaccggtaaacggaacgtaaacccgaaaccgaaccggaaaacggttaacggtaccgtaaacggtttaacttactacgtaacgtaactaaaacgtacggaaacgttacggacgttaacggaagggtaccggaaccggtaacgggtaacccgaggtaccgtaacggtaaccgttaacggttacgtacgtacggaacggaacggtaacgacgttaccgttaacggttaccttacggtttaaccgttcgttttagcccgtttacggg

SEQ ID NO: 45856 - DNA, 795 bp, Homo sapiens
  misc_feature: GYAE6OF01EECGV.27.57.F02.1.454.CMB.1.raw
  modified_base (270)..(270): a, c, t, g, unknown or other
  misc_feature (270)..(270): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgttgggttttccttgttgcttattttagaaggtgtccagtgtgaggtgcaacgtggtggtattcgtgggaggaggtgtggtccagccgtggagactccctgatcctctcctgtcgcacncctcgtggtacttcctacctttagtagttatggatggagtcgtcgggtccgccgagaccgtccggaaggggacggggtcttagggtacggttcggtacggaacccaaaacgtaaaccgtaaaaaccgaaaggtaacggtaaaggggtaaaaaggttaaaaacgtaaaacgttagttacgggtaacggtacttcggtagggtaacggggaaacgggtacccgtaacttacccgaacctaactttccccgaaccgaaggaaaccgaaacccgtaaacccggaaccgaaaaggtaaaccgtccgtaaaccgttgttaaacgtccacggaaaccttaaaggtaacgaaaccgtccgtaaccgtagggaaaccgggtaccggaaccggggaacgaaccggaaccgggttcttaaagggtaaccttaccgtaaggttgggaaccggaaggtaacggtaccgttacttaaccgggttactttaccggttacccgttttccggttttaacgttttccggaacgtttccccggg

SEQ ID NO: 45857 - DNA, 904 bp, Homo sapiens
  misc_feature: GYAE6OF01D3W5B.27.57.F02.1.454.CMB.1.raw
tcagagcgtcgtctcacgaccggtgctcgatttagctcgatatagttgggtttgaggtctcagagaggagccttagccctggacctccaaaggcccttttccacttggtgatcagcacggagcacagaggacccaccatggaactgggctgagcttgggttttccttgttgcttatttttagagttggtcgtcgtagtgtaggtaggtcgactaacggtggtagtattcggagggagggtggttggtcgtaccgtaccggtccgtaggaacgtaaccgttcccgtagaacgtcctccgtccgtgcgcgacgtccgtcgtagtacttaccttacgttttaagttagtttagtaggagtgacgtcggtccgggtacccacgaccgtaccgaacggggaaggggtacggtcggtacgggttacgttccggaaccgaacctaaaacgtaaaccgtaaaaccgaaaggtaaggtaaaacggggtaaaaaggttaaaaacgtaaaacgtttaggtacggtaacggtaccgttagggttaagggtaaacgggtaacccgggtaaccgttacctaaaccccgtaaccgttcccgttaaccccaacggaaaacgtaaacccgaaaacccgaaacccggtaaaacgtaaacggtaaccgtttacctaacgttacgtttacgtaaccgtaagtaaaccgttaaagtaaccgaaccgtacccgtaggtaaacggaaccgggtaacccgggaacccggtaacggaaccgttacccggtaagtttaaacgtacccgttaaacggtttccggtgggtaaccggaagggttaaacgtaaaccgtttcccgtttaaccccgtaaagggttttcccctttaacgggttttttcccctttaaggttttcccggtaaccccggg

SEQ ID NO: 45858 - DNA, 916 bp, Homo sapiens
  misc_feature: GYAE6OF01BONWX.27.57.F02.1.454.CMB.1.raw
tcagagcgtcgtctcacgaccggtgctcgatttagctcgatatagttgggtttggggaggtctcagagaggagccttagccctggactccaaggcctttccacttggtgatcagcacggagcacagaggaccccacatggaactggggctgagctgggttttccttgttgcttatttagaaggtgtccagtgtgaggtgcaacgtggtggattcgtgggaggaggtgtggtccagccgtaggacgtaactcccgtagacgtacctctaccgtgtcgcacgccctcgtggtactttcctaacctttttagtaagttttagtaggtagtggtacgtcggttacgggggtccccgccgaacggaccgttcccggaagggggtaccgggggtccgtaggggtaacggtttcgggtacggaaccccgtaaaacgtaaacgttaaaaaccggaaaggtaaggtaaacggggtaaaaggggttaaaaacgtaaaaaccgttaaggtacgggttaacggaacctttacgtagggtaacggaaacggggtacccgtaactttacccgaacccgtactaccccgtaaccgaaggtaacgaaccccgtaaaccggaaccgtaaaagtaaccgtactaacgttacgtaactcgtacgaaactaaaccgttacgaaaccgtacgtaccggtacgggaaccgtaaccgggacccgggtaaacgggtacccggtaaccggggttaacgtaacggttaaaccgttaaccgtttaaccgggttacgggttaccgggtaaaccgggtaaaacggtaacgggttaacccgttttaacccccgggttaaacggttttaccccgtttaaaccccgggtttttaccccgggttttaaccccgttttttagggtaacccggtttttaacccccgggggg

SEQ ID NO: 45859 - DNA, 869 bp, Homo sapiens
  misc_feature: GYAE6OF01DLWKS.27.57.F02.1.454.CMB.1.raw
  modified_base (183)..(183): a, c, t, g, unknown or other
  misc_feature (183)..(183): n is a, c, g, or t
  modified_base (258)..(258): a, c, t, g, unknown or other
  misc_feature (258)..(258): n is a, c, g, or t
tcagagcgtcgtctcacgaccggtgctcgatttagctcgatatagttgggtttgaggtctcagagaggagccttagccctggacctccaaggccctttccacttggtgatcagcacggagcacagaggacccacatggaactgggctgagctggttttcctgtgtctattttagaagtgtccngtgtgagtgcactggtgatcgtggaggagtgtggtccagcctaggagtaactcccgtagacgtactcgtccgtgngctacgtcctcgtagtacttcctaacgttttagtagttattggattgacgtcgttccgggtccgaccgtagtaccgtaccggagggggtaacgggtccgtaagggtacggttccggtacgggaaccccaaaacgtaaacgtaaaaccgtaaaggtaacggtaagggtaaaacgggttaaaaacgaaaaacgtttaggttagggtacggtaacctaccggttaggtaacggtaaacgggtcctaacttaccgacccgtaacttcccgtaacccgaggaaacccgtaacccgaaaccggaacccgtaaaagggtacccttacccgtaaacgttacgtaacgtttaccgaacggtaaacccgaaaacttaccgggaaaaccggccgtttaaccccggtaaaggaaacgggttacccgggaccggttaaacggaacccggtttacccggtaacgggttaaaccctttaaacgtacccggttaaggttacccggttaacggggaaaacccggaggttaaacccggttaacccgttaccggtttaaaaccggttccccctttaaacggtttccccggttttaaccgttttacgggggtaaccttttacccccggggg

SEQ ID NO: 45860 - DNA, 913 bp, Homo sapiens
  misc_feature: GYAE6OF01BB5P0.27.57.F02.1.454.CMB.1.raw
  modified_base (841)..(841): a, c, t, g, unknown or other
  misc_feature (841)..(841): n is a, c, g, or t
tcagagcgtcgtctcacgaccggtgctcgatttagctcgatatagttgggtttgaggtctcagagaggagccttagccctggactccaaggtcctttccacttggtgatcagcgacggagcacagacggaccccaccataggaacgtggggctggagtcgtttgggtttttccttgttgtactttagttttaggaggttgtccgtaggtggtgtagggtgacgaacgttgggttggtagtttcggaggggtagggtaggtggtcggtaccgaacgtccggtaggtaacgaaccgttccccgtaggaccgtaccttccgttccgtaggtcgacgtaccgtccgttcgttacggtacttttacccgttaaccgtttttaagtttacggtttagttacggtagttacggacgtccgggtcgggttccccccggacgaacgggtacccgtaccgggaagggggtaacggggtccgttagggtccgttacggtaccgaccaaaacgtaaacgtaaacgtaaggtaacggtaaaggtaaaggtaaaaacgtaacgtttagtacggtacgtacgtagtacggtacggaacggtacccgttactaccgaaccctcgttacccggaacccgtaaggaaaccccgtaaacccgtaaacccggtaaacccgtaaaagggtttaaccccgttaacttaacggtttaccgttaaccgttaacgtaacgtaaacgttaaaacgttacggaaaccgttaccggaccgttaacgggaaggggtacccgaaaccggggacgtaccggaccggtttaaccgaggttaaaccgttaccgtaaggttcgacgggtaacggngttaaaccggtacctttaccgaaacgttccgttttaaccggttaccgttttacgtttacggttcctccgggg

SEQ ID NO: 45861 - DNA, 748 bp, Homo sapiens
  misc_feature: GYAE6OF01A1EL3.27.57.F02.1.454.CMB.1.raw
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
  modified_base (739)..(739): a, c, t, g, unknown or other
  misc_feature (739)..(739): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttccttgttgctattttagaaggtgtccagtgtgaggtgcaactggtggattcgtggaggaggtgtggtccaggcctggagaatccctgagactctcctagtggcacggcctcgtggtatttcctaccgtttaagtagtttaacttgggattaggagacgttcgggggtcccnccaacgtaccgttccgaagggggtaaggggccttaggggnggtttaccggtgggacccctaaacgacgttaaaacccgaaggtacgtagggtaaaacgggtaaaaacgtaaaaccgtagtaggttaacgggaccgtttacgtaaggttacggaaaacggggtcccgtaacttacccgtaacctacgtacccgttaccggacggaaacgggtaaccctaaaccggccgtaaaaagggtaccgttacgaaccgtttagggtaaactttccgacgtaacgaaaacttggaaaacctggttacccagggaacgtaacgtcccgggagtaacaccggggtacttggtaacctacgttacgtggtacgacgtaacggtactactaccgtacgttacaaccgttccgttattttaggntttaccggg

SEQ ID NO: 45862 - DNA, 768 bp, Homo sapiens
  misc_feature: GYAE6OF01EY3GQ.27.57.F02.1.454.CMB.1.raw
  modified_base (762)..(762): a, c, t, g, unknown or other
  misc_feature (762)..(762): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagccgtggagactcccctgacgtactccttcctggtcgcacgtccttcgtggtactttccgtaacctttttaaggtagtttagttagggatggtacgcgtcgggggtcccaccaaggacccgttcccgggaaaggggggaaacgggggtcttaggggtacgggtttccgggtacgggaacccccaaaaacgtaaaccgtaaaaacccgaaaggtaacgttaaggggaaaacgggttaaaaaagtaaaaacgttagttaggtaacgggtacttcgtagggtaacggaaccggggtacccgtaacttacccaacccgtaacgttccccgtaccgaaggaaaccggtaaacccaaaacccggacccgtaaaacggtaacgtacccgtaacgttacggtaacttaccgtacgaaacgtaaaacgtcggaaaactcggacccgttaaggacgggacgtaccggaacggacgacggtacctgttaacgtactacgtgtcgacgagacgtctacgtcgtacttcttaccgttcttttaggnttccgg

SEQ ID NO: 45863 - DNA, 785 bp, Homo sapiens
  misc_feature: GYAE6OF01DU4IG.27.57.F02.1.454.CMB.1.raw
  modified_base (226)..(226): a, c, t, g, unknown or other
  misc_feature (226)..(226): n is a, c, g, or t
  modified_base (568)..(568): a, c, t, g, unknown or other
  misc_feature (568)..(568): n is a, c, g, or t
  modified_base (661)..(661): a, c, t, g, unknown or other
  misc_feature (661)..(661): n is a, c, g, or t
tcagagcgtcgtctcacgaccggtgctcgatttagctcgatatagttgggtttgaggtctcagagaggagccttagccctggactccaaggccctttccacttggtgatcagcacggagcacagacggacccacagtggaacgtggggctggagtcttggggtttttccttgttgtcttatttttagaaggttgtccagtggtgaggtgcacgtggtggtattcgngggaggtaggttgtcggtccaggcctgggaacgaactccccgtagacgtaccttccgtctggtgcgacgcctcgtgtacttctaccgtttagtagtttagttaggacttggacgtcgtcgggtcccgaccgacgaccgtaccgggaggggagggtccgtgggtaacggttcggtcggaacccaaaactaaacgttaaaaccaaggtaagttaacggggaaaagttaaaaaggaaaacttaggttaggacggtaacttcggtagggacgggaaacgggtacctacgttaccaacctactacccgtacgaaggaacgaacccgaacgtaacccgaaagtacctntacgttaagtctttacggataacccgtaaaagtaccgaaacgacgttacccgaggaacgggtaccggaacccgggacggtaaccggaccggtntttaacggtaactacccgttaggtggtccgggaactaagggaccggttaaccttacggttaaaccccgttttgtaaacccccgtttttggttttacccgtttaagggtaccgtttacccggggg

SEQ ID NO: 45864 - DNA, 835 bp, Homo sapiens
  misc_feature: GYAE6OF01D7ASA.27.57.F02.1.454.CMB.1.raw
  modified_base (704)..(704): a, c, t, g, unknown or other
  misc_feature (704)..(704): n is a, c, g, or t
  modified_base (743)..(743): a, c, t, g, unknown or other
  misc_feature (743)..(743): n is a, c, g, or t
tcagagcgtcgtctcacgaccggtgctcgatttagctcgatatagttgggtttgaggtctcagagaggagccttagcccctggactccaaggcctttccacttggtgatcagcacggagcacagacgacccacagtcggaacgtggggctggagtcgtttgggttttccttgttcgtcttaagttttaaggaggttcgtcctaggtgtaggaggttcgactaacggtgggtaggtgtttcggtggggaagggtcgggttggttcgggtacccgtacggtacccgttagggaaccgtaaccgttccccgaaggtacgttacccgttccgttccgttcggttcgacccgaccggttccccttcggttacggtacctttacccgtttaacgtttttaacggtttagtttaggttacggtagtcggaccgggtccggttccgggtcccgtaacgaccggtacccgggtaaccgggaagggggtaacggggtcggttacggggttaacgttccggggtaccgaaacccgaaaacttaaaccgaaaccggtaaaggtacgggtaaagggtaaaacggtaaaacgtaaagtacgtaggtagtaccgtaggtacggtacgggacggtctacctaccgacctacgtcccaacgtaggaacgtaacccaacgaaccgtagtaacctacgtactagtcttacgaataacgttaanaccgtaacgcgtcgtaacggcgaccggacgaacgggacncgggtttacgataccgttactacgggtgaccggtaagacgtacgtacccttataccggttcttaacttccgtttcttcggtcgtaacccggg

SEQ ID NO: 45865 - DNA, 667 bp, Homo sapiens
  misc_feature: GYAE6OF01BYK35.27.57.F02.1.454.CMB.1.raw
  modified_base (178)..(178): a, c, t, g, unknown or other
  misc_feature (178)..(178): n is a, c, g, or t
  modified_base (239)..(239): a, c, t, g, unknown or other
  misc_feature (239)..(239): n is a, c, g, or t
  modified_base (325)..(325): a, c, t, g, unknown or other
  misc_feature (325)..(325): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttcctgtgctatttagaggtncagtgtgaggtgcaacgtggtggtattcgtagggaggtggtgtcggtccagtcctaggganaactcccaggacgtacttcgtcctgtcgcacgtcctcgtggtacttccgtactttagtagtttattcggatgacgtcgtcgggccncgacgtacgtaccggagggagggctagggtagtcggtcgacctaacacgtaaaccgagtacgtaagggaaacgtaaactaacgtcgttaggtacgacttacgtggtaaggaccgggtacctacttaccgactacttaccgacgaagtacaccgaaccgacgaaagacgtcactacgtactcgagaactaagtcgaacgcgtaccgtagaggacccgtacgggaacggccgtaacggtcgtacgttagtaaccgttagtacggaccgttaggacgtacggttaccctccggtttaaagtcccgttacgttttaccccggtagtttttcccgagttacccgggg

SEQ ID NO: 45866 - DNA, 649 bp, Homo sapiens
  misc_feature: GYAE6OF01BCVUU.27.57.F02.1.454.CMB.1.raw
  modified_base (315)..(315): a, c, t, g, unknown or other
  misc_feature (315)..(315): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaactccctgagtactctccgtgtgcagcctctggacttctacctttaggtacgtttattggatgagtctcggggtccncagactaccggaggggaagggctagggtacgttcggtcggaccaaacaactaaaccgaagagtagggaagtaaaacgaaaactgttggacgacttcgtggaggaacgggccgtaattaccgaacctataccgtaccgaagaacgaaccctaaaccgaccgaaaaggtaacgctaacgtgtacgtccgataactaaatagaaccacggcctaggaaacggtcggaccggaacggacgacggtacctaggtaacttacgtacgtaggtcgtaggacgtacgtaacgttcccttaagtcctaaccgttttcccggttacttttaggcttaacccggg

SEQ ID NO: 45867 - DNA, 959 bp, Homo sapiens
  misc_feature: GYAE6OF01CEVXJ.27.57.F02.1.454.CMB.1.raw
tcagagcgtcgtctcacgaccggtgctcgatttagctcgatatagttgggtttgaggtctcagagaggagccttagccctggacctccaaggccctttccacttggtgatcagcacggagcacagacggacccaccatggaacgtgggctggagtcgttgggtttttccttgttgtctttaagtttttaaggaacgggttcgtacctaggtggtaggagggtgactaaacggttgggtcggattcggtgggagggaggttgtcgggtcccgagtccgtaggaacgaacctcccgtaggacgtcctccttccgtggtcgaccgtcgtcccttacgttacggtactttaccctttaaaccgtttttagtttaaggtttaacgttggtagtcggtacgtccgggtttaccggggtacccgaccgtaccggtaacccgtaccggggtaacggggggtaacggggttcgggttagggttaccgggtttcgggtaaacccggtaaccccgaaaaaacgtaaaaccggtaaaaaccgtaaaggtaaaccggttaaaggggtaaaaaggttaaaaaacgtaaaacgtttagtacgggttaacgttaacgtacggttaagggaacggggtaaaccgggtacccgttacgttacccgaacccttaagtccccgtaacgtaaaccgaacggaaaccccgtaaaccggaaaccggtaaaacgaacccgtttacgtaccgtttaaggtacttaaccgtaagtaacggtaaaactaccgggactaacccgggtcgtaaacgggaggaccggtaccgggaaaccgaccgggttaacggtccgtttaacggaactttaccggttaacggttgggaccggttaccgtaaggaaaccggttcccttaaccggtttacgttaaacccgggttttaccgtttcccgttttcggtttaaaccgtttccggtaccccgggg

SEQ ID NO: 45868 - DNA, 790 bp, Homo sapiens
  misc_feature: GYAE6OF01CFMEB.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtgattcgtgggaggaggtgtggtccagcctggagaactcctgacgactctcgtgtcgcagtcctcgtggtacttcctaccttttaggtagttagttggattggacgtcggttacggggtcccgaccgtaaggtacccgtccgggaagggggtaacggggtccgttggggtaacggtttccggtacggaaccccaaaacgaaacgttaaaaaccgaaggtaaggtaacggggtaaaaacggtaaaaaacgtaaaacgttggttaacggtaggtaacccgttcgtacgggtaacggggaagggacccttaattacccgaacccttagttcccgtaaccgaaggtaacgaaaccccgaaccgacccggaaaagggtaactacccgtaagttaggttaaacctacgttaacgaacgttaaaagtaccgaaaccgtccggtaacccgtaggaaccgggtaaccggaacccgggaaggacccgtaaccgggtctttaacgggtacttaaaccgtggtacggtacgggacggtaaagaccggtacttccggttagtaaccttccgtttccgttcgttttagcttacccggg

SEQ ID NO: 45869 - DNA, 870 bp, Homo sapiens
  misc_feature: GYAE6OF01B48WW.27.57.F02.1.454.CMB.1.raw
  modified_base (195)..(195): a, c, t, g, unknown or other
  misc_feature (195)..(195): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttccttgttgctattttagaggtgtccagtgtgaggtnctaacgtgggtgattcgtgggaggaggtggtcggtccaggtccctagggaacgtaacctccccgtaggacgtaccttccgtaccgtggtcgcctacggtcccctttcgtacgggttacctttcccgttaaaccgtttttagttaaggttttaagttggtaattaggacgtccggttccggggtccccacccgtaacgtacccgtaccgggaagggggtaacggggtcgtagggtacggtttccggtaccggtaaccccaaaacgtaaaacctaaaacccgtaaaggtaacggtaaagggaaaaacgggttaaaaaacgtaaaacgtttacgttagggtaaccggtaaccttccggttagggaacggggtaaacccggggtacccgtttaacttaccccgaaccttaaccgttacccgtacccgaaagggtaaacccgaaacccgtaaaacccgaacccgtaaaaggtaacccgtaccttaacccgttattaacgttcctaacgaaactaaacgtacgaaaccgtcgtaacccgtagggaaccggtacccggaccggtaacggaccgtacgggtcttacgggtaaaccttcgtacgttcggtcgaaggaggtaacgtccttaaccgttacgtacctttacccggtttacccgttgttttaccgcgtttaccccggg

SEQ ID NO: 45870 - DNA, 691 bp, Homo sapiens
  misc_feature: GYAE6OF01BAMIX.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagccctggagaactccctgagactctcctgtgccagcctctggattcacctttaggtagtttatggtatgagcgtggccgcagcctcgagggaagggctggagttcgtaggccaaacataaaccaagtagtaggaaacggtaaaagaaaactgtaggtggtaacttcgtggtaggaacgggtcccgtaatttcccgaacctactacctccgaaggaacgtaaaccaaacccgaccgaaaggtaaacgtcctaacgtacggttaactacgttacgaacgtaaaactacggtaaaccgacggtaccctacgggaagtaaccggaccggtaacgggaaccgaacccgggtcttacggtaaactttaaccggtaccgttagggtcggtaacggaacggtaacggtaccgttacccgttaaggttacctaacgtttccccgggttacttttttaggctttaccccggg

SEQ ID NO: 45871 - DNA, 713 bp, Homo sapiens
  misc_feature: GYAE6OF01D3ETK.27.57.F02.1.454.CMB.1.raw
  modified_base (118)..(118): a, c, t, g, unknown or other
  misc_feature (118)..(118): n is a, c, g, or t
  modified_base (122)..(122): a, c, t, g, unknown or other
  misc_feature (122)..(122): n is a, c, g, or t
  modified_base (174)..(174): a, c, t, g, unknown or other
  misc_feature (174)..(174): n is a, c, g, or t
  modified_base (201)..(201): a, c, t, g, unknown or other
  misc_feature (201)..(201): n is a, c, g, or t
tcagagcgtcgtctcacgaccggtgctcgatttagctcgatatagttgggtttgaggtctcagagaggagccttagccctggactccaaggcctttccacttggtgatcagcacggancacngaggacccacatggactggggctgagctggtttcctgttgctatttagagtnctagtgtgagtgcacgtggtcgatcgnggaggaggtgtcggtccaggaccgtggacgaactcccgtagacgtactcgtccgtgtcggcctaggccttcgtacggtacttccgttaacgtttagggtatttaaggttcgggaacttacggttcggtcggtaccgggttacccggtaccgtaaccggtaacggttcccggggaagggtaagggggtaaccgttcggtaggtttacccggaaggtacccaaaaggtaacctaaaaccggtaaacgaagttacgggaaacgttaaaagaaaaccgtgtttacggacgttacttaggtacggaacggacggacctacgtaacgtacctacgtacgtaccgacgtaacgaaccgaaacgaacgaacgtacgacgtactacgtaacgtacgtaacgtaacgaacgacgtaacgtacgacgacgacgacgacggacgacgtacgtacgtacgtacgtacgtacgtacgtagacgtcgtacgtacgtacgtacgttacgttacgttcgttcgtgtacg

SEQ ID NO: 45872 - DNA, 737 bp, Homo sapiens
  misc_feature: GYAE6OF01BYM8I.27.57.F02.1.454.CMB.1.raw
  modified_base (200)..(200): a, c, t, g, unknown or other
  misc_feature (200)..(200): n is a, c, g, or t
  modified_base (705)..(705): a, c, t, g, unknown or other
  misc_feature (705)..(705): n is a, c, g, or t
  modified_base (731)..(731): a, c, t, g, unknown or other
  misc_feature (731)..(731): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggttttcctgttgctatttagaggtgtccagtgtgagtgcactggtgnttcgtggaggaggtgtggtcctagcctggagaactcccgtagagactctctgtcgcacgccgtactggtacttccgtaactttagtagtttagtggtattcggagtcgtcggggtacccgtaccgaacggtaccgtcccggaagggggtaaccggggtcgtcggggttacggtttcgggtacgggtaccccaaaactaaacgtaaaacccgtaaagtacgtaaacgggggaaaggttaaaaacgaaacgttaacgttacgggtaggtacgttacgtagggtaggaacggggtaccctacgttaccgtaacctaacttcccacgtaacggaacaaaccgaacccgtaaacaaaggaaccgttacgtaccgttaggtaccttacgtaaccggtactaaaacgtaaccgtaacgaaccggtacccgttagggaacggttaaccgggaaccggaacggaacgtaaccggtcgtaaggttactacgtaccgttgcggtacgaagtacgtntacctggtacctacgttacgttcttncgttcg

SEQ ID NO: 45873 - DNA, 843 bp, Homo sapiens
  misc_feature: GYAE6OF01A8JJ1.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaacgtggtggattcgtagggaggtaggtgtggtccagccgtaggaacgaactcccgtgacgtaccttctcctgtgcacgccttcgtggtactttccgtaacttttagtagtttagttggtatggacgtcgtcggggtcccacgtacgaccgtaccggaaggggaacgggtcgtagggtacgtttccggcggtaaccaaacgtaacctaaaaccgaaaggtagttaaggggtaaaagtaaaaacgtaaaacgttggtacggtaacggtacttacggtaggttaacgggaaccgggtaccgttaacgtttaccgaaccctacgtttacccgaaccggtaacgaaacccggaaacctaaaacccggaaacccggtaaaaacgggttaaaccggttacccgtaaaccgtttagttaaaccgttaccgtaacggtaaacctaaaacgttaaccgggaaacctaccggtacccgtaaagggaaccgggtaacccgggaccggaaacggtaacccggtaccggtacgtttaaacgggttaacttacccgtaaccggttgggtaccgtacgggaacgtaaacggaccttttaacccggtacgttaccgtttacccgtttacccggttttatttacggtacccgtttaccggg

SEQ ID NO: 45874 - DNA, 804 bp, Homo sapiens
  misc_feature: GYAE6OF01EXAVS.27.57.F02.1.454.CMB.1.raw
  modified_base (251)..(251): a, c, t, g, unknown or other
  misc_feature (251)..(251): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtggggctgagtcgttgggttttccttgttgcttattttagaaggtgtccagtgtggaggtgactaacgtggtggtattcgtgggaggtaggtgtggtccagccgtgganactccctagacgactctccgtgtcgcacgcctcgtaggtacttacctacgtttagtagttagttggatggacgtcgtcgggtcccacgacggtccgtaccgggaggggtacgggtcgtagggtcggttcggtaccgaaccaaacgtaaactaaaccgaaggtaacggtaagggtaaaaggtaaaaactaaacgtaggttaggtacggtacttcgtagggtaacggtaacgggtcctacttaccaccgtacgtaccgtaccgaaggaacaacccgtaaaccggactaaaacggtacgtaccgtaacgttagttaaccttacgtaacggtaaactaaacgttaccgaacccgtaacggtccgttaagggaacccggtacgggtaacccggggaacaacccgggttaccggtacggtttaacgttaaccgtaaccggttaccggttagggtacccggtaaagggaaccgttacggttacctttaaccggttaaaccgttccccggtttaccggtttaccccggtttttatttcccgggtaaccggtttacccgggg

SEQ ID NO: 45875 - DNA, 893 bp, Homo sapiens
  misc_feature: GYAE6OF01ETPPP.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcgagagaggagccttagccctggactccaagggcctttccacttggtgatcgagcacggagcacgagacggacccaccagtcggaacgtgggggctgacgtcgttgggttttccttgttgcttattttagaggtgtcagtgtgaggtgactaagtggtggtattcgtgggaggtaggtgtggtcccaaggtccgttaggggaactaaccgttccccgtaggtacggtaccttccgttacccgnggttccgcgtaccggtcccttcggtggtaacctttcctaaccgttttaggttaagtttagttggagttaggtcgtcggttcggggtcccgaccgaggtaccgtaccgggaagggggaacggggtccttagggtacggttccggtccggaacccaaaacctaacgtaaaacccgaaaggtacgtaacgggaaacggttaaaaacgaaaaccgtttagtacggtacggtaactttccgggtaggtaacgggtaacgggtacccgttaacggtttacccaaccgttaaccgtaccgttaaccgaacggttaaccggaaaacctaaacccgggaaccctaaaacgggtaaacccgttacgtaaacccgtttacgtttaaacgttacccgttagtaaaacccgtaattaaccgaaaccgtaccggtaacccgtagggaaaccgaccgggttacccggaacgggtaacccgtaacgggttaccttacggttaaacgtttacccgtaaggtttcggtacccggtaggtaaccggtaataacccgtttcgtaacgtaccttaccggttaccgttttagtttaaccgcgtttacccggg

SEQ ID NO: 45876 - DNA, 870 bp, Homo sapiens
  misc_feature: GYAE6OF01B3YQF.27.57.F02.1.454.CMB.1.raw
tcagagcgtcgtctcacgaccggtgctcgatttagctcgatatagtttgggtttgaggtctcagagaggagccttagccctggactccaaggtcctttccacttggtgatcagcacggagcacagaggacccacagtggaacgtgggctgagtcgttcgggttttccttgttgtacttagttttaggaaggttcgtacctaggttgtggtaggtcgtactaacggttgggtaggtatttcggtagggagggtagggtggttcggtccgaggtccgtaggaacgtacttcccgtagacgtacctccgttccgtgtcgaccacgtcccttgtacggttacttaccgtttaaccgtttaggttagtttagttaggtgtacgggtacgttccgggttccgggtacccctacggaacggtacccggtaaccggggtaagggggtacggtacggtacggggttaccggttacgggaccgtaacccgaaaagtaaaccgtaaaaccggaaaggtaaggtaaacgggtaaaaaggtaaaaacgtaaacgtttaggtacgggtaacggttaacttacggttagggtaacggggtaaaccggtaccgttaaccggtaccctaaccgtactttaaccccggaaccgaacgggaaaccgaaaaccccgtaaccgaaaccgaaaacggttcgtaacaacggtttatccgtacgtaacgaaacgttaaagaaccgtaacgacgttacgaacggaaccggaacccgggtaccggaagggacccgtacggtccgttaataccgttacccgttaggcgtacgaggtaacggtctaccgtttccgttaccgttactttcccgtttagttcgtttacggccgttcgggg

SEQ ID NO: 45877 - DNA, 690 bp, Homo sapiens
  misc_feature: GYAE6OF01BKO9X.27.57.F02.1.454.CMB.1.raw
  modified_base (164)..(164): a, c, t, g, unknown or other
  misc_feature (164)..(164): n is a, c, g, or t
  modified_base (209)..(209): a, c, t, g, unknown or other
  misc_feature (209)..(209): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (321)..(321): a, c, t, g, unknown or other
  misc_feature (321)..(321): n is a, c, g, or t
  modified_base (636)..(636): a, c, t, g, unknown or other
  misc_feature (636)..(636): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggactggggctgagcttggttttctgttncttattttagaggtgtcagtgtgaggtgctagtggtggtattcgngggaggtaggttgtcggtccagtccgtaggactactcctgacgcctctccgtgtcncncgcctcgtgtacttcttacgtttagtagttagttggatgacgtcgtcgggtccncgacggaccgtcgggaggggacgggtgtagggtgttcgggcgaaccaaactaacgtaaaccgaagtagtaaggaaaggtaaaacgtaattagtaggtagtacgttcggtaggtaacggacgggtacccgttactaccgaacctccgttaccgtaccgaaggaacgtaacccgtaaccgaaccgtaaagtaacccgtactaggttacgtaactcgtagaactaagtaacgtaacgtcggtacgaagacgggaccgaacgggacgaacgtaccgggttattacgtaaacgttctaagtacgggtcgaggtaacggtntccggttactacgttaccgtttcgtttaccgtttcgttttggtacttcccgggg

SEQ ID NO: 45878 - DNA, 723 bp, Homo sapiens
  misc_feature: GYAE6OF01CWOFQ.27.57.F02.1.454.CMB.1.raw
tcagagcgtcgtctcacgaccggtgctcgatttagctcgatatagttgggtttgaggtctcagagaggagccttagccctggactccaaggtccctttccacttggtgatcagcacggagcacaggacggacccacagtggaacgtgggctgagtcgttgggttttccttgttgtcttatttaggagtcgtccaggtgtgtaggtgctaagtggtcgtatgagggaggtggtgtcggtcagcgtaggagtacctccgtgactacctcgtccgtgtcgacctcgtccttcgtaggtacttccggttaacgttttgttagtttagttcggattggacggtccggtacgggtccccacgaacggtaccggtaacccggggagggggtacggtcggttagggtaccggttcgggaccgaaccgaaactaaacgaaaccgaagggtaggtaaacgggtaaaaaggtaaaactaacgttgtacggtagtaccgtggtacggaacgggacgttacgacctaccacttcgtaacacgacgtaaccgaacgtaaccgaacgaacggtacactaggtacttcgtacaacgtaacagacgaaacgcgtacgaaggaaccggtgaacccgggagaaccgtcggtactttacgaactacggtactggacggtactaggaaccgttcctaaccgtttcgacttttacctacgtttagtttcccgaggttaccccggg

SEQ ID NO: 45879 - DNA, 797 bp, Homo sapiens
  misc_feature: GYAE6OF01DVBAU.27.57.F02.1.454.CMB.1.raw
  modified_base (76)..(76): a, c, t, g, unknown or other
  misc_feature (76)..(76): n is a, c, g, or t
  modified_base (646)..(646): a, c, t, g, unknown or other
  misc_feature (646)..(646): n is a, c, g, or t
  modified_base (788)..(788): a, c, t, g, unknown or other
  misc_feature (788)..(788): n is a, c, g, or t
tcagagcgtcgtctcacgaccggtgctcgatttagctcgatatagttgggtttgaggtctcagagaggagccttanccctggactccaaggcctttccacttggtgatcagcacggagcacagacggacccacatggaacgtcgggctgagtcttgggtttttccttgttgtcttaattttagaaggtgtcagtgtcgaggtgctaacgtggtgtattcgtggaggaggtgtcgtccgagccgtggaagtactcccgtgacgtactctccgtagtgacagtcctcgtaggtacttccttacttttaaggttaagtttattaggtagtcggtacggtccggtttcggggtcccgaccgaacggtacccggttaccgggaagggggggtaacggggtcgttacggggtaacggtttaccggggaccggaaacctaaaacctaaaaccgttaaaaccggaaaggttaaagggtaaaggggtaaaaaacggtttaaaaacggtaaaaccgtttggtaagggttaccggtaacctttcgggttagggttaacgggaacgggtacccttaagttaccaacccgtacgtcctaacccgaaggaacccgaaaccgaaccggaacgtaaaacggtcgttaccgacttacggttanacgttaacgaataaacgtacgaaacgtcgtaaccgtaggaaggaccggaccggaagggaacccgtcgtacgtaacgtacttaccgaacggtgtaacgggaacgtggaaacctcgttactaacgttcttacgtttcctcttgngttcccggg

SEQ ID NO: 45880 - DNA, 683 bp, Homo sapiens
  misc_feature: GYAE6OF01BN2GW.27.57.F02.1.454.CMB.1.raw
  modified_base (121)..(121): a, c, t, g, unknown or other
  misc_feature (121)..(121): n is a, c, g, or t
  modified_base (179)..(179): a, c, t, g, unknown or other
  misc_feature (179)..(179): n is a, c, g, or t
  modified_base (208)..(208): a, c, t, g, unknown or other
  misc_feature (208)..(208): n is a, c, g, or t
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
tcagagcgtcgtctcacgaccggtgctcgatttagctcgatataggttgggtttgaggtctcagagaggagccttagccctggacctccaaggtcctttccacttggtgatcagcacggancacagagacccacatggaactgggctgagtcgttgggtttctgtgcttatttagagtntcagtgtgagtcgctagtggtgacttcgngggagggtaggtcggtcgaccgagtccgtaggacgaaccttccgagactcctcctcgngtcgacngtccctagtgtacttcgtacgtttagtagttgtaggctaggagtcggtacggcccacgacgacgtacggaaggggtacgtcgtaggtacgtcggacgaacaaacaaacgttaaacgaaggtaacggtaaaggggtaaaaagttaaaacaaagttgtagggtacctaacgttcggtaagggaacggaacggtaccttactaaccgtacctacgttaccgaacgtaacggaaccgaaaaccgaccgtaacgtaaaaccgcgttaaccacgttaagtaccaagtacaagtagaaccgaacgtcgaaccgtaaggacggacgacggtacgaccgagtactagtactacgtacgtaggcgtagacggaacttcgttaacctagttcccttacggtccttttagcgttatcccggg

SEQ ID NO: 45881 - DNA, 777 bp, Homo sapiens
  misc_feature: GYAE6OF01E2ET3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaagtgtcagtgtgaggtgcaacgtggtggtattcgtggaggaggtgtggtccgagccgtggagtaactccctgacgactcctcctggtcgcacgtccctacgtggtactttcctaaccgtttttaaggttagtttagttagggattaggacggtcgttccggggtcccaccgacgtaccggtaccggaagggggtaccggggtgttggtaggttccggtacgaccaaactaaacgtaaaaccgaaggtaagtaagggtaaaacggtaaaacgtaaaacgtagttggtacggtaacttacgtaggtaacggaacggtcctaagttacccacgtaccgttacctaaccgaagtaaccgaaacccgtaaccgtaccgaaagtaacccgtccgtaacgttacggttacctacgttaacgaaacgtaacgttaccggaaacgtccggttacgtaacggaaccgggaaccggtaaccgggaacgggtaaccccggacggttacttaacgggttacgttaaaccgtagttcgggtacgtacggaaacgtacgtaacccgttagtaacctttcgttaaccgtttccgtttacgtttagacggttccg

SEQ ID NO: 45882 - DNA, 822 bp, Homo sapiens
  misc_feature: GYAE6OF01AW1LQ.27.57.F02.1.454.CMB.1.raw
  modified_base (122)..(122): a, c, t, g, unknown or other
  misc_feature (122)..(122): n is a, c, g, or t
  modified_base (228)..(228): a, c, t, g, unknown or other
  misc_feature (228)..(228): n is a, c, g, or t
  modified_base (264)..(264): a, c, t, g, unknown or other
  misc_feature (264)..(264): n is a, c, g, or t
  modified_base (649)..(649): a, c, t, g, unknown or other
  misc_feature (649)..(649): n is a, c, g, or t
  modified_base (656)..(656): a, c, t, g, unknown or other
  misc_feature (656)..(656): n is a, c, g, or t
tcagagcgtcgtctcacgaccggtgctcgatttagctcgatatagttgggttgaggtctcagagaggagccttagccctggacctccgaacggcctttccacttggtagatcgagcacggancacgagacggaacccacagtaggacgtggggctgagcgttcggttttcttgtgtcttattttaggaacggtgtacagtgtggaggtgctaacgtggtggtacttgngggaggtaggtgtcggtcagcgtggaacgactccgngtacgacttcctccgtaggtcgacgacgtcctggtacgtacgtttacccgttaaccgttttaaggttaagtttgtacgggagttacggtaccgggtcggttaccggggttacccgacgtaacggtacccggttacggggaacgggggtaacggggttacgtacggggttaccgttacgggtcccgggaaacctaaaaccggtaaacgtaaaaccggtaaagaaggttaacggggtaaattaaaacggaaacgttggtacggtacggaaactttcgggtaggttacgggaaacccgggtcccgtaattacccgaaccgtatccccgaggtaaacggaactaacccggaacgaccgtaaaaggtaccctcgaccgtagtacgtaacncgtaaanaacgtacgaacgtaactacggtaccgaagggtcgtaaccggaaggtacccggtagtaacgtacgttaaccggtacttaggtaggttaacggacggtaaggaacgttccgtaacccgtacgttacccggttacttcccgggtttaactttgggtctttacccggggg

SEQ ID NO: 45883 - DNA, 877 bp, Homo sapiens
  misc_feature: GYAE6OF01BJE3V.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccacataggaacgtggggctgagtcgttgggttttccttgttgacttattttaggaggttgtccgagttggtggaggtgacgtaacgtgggtaggtattcggtagggagggtaggttggtcgggtaccgtacggtaccgtagggaacgtaaccttcccgtaggaccgtaccttccgtccggtaggtcgtacgtacgtcccgttacgtacggttaacttttacccgtttaaaccgtttttaggttaaggttttaggttacggtaagtggtacggtccggggttaccggggtcccccgaacggaccggtaacccgttaacccggggaagggggtacggggtaccggttagggtttacgggttaccgggtaccggaaacctaaaaccgtaaaacccgtaaaacggaaaggtaacggttaaagggggtaaaaacgtaaaaaacggttaacgttacgttaacgggtacggttacgttacggtagggttaaccggggaacggtaccgttactacccacgtacttaccgacgaacgaacaacgaaccggacaagtacgacgtgtaacgtatactacgaacttaagaaccgtaacgtaccgaggtaacgacgggtaacgaacccggaacggaccgtacggtaacgtaagttaaccgtacggttacgtaggacgggtacgtaacgggtaacttaccggttacgttaacccgttacggttcccgttttaacggttcgtttaacttccggggtaacccg

SEQ ID NO: 45884 - DNA, 590 bp, Homo sapiens
  misc_feature: GYAE6OF01BDC1K.27.57.F02.1.454.CMB.1.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (504)..(504): a, c, t, g, unknown or other
  misc_feature (504)..(504): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctggttttccttgttgactattttagaaggtgtccagtgtgaggtgcaatggtgattcnggaggngtgtggtcagctgganaatcctgagtcctntcgtgtgcagtcctctggtacttcaaccgtttagagtttaagttggaagttgaggctggggtcccncgagactccgagggaagggtctggattcggaggccaacgataaaccgagaagtggaaacggtaaagaaaacctgtagtacggactacgtggtagaaacggccgtattacccactaagtcctacgaaggaacgaacaaacgcttaaagaaacgttcaaacgttgaatcngactaaancgtaaacagtcctagaganccgagttacccagcgttaacctagaccctaagtgtacgtactggacgtactacggtaagtccaacgttgtacttttcggaatccgg

SEQ ID NO: 45885 - DNA, 751 bp, Homo sapiens
  misc_feature: GYAE6OF01DLK37.27.57.F02.1.454.CMB.1.raw
  modified_base (185)..(185): a, c, t, g, unknown or other
  misc_feature (185)..(185): n is a, c, g, or t
  modified_base (199)..(199): a, c, t, g, unknown or other
  misc_feature (199)..(199): n is a, c, g, or t
  modified_base (263)..(263): a, c, t, g, unknown or other
  misc_feature (263)..(263): n is a, c, g, or t
  modified_base (383)..(383): a, c, t, g, unknown or other
  misc_feature (383)..(383): n is a, c, g, or t
tcagagcgtcgtctcacgaccggtgctcgatttagctcgatatagttgggtttgaggtctcagagaggagccttagccctggactccaaggcctttccacttggtgatcagcacgagcacagaggacccacatggaacgtgggctgagcttgggtttttccttgttgtcttaattttagaaggtntccagtgtgaggtnacaacgtggtagattcgtggaggaggtgtcggtccaggcctggaagactcccgtgacgacttcncctgtgcagcctctaggtacttcctaactttagtagttagttgatgtagtcgtcggtccgactaggaccgtaccggaaggggtacgggcttagggtaacgttcggtacggaaccctaaanaactaaaaccgaaggtagtaagggaaaagtaaaaacgtaaacttagtaggtacggaacttcgtagggtacggaaacgggtcctaatttccgaaccgtattcccgtaaccgaagaaacgtaaccaaccgtaaccgaaaagtaccgttactagtttaccgaaattccgtaagtaaactaaagtccggaaactacggtaccctaagggaacgttacggaacccggaaggtaacccgtacgggtaccgtttaagttaaacccttaccgttaacggttccgggtaacggtacggtaaaacggtaccgttaactccccggttaaaagttcttaaccccggtttcgtttaccgttttagacccgtttacccgggg

SEQ ID NO: 45886 - DNA, 689 bp, Homo sapiens
  misc_feature: GYAE6OF01A4R52.27.57.F02.1.454.CMB.1.raw
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (551)..(551): a, c, t, g, unknown or other
  misc_feature (551)..(551): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgacgtcttgggtttccttgtgacttattttagaaggtcgtcagtgtgtaggtcncaagtggtgtattcgngggagtggtgtggtccaggcctggaacgaactcccgtagactactctccgtagtcgctacgtcctcgtaggtactttctaccgtttaagtagttagtgatgtagcgtacgggtccaccgagaccgtcgggaacggggtacgggacgtcgggtagttccggaccggtaccaaaacgtaaacttaaaccggaaagaacggtaaggtaaaacggtaaaaacgtaaacgttagaggtacggtacttacgtagacggtaacggtaccgtattacacctatccgtaccaagaacgtaacccgaagtaaccgaaacgtaactacgtaccgtagttaccgtanaaccgtaagtaaactacgaaacgacctacgtaggtaaaccgacggaaccgggtaccgaacggtacctaggtaacctaggtactacggtgtacgagtaaggactactacgtagtctagttcccgtttattctgtaccgg

SEQ ID NO: 45887 - DNA, 817 bp, Homo sapiens
  misc_feature: GYAE6OF01AM4C8.27.57.F02.1.454.CMB.1.raw
  modified_base (119)..(119): a, c, t, g, unknown or other
  misc_feature (119)..(119): n is a, c, g, or t
tcagagcgtcgtctcacgaccggtgctcgatttagctcgatatagttgggtttgaggtctcagagaggagccttagccctggactccaaggcctttccactttggtgatcagcacggancacagacgaccccacatggacgtggggctagagtcttcgggttttccttgttgcttattttaggagtgtccgtaggtgtagagtgactacgttggtagtcttcggagggaggtaggttcggtcggtaccaggtaccgtaggaagtaccttcccgtaggactccttcctacgtggtaccacgccgtccgtttcgtagtacctttacccgtttaacttttaaggttaaggttttaagttgggtacttaggtacggtcccggggtttaccgggtacccgaccgaacggtacccgggtacggggaacgggggtaggggtccggttagggtacccggtttacgggacccgttaaacccgaaaacgtaacctaaaacggtaaaggtaacggtaaaggggtaaaagtaaaaaccggtaaatttgggtacggttaacggaacgttcgtacgggttaacgggaacggacccttactaacccgtaccgttaaccgtacgtaccgaaagggtacctaaccgggaaacctaaccggaaacgtcgttaaccagtttcgtacgtacgttaccaaacgtataacgactacgaacgtacgaaggggtacaccggaacgtacgaccggttatacaccggtatacggtcttaggacggttaagcttaaccgttcgacttccggttaacttcgtttacgttaccttgggttacccgg

SEQ ID NO: 45888 - DNA, 608 bp, Homo sapiens
  misc_feature: GYAE6OF01AS1HT.27.57.F02.1.454.CMB.1.raw
  modified_base (304)..(304): a, c, t, g, unknown or other
  misc_feature (304)..(304): n is a, c, g, or t
  modified_base (478)..(478): a, c, t, g, unknown or other
  misc_feature (478)..(478): n is a, c, g, or t
  modified_base (601)..(601): a, c, t, g, unknown or other
  misc_feature (601)..(601): n is a, c, g, or t
tcagagcgtcgtctcacgaccggtgctcgatttagctcgatatagttgggtttggggaggtctcagagaggagccttagccctggactccaaggcctttccacttggtgattagcacggagcacagaggacccaccatggaactggggctgagcgtggtttcgtgtgctatttagaaggtgtccagtgtgaggtgcaatggtggattctggaggaggtgtggtccagcctggagaatcctgagacctctcctgtgcagcctgtggattccaactttagtagttattggatcgagctggggtccncagactcgagggacgggctgggattcgtgacaactataaaaccgagatagggaaagtaaaaagaaaacttagtgtacggtaacgtcttagagaaagggggttcccaaatttccaaccaagtcctaccgaagacgacctaaacgcgaaagaacggttaccaagggtattaactcncgtaactaaaagcgtaaaccagtacccgttagagacgtaccggaacggcgaacgtctggaaacttacgacttggagtacggagaacggatcccgtataccgtacttccggtacttttgacttntaccggg

SEQ ID NO: 45889 - DNA, 751 bp, Homo sapiens
  misc_feature: GYAE6OF01DG8O0.27.57.F02.1.454.CMB.1.raw
tcagagcgtcgtctcacgaccggtgctcgatttagctcgatatagttggtttgaggtctcagagaggagccttagccctggactccaaggcctttccacttggtgatcagcacggagcacagacggacccacatggaacgtgggctgagtcgttgggttttccttgttgtcttagttttagaaggttgtcagtgtgaggtgcaacgtggtgtattcgtaggaggtaggtggtcggtccacgtccgtaggaactactcccgtaggacgtctcctcgtgtcgcgtcgtccttcgtcgttactttaccgttaacgttttagtttagtttacgttggtagtcgtacggtcggttaccgggtcccgaccgtacggtaccgtccgggaaggggacgggtcgtgggtacgttcggcgacaataaacgtaacgaagtaagtaaggtaaacggtaaaacgtaacgttagtcggtagtacttcgtagggtacggtaacgggtaccttacttaaccacctacttacccgaccaacggtaacgaaacccgaaccgaaccgaaacgtaaccgtactaacgttacgtacttacgtaacgaacgtaaacgtacgaacgacgaccgtaacggacggacgaccggaacgaaccggtaccgttacgttacgtaactaccgttacggtcgttacggagtaaccggtaagttaccccgttagttaccgtaccgttacgttcccgttttacgtttagttccgttacccgggg

SEQ ID NO: 45890 - DNA, 936 bp, Homo sapiens
  misc_feature: GYAE6OF01CTWAE.27.57.F02.1.454.CMB.1.raw
tcagagcgtcgtctcacgaccggtgctcgatttagctcgatatagttgggtttgaggtctcagagaggagccttagccctggactccaaggtccctttccactttggtgatcagccacggagcacagacggacccacagtggaacgtgggctgagtcgtttcgggtttttccttgttgtactttaagtttttaaggaaggtcgtccaggtgtggaggtcgacgaacgtgggtaggtacgttgagggaggtagggttggtcggtaccgaggccgtagggaacgtaaccttcccgtagaacgttccttccgttccgttggtgcccgtacggtcccttcggttacggttaaccttttaacccgtttaaaccgttttttaagggtttaacggtttacggtttagggtagttacggggtaacggtcccgggggtttaccggggtaccccgaaccggtaaccggtaccccgggtaaccggggaacgggggggtaacgggtcggttacgggttacgggtttaccggaccggtaaaacccctaaaaacgtaaaaccgtaaaaaccggtaaggtaacggttaaaaggggtaaaaacggttaaaaaacgtaaacgtttaggttacgggtacggtaactttcgggtagggtaaacggtaccgggtaaccttacttacccgaaccttaacgtcccgtaaaccgaagggaaaccccgtaaaccgaacccggaaacgaaaaggtcgttacctaaacggttacgttacgtacgtaacgaaacgtagtaacgaacctcggactaacggacgggtaccgaaccgggagaacccggtcgtcgttaaagtaccgttacgtcggtagggtaaccgacgtaaaggtaccgttaccctaaccggtttcgtaaccggtttaccgttttccgttaaggtttcccgacggtttacccgggg

SEQ ID NO: 45891 - DNA, 595 bp, Homo sapiens
  misc_feature: GYAE6OF01BUIQ6.27.57.F02.1.454.CMB.1.raw
  modified_base (270)..(270): a, c, t, g, unknown or other
  misc_feature (270)..(270): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (428)..(428): a, c, t, g, unknown or other
  misc_feature (428)..(428): n is a, c, g, or t
  modified_base (474)..(474): a, c, t, g, unknown or other
  misc_feature (474)..(474): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccccaccatggaactggggctgagctgggtttccttgttgctattttagaaggtgtccagtgtgaggtgcaactggtggattcgtgggaggaggtgtcggtccaggcctggagaactccctgacgactctcctgtgcagcctntggacttccactttagtagttattggatggagcgtggggtcccacaggacctccggaaggggagggtctgggagttcggnggaccaanataaaccaagatagggaaagtaaagaaaactgtaggtcggactcgtgaggaacgggcctattccaacctntccctacgagacaacaaccgaccaagaactctacgtagtactcganaactaaatgaacgtacgaccgtaggacgacggaccggaacgtaccacggtctagtacttacgacgtgacggtagaggtacgacttccgtacgtccgttacttcccgttctttgccgttcgg

SEQ ID NO: 45892 - DNA, 913 bp, Homo sapiens
  misc_feature: GYAE6OF01DTM4C.27.57.F02.1.454.CMB.1.raw
tcagagcgtcgtctcacgaccggtgctcgatttagctcgatatagttgggtttgaggtctcagagaggagccttagccctggacctccaaggtcctttccacttggtgatcagcacggagcacagacggacccacagtgggaacgtgggctgagtcgtttcgggtttttccttggttgtacttaagtttttaaggaagggttcgtaccgtaggtggtaggtaggtcgtactaacggttgggtaggtagtttcggtagggggacgggtagggttggtcgggtaccctaggtaccgtaggggaactaaccgttccccgtaggaacgtaccttcctccgttcggcgacctcggtccttcggtaggttacctttaccgttaaccgttttagttaagtttcggtaggtagtacgggtacggtccgggtaccgggtacccaccggaacggcccggtaaccgggaagggggtacgggttcggttacgggttacggttccgtaacggaaaccctaaactaaaacgttaaaaccggaaggtaaacggtaaaggggaaaaaacggttaaaacgtaaacgttaggtacggtaccgtaggtacggtagggaacggtaacgggtccttaacgtacctaaccgtcgtaacccctaaggaacgaaacccgtaacccggaaaccgtaaaccgtaaacgtacgtaccgtacgttaagtacccgtagtaacgaaacgttaaccggacgaaaccggtacgtaccgggaaggtaaccccgggacggtaaaccgggaacccgtaccgggtagttaccggtttaacgttaaccgtcggtacgtaccggggtagtaaccgacgggtttacccaccgtttacccggtttaacctcgttttaccgtaccgtttttacggttcgtccggtttacccggg

SEQ ID NO: 45893 - DNA, 864 bp, Homo sapiens
  misc_feature: GYAE6OF01B7U0Q.27.57.F02.1.454.CMB.1.raw
  modified_base (808)..(808): a, c, t, g, unknown or other
  misc_feature (808)..(808): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactgggctgagcgttgggttttccttgttgtcttatttagaggtgtccagtgtgaggtcgacaacgttggtgtattcgtagggaggagggttgtcggtcccagtccgtgggactactcccgtagacgtactccgttcgtggtacgccgacgtccctacgtcggttactttaccttaaccgtttttaggttaagttttagttcggtaacgtggtacggtcggttacccggggttccccgacccgtacggtacccgttacccggggaacggggggtaacggggtcgttgggggttaccggttcccggtaccggaacccctaaaacgtaaaccttaaaaccgggaaagtaacggttaaacggggtaaaagggttaaaaaaccgtaaaacgttacggttaacgggtaaccgttacggttccggttaagggtaaccgggaaacccggggtacccttaacttacccgaaccgttactacccgtaaccgaaggaacccggaaccgtaaacccggacgtaaacggtacgtactaaccgttcgttaaactcggtaaccgtaacaaacgttaacggaacctaccgggtaccgtacgggaaccggaacggacccgggaacggacccggttacggtacttaccggttaacctacgttacggtgtacggacggttaaacggngttaaccgtccgttacgttacttacccgtttcgtttaacgtttcggtacttccggg

SEQ ID NO: 45894 - DNA, 758 bp, Homo sapiens
  misc_feature: GYAE6OF01BDY1P.27.57.F02.1.454.CMB.1.raw
  modified_base (318)..(318): a, c, t, g, unknown or other
  misc_feature (318)..(318): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaacgtgggctgagcttgggttttccttgttgtcttattttagaaggtgtccaggtgtgaggtgcacgtggtgattcgtggaggtggtggtcgtcagccgtaggagtaactccgtagacgtactctcgtgtcgcacgtctcgtgtacttctactttaggtagttagtgatgagtcgtcggtcncgacgaccgtcggagggggacggtcgtacgggtacgttacggcggaacaacgtaaactaaaccgaaggtacggtaaggtaaacggaaaaacgtaaacgtcgtagggtacgtaccttagggtacggtaacggggtaaccgggtacctacgtttaacccgaacgtaccgtacccggttaacccgaagggtaacccgaaacccgtaaccgggaaacctaaagggtacccgtacgttaacgttacggttaactcgggtaactaacccggtaaagttaccggaaaccggtacgacgggtaacggaccggaccgggttaaaccgggaccggaaacccgggtggttaacccgtagttaaaccgttacccgtagttacccgggagtacggaaacgtcgtacttaccggcgtttaactccggtttacttacgttttcgaacgttccggg

SEQ ID NO: 45895 - DNA, 711 bp, Homo sapiens
  misc_feature: GYAE6OF01BZIS6.27.57.F02.1.454.CMB.1.raw
  modified_base (214)..(214): a, c, t, g, unknown or other
  misc_feature (214)..(214): n is a, c, g, or t
  modified_base (662)..(662): a, c, t, g, unknown or other
  misc_feature (662)..(662): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaacgtggggctgagctgggttttccttgttgcttattttagaggtgtccagtgtgaggtgacaacgtggtggattcgngggaggaggtgtggccagccgtggagaactccgtgagactctctagtcgcacgccttactggtacttcctacctttaggtagtttactggagtgacgtccggtcgggtcccgcgaagtacccgtcggaaggggacgggtctgggtagttccggcggaacctaaacgaactaaaaccgtaggtaagtacggggtaaaacgtaaaaagtaaaccgtagtcggtaagacctttggaaggttacgggaacgggtccgtaacgttaccaaccgacttaccgtaaccgaagtaacgaaccgtaaacccggaacgtaaagtaacgtactaacgtagttacgtactaacgaataaacgtacgaaactaccgtaagacggacgtaccggaagaccgtagacgtagtaaccttacggctaggtacgaggtaaccggtagtaacccgttccgttaaacncggtttaaccctttcggttacgtttttacgcgttcccggttaaccgggg

SEQ ID NO: 45896 - DNA, 856 bp, Homo sapiens
  misc_feature: GYAE6OF01CTDV8.27.57.F02.1.454.CMB.1.raw
  modified_base (647)..(647): a, c, t, g, unknown or other
  misc_feature (647)..(647): n is a, c, g, or t
  modified_base (700)..(700): a, c, t, g, unknown or other
  misc_feature (700)..(700): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaaccacatggaacgtggggctgagcgttgggttttccttgttcgcttagttttagaggtgtccagtgtggaggtgctaacgtgggtggacttcgtaggggagggtagggttggtacgggtcccaggtacccgtagggtaacgtaaactccccgttaggaacgtccttcctccgttggtcgccacggtccctcgttaggtactttccgttaacctttttaaggtttaggtttagtttacggagtggtacggtcggtaccggggttccccgaccgtaacggtaacccgtacccgggaagggggaacgggggtcgttaggggtaccggtttcgggtaccggaacccaaaacgtaaacgtaaaaccgaaggtaaacgtaaagggggttaaacggtaaaaaaacggtaaacttaggttaacgggtcggttaacctcggttaggtaaccggggaacgggtccgtaacttaccgacctacgttaccgtaccaagggtaaccaaccgtaaccaaccgaaaggttaaacncgtaacgttacgtaactcgtaaccgtaaacgtaagaccgtaaacaaccgggtntaacccgggaaagtaccggggtaacccggaggtaaccccggacgggtttactaacggtttactaaacgtcggttacggtcgaaggtagttaccgggtacctttacccggtacgtttaccttacggtttacccttttggttcgtacgtttcccgggg

SEQ ID NO: 45897 - DNA, 692 bp, Homo sapiens
  misc_feature: GYAE6OF01DWTAM.27.57.F02.1.454.CMB.1.raw
  modified_base (183)..(183): a, c, t, g, unknown or other
  misc_feature (183)..(183): n is a, c, g, or t
  modified_base (326)..(326): a, c, t, g, unknown or other
  misc_feature (326)..(326): n is a, c, g, or t
  modified_base (649)..(649): a, c, t, g, unknown or other
  misc_feature (649)..(649): n is a, c, g, or t
  modified_base (657)..(657): a, c, t, g, unknown or other
  misc_feature (657)..(657): n is a, c, g, or t
tcagagcgtcgtctcacgaccggtgctcgatttagctcgatatagttgggtttgaggtctcagagaggagccttagccctggactccaaggcctttccacttggtagatcagcacggagcacagaggacccaccatggaactgggctgagcttgggttttccttgttgtctattttagaggtntcagtgtgaggtgcaacgtggtggtattcgtgggaggtaggttgtggtacccagtccgtggtaagaactccctgagtacctctcctgtgcacgcctcgtgtacttctacgtttagtagttagtagatgacgtcgtcgggtccnccgacgtaccgtacggagggggtaacgggtcgttaggacggttcgtacggaacccaaacgtaactaaaaccgaagtaacgtagggaaaacggttaaaagaaaacgttagttaggtacggtacctaggttagttacgggaaacgggtacctaacgttacccaaccgttatccctaccgagtaaaccgacgaacccgaaacgtaaacgtacgttacacccgttagtactaccgtagaactaacgtataaccgacgtaccgtaaggacggtaccggaccggacgaaccgacgacttaggttactacgtcgtagtcggaactaggtntacccgtntacgttctaacgtttcgtacgtttgacgttccggg

SEQ ID NO: 45898 - DNA, 834 bp, Homo sapiens
  misc_feature: GYAE6OF01BWAFV.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacgagaggacccaccatggaactggggctgagcgttgggttttccttgttcgcttattttagaaggtgtccagtgtgaggtgcaacgtggtggtattcgtgggagggtaggtggtggtccaggccgtgggaagaacttccccgtggaacgaccttccttcctgtcgctacgcctgtggtacttctaccgtttagtagttagtggatgtagtcgtcgggtcccgacgacggtaccgtaccggaggggaacggggtcgtgggtacggttccgggtaccgggaaccctaaaacctaaacgtaaaaacccgtaaaggtaacggttaaggggtaaaaacgggtaaaaaacgtaaaaacttacggttacgggttaacggtaccgtttacgtagggttaaacggaaaccggggtacccgttaacgtttacccgaaccctacttacccgtaacccggaaaggtaacccgaaaccgtaaacccggaaccgtaaaacggtaaaccggttacctaacgttaaggttaccttaccggtaagtaaacccgtaaacggtacgtaaacctaaccggtaccgttaggaacgggtaacccggaccggggtaacggaaccggtacccgggtaaccgttagttaaaccgttaacgttacgtacggtcggaaggtacgtaagttacttaccgtaccgttactaccgtttacccgtgttttacgcgtttacccgg

SEQ ID NO: 45899 - DNA, 773 bp, Homo sapiens
  misc_feature: GYAE6OF01AT2B0.27.57.F02.1.454.CMB.1.raw
  modified_base (670)..(670): a, c, t, g, unknown or other
  misc_feature (670)..(670): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactgggctgagcttggttttcctgttgcttattttagaggtgtcagtgtgaggtgacaacgtggtaggattcgtgggaggtaggtgtggtccagccgtggaagtactcccgtgacgcttcctctggtcgcacgtcctcgtggtaactttcctaaccgtttttaaggtagttttagttgggtaactggtacgtccggtttcggggtcccgaccgtaaccgtaccggtaccgggaaggggggtaacgggtcggttagggaacggtttcgggtacccggaacccaaaaacggtaactaaaaaccgaaggtaagtaacggggaaaagggttaaaaataaaaccgtgttacggtaacggtacttacgggtaggtacggggaaacggtcccgtaacttacccaacgtcttacccgtaccgaaggacgaacccaaaccggtaccaaaagtaccggtactaaccgttggtaacttacggtacctaaagtaagtaccgaaacgtccggtaacagggtaacgggacccgacggtaaacgggntacccgggtctaagtaccgttactacggtcggtccgtaagacggtaacttacgtacccttagtacccgtttacgtttcccgttattttcggacgtttcccggg

SEQ ID NO: 45900 - DNA, 694 bp, Homo sapiens
  misc_feature: GYAE6OF01ECEPG.27.57.F02.1.454.CMB.1.raw
  modified_base (315)..(315): a, c, t, g, unknown or other
  misc_feature (315)..(315): n is a, c, g, or t
  modified_base (687)..(687): a, c, t, g, unknown or other
  misc_feature (687)..(687): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtgggaggaggtgtggtccagcctggagaatcccgtagacgactctcctgtgctagcctctggattctacctttagtagtttatggatggacgtcgtcgggtccnccaggacctaccggaggggaacgggtcgtgggtacgttcggtcggaaccaaacgaacgttaaaaaccgaaaggaagttaggggaaaaggttaaaaaacgaaaactttagtaggtaggaacttcggtaggtaacgggaaagggtcctaacgtttacccgaacctacgttaccctaccgaaggaacgtaaaccgaaaccggaccaaaaggtaacgttaccaacgttaggtaactccgtaagaactaaagtacgaaactacggtacctagggaacgaccgggtaccggaaaggcccgtaacggtcttacggtaactaccgtaagtcggtacgaggtagactactaccgtacgtccttactttcccgtattttcgnttcccgg

SEQ ID NO: 45901 - DNA, 823 bp, Homo sapiens
  misc_feature: GYAE6OF01CAQJX.27.57.F02.1.454.CMB.1.raw
  modified_base (177)..(177): a, c, t, g, unknown or other
  misc_feature (177)..(177): n is a, c, g, or t
  modified_base (244)..(244): a, c, t, g, unknown or other
  misc_feature (244)..(244): n is a, c, g, or t
  modified_base (334)..(334): a, c, t, g, unknown or other
  misc_feature (334)..(334): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttgggtttccttgtgctattttagagtntccagtgtgaggtgcaacgtggtgattcgtgggaggtaggtgtcggtccagcctaggagactcccgngagacctctccgtgtgctagccttcgtggtactttcctaacgtttttagtacgttttaagttgggtaattggacgtcgttcggggtcccnccgtaagtaccgtccggaaggggacgggtcttaggggtacgtttcggcggaacccctaaagtaacgtaaaaccgaagggtaacgttaacggggtaaaacgttaaaaacgtaaaacgtttgtaacgggttacgtaaccgtttaggtaagggttaacgggaaccggggtacccttattaaccccgaaccgtaacttcccggttaacccgaaggtaaaccgtaaacccgaaaaccgggtaccctaaaaggtaacggttaccctaaggtttacgtaactttacggtacggaaaccttaaaagttacggaaaccctggtacccgtaggaaaccggtaccggacccggaacgggtaaccctagggtacccttaaagggtttaacacccgtttacggtacggtacggtaaccggaaagttacccggtaacctttacccgggtaattaacccctttaaccggtttcctttaaacggttttccggacgtttacccggg

SEQ ID NO: 45902 - DNA, 816 bp, Homo sapiens
  misc_feature: GYAE6OF01CRJIB.27.57.F02.1.454.CMB.1.raw
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (201)..(202): a, c, t, g, unknown or other
  misc_feature (201)..(202): n is a, c, g, or t
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (296)..(296): a, c, t, g, unknown or other
  misc_feature (296)..(296): n is a, c, g, or t
tcagagcgtcgtctcacgaccggtgctcgatttagctcgatatagtttgggtttgaggtctcagagaggagccttagccctggactccaaggtccctttccacttggtgatcagcgacggagcacagacggacccacatggaacgtgggctgagtcgttgggttttcttgttgtcttattttagaggtgtcngtgtgngtnntagtggtgattgnggnggngtgtgtcagctgganactcctagacnctctctgcgcncgtctcgtgtacttcttaactttagttagttagttagngtaggcgtcggtccgggtccacggacgtaccggtcggagggggtaacgggtcgtagggtcggtttacggacgtaaccgaaactaaacctaaacggagtaagggtaaacgggtaaaaggtaaaaacgtaaacttaggttacggtaacgttacgtttcggtaggtaccggggtaacggtaccctattacccgaaccttactacccgacgaacggaacgtaaccacgtaaccgaagtacgttacctacgtagttaccgtcgtaaactaaacgtaacggtaagaaccgtaccggttacgaaccggtaagggacccgggaacggaaaccggggaccgttaccgggttaaacgtttacgtaaaaccggtttacccggttacgggttaccgggtaacggtaacgttaaacgggttcccgttttaaacgttaccccccgggttttaaacgttacccgggttttacccctttttttaaccccgggtttttaaacgtttttcccggggttacccgggttttacccggggg

SEQ ID NO: 45903 - DNA, 922 bp, Homo sapiens
  misc_feature: GYAE6OF01EN9XT.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccagtggaacgtggggctgagtcgttcgggttttccttgttgtcttattttagaaggtgtcctagtgtgaggtgacacgtggtgtattcgtggaggtaggttcggtggtccagccgtaggagaacttcccagacgtaccgtctccgtggtcgcgtagtcccttgtacggtacttaccgttaaccgttttaaggttagttttaagttcggtagttacggtacgtccggttaccggggttacccgacccgtaacggtacccggttaacccgggtaaggggggtaaccgggggtccgttacgggttacgggtttacccgggtaccggtaaaccccgtaaaaccgtaaaaccgtaaaaccggtaaaggtaaacgggttaaacggggtaaaaagggtaaaaacgttaaaaacgttacggttagggttaaccggtaacgtttcgggtaaggtaaccgggtaaacgggtacccgttaacgtttacccggaaccgttaccctacccggtaaaccgtaacgaaaccccgggtaaaccccgaaaacccggtaaaccgtaaacggtttaaacccgtacccttaacggttactttaaacgtcccggtaacgtaaacgtaaacgtacgaacccgacggttacgaaggtaccggaaccggaccgggaaacgaaccggtaccgtcgttacgttaaaccgttaccgtcggttggaccgggtgaaaggttaacccgttaagtttcccgtaaccgttaccgttttacctttacccggttttcgtttaaacggtccggtttaaaccggg

SEQ ID NO: 45904 - DNA, 726 bp, Homo sapiens
  misc_feature: GYAE6OF01BXCRD.27.57.F02.1.454.CMB.1.raw
  modified_base (181)..(181): a, c, t, g, unknown or other
  misc_feature (181)..(181): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (354)..(354): a, c, t, g, unknown or other
  misc_feature (354)..(354): n is a, c, g, or t
  modified_base (591)..(591): a, c, t, g, unknown or other
  misc_feature (591)..(591): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttcctgttgcttattttagaggtntccagtgtgagtgcactggtgattcnggaggnggtgtgtccagccngganactccctgacgactctcctgtcgacctgccttcgtaggtacttccttaaccgtttaggtaacgtttagttggattggaggtccgttcggggtcccgcgacgacgtccggaaggggagggtcgngggttagttccggtacgaccaaactaactaaaccgaaggtagtacgggaaaaggtaaaacgtaaacgtaggttagtacggtaaccgttcggtaaggttacgggaaacggggtcccttacgttacccgaaccctacgttcccgtaaccgaacgggaacgtaaaccccgaaccgggtaccgtaaaaggtaaccggtcgtaaccttaggttacgttactacgaacgtaactacggaaacncggtaccgtagggaacgacggtaccgggacgtaaccgacgtcgtagttaacgtacctacggtagtcgaccggaaaggtcgtacgttacccgttagtacccttaggttaccccgtttagtttcggactttcccggg

SEQ ID NO: 45905 - DNA, 925 bp, Homo sapiens
  misc_feature: GYAE6OF01DHO4Q.27.57.F02.1.454.CMB.1.raw
  modified_base (118)..(118): a, c, t, g, unknown or other
  misc_feature (118)..(118): n is a, c, g, or t
  modified_base (818)..(818): a, c, t, g, unknown or other
  misc_feature (818)..(818): n is a, c, g, or t
  modified_base (904)..(904): a, c, t, g, unknown or other
  misc_feature (904)..(904): n is a, c, g, or t
  modified_base (914)..(914): a, c, t, g, unknown or other
  misc_feature (914)..(914): n is a, c, g, or t
tcagagcgtcgtctcacgaccggtgctcgatttagctcgatatagttgggtttgaggtctcagagaggagccttagccctggactccaaggcctttccacttggtgatcagcacggancacagacggacccacatggaacgtgggctggagtcgttgggtttttccttgttgtcttaagttttagaaggttgtcctaggtgtggaggtgactaacgtgggtaggtattcggtagggagggtaggtggtcggtcccagccgtaggaacgtaactcccgtgacgtacttccgtccgtgtagcacgtcccttcgtaggtactttaccgttaaccgtttttaggttaagtttaaggttggtacgttggacggtcggttaccgggtcccgaccgtaacgtacccgtaccgggaagggggaacggggtccgtagggttacggtttaccggacgggaaccccaaaacgtaaaactaaaaacccggtaagtaaacgggttaagggtaaaaaaaccgggttaaaaaagtaaaaaccgttttaagggtacgggttaaccggtaacccgtttaggggtttaggttaaaccggggggtaaaccgggtacccgttaacgttttaaccccaaaaccggttaccttacccggttaacccggaaacggaaacgtaaaacccccgggaaaccgaacccgttaaaaaagtaccccggttaccttaacggtttaaccggttaacctttaccgtaacggtaaacaaaggttacccggaaaccgtaacgtcccgttaaaggaaccgggtacggacccgggttaacgacccggtacggtnttaaaccggtaacctttaccgtacggtagggtaccgaagggttacaacggttaccctaccggttgttacccttaacgttccgtttntttaaccggngttacccgggg

SEQ ID NO: 45906 - DNA, 838 bp, Homo sapiens
  misc_feature: GYAE6OF01CSUWK.27.57.F02.1.454.CMB.1.raw
  modified_base (194)..(194): a, c, t, g, unknown or other
  misc_feature (194)..(194): n is a, c, g, or t
  modified_base (820)..(820): a, c, t, g, unknown or other
  misc_feature (820)..(820): n is a, c, g, or t
tcagagcgtcgtctcacgaccggtgctcgatttagctcgatatagttgggtttgaggtctcagagaggagccttagcccctggactccaaggcctttccacttggtgatcagcacggagcacagacggacccacatggaacgtgggcctgagtcgtttgggtttttccttgttcgactttattttaggaggttntcctagtggtgaggtcacgaacgtgggtagtacttcggtagggagggtaggttcggtcggtaccacggtccgtagggaacggtaaccttccccgtaggaagtccccttcgttcccggttggtgtcctccggtccttaccggtaggttaacctttccgtttaacccgttttttaaagggtttactttaggtttaggacgtcggtacggttaaccgggttccggggttacccaccggtaacggtaccccgtacgggaaggggggtaaccgggtcggtaggggttaccgtttacgggaccgaaaccttaaaaccgaaacgttaaaaccgaggtaaacgggtaaaggggtaaaaggttaaaaaaccggaagtttacggtcgggttaactaccggttacggtaggttaaacggggaccggtacctacgtaacccaccgttacctaccgtaacgtaggaaaccgaaacgtaaccgaaaccgtaaacgtaacgttaccttaacgtagttaccgtactacggaactaagtacccgacgaacgtaccgtaggaccggacgaccggaagtaccggacgtgtacgtacgtacgtgacggtggagttacgaacttccgtattaccgtcttaccgtttnttcgtacgttagtccggg

SEQ ID NO: 45907 - DNA, 731 bp, Homo sapiens
  misc_feature: GYAE6OF01AR80X.27.57.F02.1.454.CMB.1.raw
  modified_base (185)..(185): a, c, t, g, unknown or other
  misc_feature (185)..(185): n is a, c, g, or t
  modified_base (353)..(353): a, c, t, g, unknown or other
  misc_feature (353)..(353): n is a, c, g, or t
tcagagcgtcgtctcacgaccggtgctcgatttagctcgatatagtttgggtttgaggtctcagagaggagccttagccctggactccaaggtcctttccacttggtgatcagcacggagcacagaggacccacatggaactggggctgagcttgggttttccttgttgcttattttagaaggtntcagtgtgaggtgcaacgtgggtggattcgtgggagggaggttgtgggtcccaggtccgtgggacgaacttccccgtaggacgtaccttccttcccgtgtcgcacgtcctcgtggtactttccttaccttttaggttatttagttaggatgacgtcggtcggggtccnccgacgaccgtacggaggggtagggcgttgggtacgtttcggaggacccaaactaacttaaaccgaaggtagtaagggaaaggttaaaaacgaatacgttggtacggtacttcgttaggacgggaacggtccgtaacttccctaacctactacccgtaccgtaggaacgaccgaaacccggaacaaagtaacggtcctagttacgtacttacgtacaacgtaacgtacaacgaccgtaccgtaagggaccgaacgggtaaccggaacggtaacgaccggtcttaaagtcgtaaccgttaccgtaggacggaccggaagagttaccgttactaacggttcccttaacgtttcccgtttacgtttagtacccgtttcggg

SEQ ID NO: 45908 - DNA, 727 bp, Homo sapiens
  misc_feature: GYAE6OF01AOM95.27.57.F02.1.454.CMB.1.raw
  modified_base (121)..(121): a, c, t, g, unknown or other
  misc_feature (121)..(121): n is a, c, g, or t
  modified_base (190)..(190): a, c, t, g, unknown or other
  misc_feature (190)..(190): n is a, c, g, or t
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (538)..(538): a, c, t, g, unknown or other
  misc_feature (538)..(538): n is a, c, g, or t
  modified_base (629)..(629): a, c, t, g, unknown or other
  misc_feature (629)..(629): n is a, c, g, or t
  modified_base (664)..(664): a, c, t, g, unknown or other
  misc_feature (664)..(664): n is a, c, g, or t
tcagagcgtcgtctcacgaccggtgctcgatttagctcgatatagttgggtttgaggtctcagagaggagccttagccctggactccaaggccctttccacttggtgatcagcgacggacncacgagacggacccacagtggaacgtgggctggacgtcgttggttttcctgttgcttagtttagaggtntctagtgnggtaggngacaacgtggtagtacttcgtgggaggtaggtgtacggccaggtccgtaggaactacttcccgagtaccacttccgtcgtagtacgccgtaccgtccgttacggtcgttacttcccgtttaacggtttaaagttcggtttattacgggagttcgacgggtccggttcgggacccgaccgtacgtaccggtacggggaggggtacggtcgttgggtacggttcgaccgaacctaaagtaaccgaaacgaagtacggaaagtaaagtaaacgtaactggtgaacgttcgttacgtgggtacggaaccgtctacctaacaccgtactccgaacganaccgaaccaacgaacaagtcactaggtactagtccaaggtaactaagtaaccgcttagacccggtagacgggtaccgtacggtaacggtanacgggtacgtttagtaaccgtaccgtggttaacgngtaccggtaaggtcccttaccggctttaagccctttaagtaccctttgtaaccgtcgttacgg

SEQ ID NO: 45909 - DNA, 659 bp, Homo sapiens
  misc_feature: GYAE6OF01BBQ7G.27.57.F02.1.454.CMB.1.raw
  modified_base (178)..(178): a, c, t, g, unknown or other
  misc_feature (178)..(178): n is a, c, g, or t
  modified_base (181)..(182): a, c, t, g, unknown or other
  misc_feature (181)..(182): n is a, c, g, or t
  modified_base (184)..(184): a, c, t, g, unknown or other
  misc_feature (184)..(184): n is a, c, g, or t
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (258)..(258): a, c, t, g, unknown or other
  misc_feature (258)..(258): n is a, c, g, or t
  modified_base (299)..(299): a, c, t, g, unknown or other
  misc_feature (299)..(299): n is a, c, g, or t
  modified_base (440)..(440): a, c, t, g, unknown or other
  misc_feature (440)..(440): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccagtggaactggggctgagcggtgttcgtgtaggctattaagagntcnngngagtnacatggtagtatcgaggngnggtcgtgacacgctaggnaactccgaggacgacttcacgtgacgctacnccgttgtagtacttacgtacctttaaggttcggttataggngttcgacgtcggtggccccaacgacgtccgtacggaagggtcgggtctcgggtgtccggtacacgaaacacgtaagagttgaacggaagttaaaaccgtagtaggttacgaagttcgtacgagggttaggacccggttacntttaccgcaacttccgcgaacgacgtaaacgacgaacgtagtacctacgtaccgtagtctacgtacgtaactaacggttacgaccgtacggtaccgagtacggtaccggaacggtacgtaccggtacgtaacgtcgtaacgttactaccgtaggtacgaaggcggtacgtacgttaccttacggtacttaacccgttgtttcgttcgttacgtcccggg

SEQ ID NO: 45910 - DNA, 661 bp, Homo sapiens
  misc_feature: GYAE6OF01C8OVO.27.57.F02.1.454.CMB.1.raw
  modified_base (180)..(180): a, c, t, g, unknown or other
  misc_feature (180)..(180): n is a, c, g, or t
  modified_base (209)..(209): a, c, t, g, unknown or other
  misc_feature (209)..(209): n is a, c, g, or t
  modified_base (584)..(584): a, c, t, g, unknown or other
  misc_feature (584)..(584): n is a, c, g, or t
  modified_base (606)..(606): a, c, t, g, unknown or other
  misc_feature (606)..(606): n is a, c, g, or t
  modified_base (650)..(650): a, c, t, g, unknown or other
  misc_feature (650)..(650): n is a, c, g, or t
tcagagcgtcgtctcacgaccggtgctcgatttagctcgatatagttgggtttgaggtctcagagaggagccttagccctggactccaaggtcctttccacttggtgatcagcacggagcacagacggacccacatggaactgggctgagtcttggttttcctgtgcttatttagaagtntccagtgtgagtgcaacgtggtgattcgnggaggtacgtgtcggtccaggtccgtaggaataactcccgtaggactaccttcctcgtgtacgcacgtccctgtacggtactttctaaccgttttagtaggtttatggattggacgtcgtcgggtcccacaagtcccgtacggaaggggacggtctagggtacgttcgacgaaccaaataacgtaaacgaagtagtaacggaaacgtaaaaagtaactgtcggtagtaacgttcgaggttaacggaccggtatacctacacctaactccgaaacgtagaaacgaaccttaaacggacctaaagggtaactaccgcgttagtaacctctacggaaataatacgaaaccgtcgaccttaggaaccgacgacggtaanaccgcggtaacttgacgtaccngtaggcgaatgaatccgtaactgtactcgttacctcgtttaaanccgttaccggg

SEQ ID NO: 45911 - DNA, 682 bp, Homo sapiens
  misc_feature: GYAE6OF01CUFBT.27.57.F02.1.454.CMB.1.raw
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
  modified_base (387)..(387): a, c, t, g, unknown or other
  misc_feature (387)..(387): n is a, c, g, or t
  modified_base (507)..(507): a, c, t, g, unknown or other
  misc_feature (507)..(507): n is a, c, g, or t
  modified_base (547)..(547): a, c, t, g, unknown or other
  misc_feature (547)..(547): n is a, c, g, or t
  modified_base (568)..(568): a, c, t, g, unknown or other
  misc_feature (568)..(568): n is a, c, g, or t
  modified_base (579)..(579): a, c, t, g, unknown or other
  misc_feature (579)..(579): n is a, c, g, or t
tcagagcgtcgtctcacgaccggtgctcgatttagctcgatatagttgggtttgaggtctcagagaggagccttagccctggactccaaggtccctttccacttggtgactcagccacggacgcaacgaggacggacccaccgagtgggacgtgggactgagtcgttcgggtttttccttggttgtacgtttaagttttaggaacggttgtacctagggtgtggaggtcgacgtacgttgggtgtagtttcggaggggnggtcggttgtcggaccgacgtccgtaggaactacctccgtgaaccgtccgtctccgnggacgcctacgccttgtagtaccttaccgtacgtttagtagtttgtgtaacgtgtacgtcggtcggtaccncacggaccgtcggaggggacggtcgtaggtccgtacgtaccgaaccaactaaacggtaaccgaggtaagtaaacggaaacgttaaaacaagtgtagcgtctaggtaggaggtacgacttnaccgactctaccgacgacgacgaacgaacgacgaaacgtntcgtatgtactacgacgtaanacgtagcacgngaaggccgtacgacgacacggctcgtaacgtacgtactagtcgtaggatacggtaacgtccgtacttacgttcctaacgttccgttaagtcgttcgtaccggg

SEQ ID NO: 45912 - DNA, 705 bp, Homo sapiens
  misc_feature: GYAE6OF01BV43W.27.57.F02.1.454.CMB.1.raw
  modified_base (608)..(608): a, c, t, g, unknown or other
  misc_feature (608)..(608): n is a, c, g, or t
  modified_base (692)..(692): a, c, t, g, unknown or other
  misc_feature (692)..(692): n is a, c, g, or t
tcagagcgtcgtctcacgaccggtgctcgatttagctcgatatagttgggtttgagttctcagagaggagccttagccctggactccaaggcctttccacttggtgatcagcacggagcacgagacggacccacagtggaacgtgggctgagtcttgggttttccttgtgtcttatttaggaaggtcgtccagtgtgaggtcacgaacgtgggtggtacttcgtgggagggtaggtggtcggtaccaggtccgttaggaacgaactcccgtaggacgtacttcctccgtgtcgcgacgtcctgtaggtacttcgtaactttagtagttagttggatggagtcgtcggtccacgacgtaccgtcggaaggggacgggtcctggagttcgcggaacctaaacgaacgtaaaccgaagtaaggtaggaaaacggtaaaagtaaaactgtagggtacgtaacgtgtacggtaaggaccgggtactacgtaccctaacgtactccgtacgaagaccgtaacaaccggaacaaacggttagaccctagtacttacgacgtagaaactaaagacgaactaggtacctaggacgtaccggacggtagacccggtancgttcgtaagtacccgtggttacggcgaccgaagtacggacccgtttacctaaagtcctttaccggttaccctttggtttaacncccggttaccggg

SEQ ID NO: 45913 - DNA, 796 bp, Homo sapiens
  misc_feature: GYAE6OF01DJH4U.27.57.F02.1.454.CMB.1.raw
  modified_base (119)..(119): a, c, t, g, unknown or other
  misc_feature (119)..(119): n is a, c, g, or t
  modified_base (171)..(171): a, c, t, g, unknown or other
  misc_feature (171)..(171): n is a, c, g, or t
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (616)..(616): a, c, t, g, unknown or other
  misc_feature (616)..(616): n is a, c, g, or t
tcagagcgtcgtctcacgaccggtgctcgatttagctcgatatagttgggtttgaggtctcagagaggagccttagccctggactccaaggccctttccacttggtgatcagcacggancacagacggacccacagtggaactgggctgagtcgttgggttttcctgttgnttattttaagacgtgtcagtgtgaggtgcaacgtggtggtattcgngggaggagggtntcgggtaccagtccgtggaacgaacctcccgtaggaacgtaccttccgttcctaggtccgcacgccgttgtaggtacttcctaaccgtttaggttatttagtggatcgaggtcggttacgggtcccgtacccaagtacgaccggagggaacgggctagggtagttcggacggaaccaaacgttaagaaaaacctaaggtaagtacgggtaaagtaaaaaaccgtaaaagtgtaggtacgtaacgtcgttagggaaggaaacgggtaccctaaggtttacccaaccgttacgttacaccgaaaggaaccgaaacgaacccgtaaccaaaagtaacgacccgtaagttaacgttaagtaccgtaacgtaaactaaaagtccgaaaacgngttaacccgaggaaacgggtacgaaccggaaggggttaacccaacccgggtaatcgtttaaaacaaacggtttacttacgggtaaccgtaacggaacgttaaacgacggttaaccccgtttaaataccccttttacggtttacccgtttaacggtttttaccgcccttttaacccggggg

SEQ ID NO: 45914 - DNA, 808 bp, Homo sapiens
  misc_feature: GYAE6OF01DWMDF.27.57.F02.1.454.CMB.1.raw
  modified_base (238)..(238): a, c, t, g, unknown or other
  misc_feature (238)..(238): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtggggctggagtcgttggggtttttcctttggttgtctttagtttttaggaaggttgtaccaggttgtgaggtgactaacgtggtaggtatttcgnggggagggtaggttgtcgggtccagccgtaggaagtaactcccgtgacgtctctcctgtgcacgtcctgtgtacttctacgtttagtagtttagtggtatggacgtcggttacgggtcccgaccgacggtaccgtaccgggaagggggtacgggtcgtagggtacgttcggacggaaccaaacgaaacgtaaaccgaaggagtaagggaaaaggtaaaataaacgtagtggtacgtacgtgtaggacggtacggaccttataccactactccgtacgaagaacgacgaaaccgaaccgtaaggtaaccgtctaagttacgtacgtaccgtagtaaactaaaagtacgaaaccggtagaaccgtacgggaaacggccggggtaacccgggaacgggtaacccggacgggtttaacctttaaacggggttaacctttaaacccgggttacggtttacggggtaaacggtacccgggtaaagttaacccgggttaacctttaccggttaccgtttaccccgtttaaacggttttccttttaaacccggttttgttaacccggtttacccgggg

SEQ ID NO: 45915 - DNA, 775 bp, Homo sapiens
  misc_feature: GYAE6OF01A90IA.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagctgggttttccttgttgctattttagaacgtgtccagtgtgaggtgcaactggtgattcgtggaggtaggtgtcggtccacgtccgtagggacgaacttcccgtagacgtacctcctcctgtcgacgacgcccttcgtaggtacttcccgtaaccgtttttacggtaacgtttagttcggaatcggacggtccgtacggggtacccgacctacgtaaccgttccggaagggggttaacgggccgttacgggtacggttccggtaccggaccctaaacgtaacctaaaaccgaaaggtacgtacggggtaaacggtaaaaacgtaaaaccgttagtcggttacggtacttccgtaggtacggaacgggtcctaacttaccgaccattccctaccgaaaggacccgaaacctaacccggaaccgaaaacggtaacgtccctaattcgtaactacctaggaacctaaaggtccgaaacacgtcctaagggaacgtacgtacccggaagaccgacggtaccgtttagtaaacccgtccgttaagtggtacgtaccggtaaagttcctaaacccggttccgttagttaccctacccgtttccgttacgttttacggtacctttccccgg

SEQ ID NO: 45916 - DNA, 915 bp, Homo sapiens
  misc_feature: GYAE6OF01DR5FM.27.57.F02.1.454.CMB.1.raw
  modified_base (209)..(209): a, c, t, g, unknown or other
  misc_feature (209)..(209): n is a, c, g, or t
  modified_base (733)..(733): a, c, t, g, unknown or other
  misc_feature (733)..(733): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaacgtgggctggagcgttgggttttcccttggttgtcttaagttttaggaaggtctccaggttgtggaggtnacgaacgttgggtacgtagttcgtaggggaggtagggtggtcggtaccgaggtcctagggtacgaaccgttccccgtagggtacctaccgttccgttccgttcgggtacgcccgaacggtccccttcggttacggttacctttacccttaaacccgtttttaagggttaagttttacggttaggtacgtaggtacgggtccggtccggggtacccgaccgtaacggacccgtaccggggaaacgggggtacggggtccgttagggtaccggtttaccggtccgaaaccgaaacgtaacgtaaaaccgaaggtaacggtggggtaaaaacggtaaaaacggtaaactttaggtacgggtaaggtaaccgttcgggttaacggttaacgggaaccggggtacctaagttaccctaacccgtaactccgttaaacgaacgaaccgaacccgaaaccggaacggtaaacgtaacgtactaaccgttagttaacgttcccgtaaaggtaactaaaaccgtacggaaacncccggtttacgaacgggacggtacggaaccgggaaccggtaacggtacccgggtacttaacgtaaccgttaaaccccttgggaccggttaacggggaacgaacgttaccggttaaaccttcccggttaaccggtttacttacccggttttacccgttacgttccggttaagtttacccgggg

SEQ ID NO: 45917 - DNA, 818 bp, Homo sapiens
  misc_feature: GYAE6OF01DV6ZT.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcgacggagcacagaggacccaccagtggaacgtgggctgagtcgttgggttttccttgttgcttattttagaaggtcgtccagtgtgaggtcgacgaacgttggtggtattcgtagggaggtacggttgtcggtccagtccgtaggaacgtaccttccccgtaggaaccgtaccttccgttccgttgcgtaccgaccgtccgttcgtacgttacctttaccgtttaacgtttaagttagtttagtaggtacgtcggtacggtcggtccgggtaccgacgtacggtaccggtacgggaggggtacgggtcggttacggttaccggttcggacggaacctaaacgtaaaacgtaaacgaaggtaaggtaaagggtaaacggtaaaacgttaacgtagtacggtacggtacgtacgggttacgggaacggtaaccgggtaccttaacgtaccctaaccgtaaccgttcccgtaaaccgtaacgaacccgaaacccgtaaccggaaaccgtaaacggtccgttaactacgttaacttccgtaagtaaccgtaaataacgtaaccgacgtaccgacgtacggacgaccggaccggacggtaccgtacggttactaacgtacctacgttacggcggtacggtaacgacggtacgtacccgttacgttacgttaccgttaccgtttaccgtttacgttccgttacgttaccggg

SEQ ID NO: 45918 - DNA, 857 bp, Homo sapiens
  misc_feature: GYAE6OF01CTJ9C.27.57.F02.1.454.CMB.1.raw
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
tcagagcgtcgtctcacgaccggtgctcgatttagctcgatatagttgggtttgaggtctcagagaggagccttaaccctggactccaaggcctttccacttggtgatcagcacggagcacagaggacccaccatggaactggggctgagcgttgggtttttccttgttgcttattttagaggtgtccagtgtggaggtgacagtggtggtattgtggaggnggtgtggtccagccgtaggatactccctagacgtacctcctccgtggtcgcncgtccctcgtcggtcttacctaccttttaaggttagtttagttggagttggacggtccgtggggtccccacgacgtaccggtaccggaagggggacggggtcgtagggttacggttcggtacggaacccaaacgaaacgtaaaaccgaagtaggttaacggggaaaaagtaaaaacggtaaaactagttacggtacgtacgttacggtaggtacgggaaacggggtaccttacgttaccgtaaccgaacctttacccgaccgtaaacggaacccgaaaacccgaaaccggaacccgtaaaaacgggtaacgttaccctaacgggtttaacgttactaaccccggttaaggtaaaccaaaggttaaccgaaaccggtaaccggtaccggttaagggaaaccgggaacccgggaccggggtaaacggaacccggtaaaccgggtttccttaaaggtttaacctaacggtttccggttagggccgggaaacggtaggttaaaccggtaccgtttacccgttaacggtttaccttaccggttttccggtttaccggttttaacgccgtttccccggggtaacggggg

SEQ ID NO: 45919 - DNA, 803 bp, Homo sapiens
  misc_feature: GYAE6OF01DIWXK.27.57.F02.1.454.CMB.1.raw
  modified_base (182)..(182): a, c, t, g, unknown or other
  misc_feature (182)..(182): n is a, c, g, or t
  modified_base (218)..(218): a, c, t, g, unknown or other
  misc_feature (218)..(218): n is a, c, g, or t
  modified_base (692)..(692): a, c, t, g, unknown or other
  misc_feature (692)..(692): n is a, c, g, or t
  modified_base (786)..(786): a, c, t, g, unknown or other
  misc_feature (786)..(786): n is a, c, g, or t
tcagagcgtcgtctcacgaccggtgctcgatttagctcgatatagttgggtttgaggtctcagagaggagccttagccctggactccaaggccctttccacttggtgatcagcacggagcacagacggacccacatggaacgtggggctgagcgttgggttttcctgtgcttatttagagtntccagtgtgaggtgcacgtggtggattcgtggaggnggtgtggtccagccgtggagtaactccctgacgtacctcctccgtagtcgcacgtccttcgtaggtaacctttacctaccgttttaagttagtttagttggtatggaacgtccggtttcgggtcccgtaccgaacggtaccgtaccgggaagggggacggggtccgttagggtaacggttcggtaccggacctaaaaccgaacttaaaaccgaagtaacgtaaggggaaaacgttaaaaacgtaaaaacgttagtaggtacggtaccgttcgtacgggtaaggaccgggtaacctacttacccgaacctaactcccgtaaccgtaaggaactaaccgaaccggaacctaaaggaccgttaacccgtacgtttacgtaacctccgtaacgtaaacctaaagttaccggaaaccgtacggtaccccgttaagggaaccgggtaccgacccgggaaacgggtaacgtacccgggttnttaaaccggttactaacccggtttacgacggttacgggaacggttaagaacggtttaacctacccggttacgtactttaccgtttacccgtttntttacgcgttacccggg

SEQ ID NO: 45920 - DNA, 832 bp, Homo sapiens
  misc_feature: GYAE6OF01BEE1J.27.57.F02.1.454.CMB.1.raw
  modified_base (224)..(224): a, c, t, g, unknown or other
  misc_feature (224)..(224): n is a, c, g, or t
  modified_base (744)..(744): a, c, t, g, unknown or other
  misc_feature (744)..(744): n is a, c, g, or t
tcagagcgtcgtctcacgaccggtgctcgatttagctcgatatagttgggtttgaggtctcagagaggagccttagccctggactccaaggccctttccacgttggtgatcagcacggagcacagacggacccaccagtggaactgggctgagtcgttcgggttttccttgttagtcttagttttagaggtgtctagtgtgaggtgactacgtggtgtattcgngggagtggtgtcggtaccagccgtaggaacgtaactcccgtaggacgtaccttccgtcgtacggtcgccgtacgtcccttgtaggttacttacgttaaccgtttagtacgtttagtagggtacttcggacgtcggttccggtaccccgacgtaccgtaccggtaacgggtaacgggggtacgggtacgttacgggtttaaccggttacggtacgaaaaccccgtaaaagggttaaaacctaaaaccggtaaaaggttaaggtttaaaacggggaaaacggttaaaaaacgtaaaacgtttcggtaaagggttaccggttaacctacggtttaaggggaaccggtaaaccggggtaccctttacgttaaccgaccgttaacctaccccggttacgaaacggaaactaaccccggtaaaaccggaccgtaaacggtaacgttcctaagtttacgttactaacgggttacaaacggtttaaggaacgtacgaccggtaactacgggaacggtaccaaccgggngtaaccgtacgtccgtaataccgtgtaacctgggactacggagtaactacgtacgttactcgttaaccttgttattcgtcgtaccggg

SEQ ID NO: 45921 - DNA, 852 bp, Homo sapiens
  misc_feature: GYAE6OF01CXJGL.27.57.F02.1.454.CMB.1.raw
  modified_base (615)..(615): a, c, t, g, unknown or other
  misc_feature (615)..(615): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgttgggttttccttgttgcttattttagaaggtgtccagtgtgaggtgcaacgtgggtggtattcgtgggaggtagggtggtcggtaccaggtccgtagggaagtaaccgtcccctaggacgtaccttccttccgtggtcgccacgtcccgttcgtaggtactttcctaccgttttaggttagtttagttggataggtacggtcgtaccggggtcccaccgaagtacccgtaccggaaggggggaacgggcgttaggggtacggtttaccgtacgggaacccaaaacgtaaaccgttaaaaaccgaaggtaagtaaaggggtaaagtaaaaaagtaaaaaccgttagtcgggtagtacgtacgtaggtaggaacgggacctacgtaccaccgtactactaccaagacaaacccaaccgtaacaaagtagacctacgtagtactgtacgaactaaagcgtaaacnccggacgtacggaacggtaacccgggaaccgggaaacggtaacccggtaacccgggtacggtttaacggtaaacgttttaaaaccccgggtacggttacgggttaacccggggaccggtaaaacggtaacggtaaaaccccgtttaccccggtttaaacggtacccccttttaaacccgggttttttacccggtttacccggtttttttaacggtaaccccgttttacccccggggg

SEQ ID NO: 45922 - DNA, 865 bp, Homo sapiens
  misc_feature: GYAE6OF01AY389.27.57.F02.1.454.CMB.1.raw
  modified_base (269)..(269): a, c, t, g, unknown or other
  misc_feature (269)..(269): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggtctgagtcttgggttttccttgttgcttattttagagtgtccagtgtgaggtgacacgtgggtgtattcgtgggaggtaggttggtcggtccgacgcccgttggaactaaccttccctaggaacncgttcctcgtgtcgacgtacgtccttgtcggtaactttcctaaccgttttacggtacgttttagttggatggtaccggtcggttccggtaccccgaccgtagacccggttaccgggtaaagggggtacggggtacgttgggttaaccggtttcgggtaccgtaaccgtaaaacgtaaacgttaaaacccggaaagtaacgggttaaggggtaaaacggtaaaaacgtaaacgtttaggtgggtaaccggttaactcggtagggttaaccggggaccgggtaaccgtttacgtacccaaccgttccttaaccgtaccgtaacgaacgtaacccccgaaaccggtaacgaaaacggtaaacccgttccttaaacgttacggttaaccttacgttaacggaaactaaactacggtaaaaccgccggttaaccgtaacgggaacgacccgggaccggttaaacggaccggtacccggtacgtagttaaccgttacgtaccgggtacgttacggggactaacgggtacgttaaccctcggttttaaaccggtcctttaacccggttttaccggttagtttttacccgcggttttaacccgg

SEQ ID NO: 45923 - DNA, 693 bp, Homo sapiens
  misc_feature: GYAE6OF01ER8QC.27.57.F02.1.454.CMB.1.raw
  modified_base (321)..(321): a, c, t, g, unknown or other
  misc_feature (321)..(321): n is a, c, g, or t
tcagagcgtcgtctcacgaccggtgctcgatttagctcgatatagttgggtttgaggtctcagagaggatccttagccctggactccaaggcctttccacttggtgatcagcacggagcacagaggacccaccatggaactggggctgagctgggttttccttgttgcttattttagaggtgtccagtgtgaggtgacaacgtggtggtattctgggaggaggtgtggtccagcctaggagaactccccgtagagtacctctcctgtcgcagcctctggtattcctactttagtagtttagtggatgacgctcggggtccnccgacgacctccggaaggggacgggtctaggagttcgtaggaccaaactaactaaaccaagagtaagggaaaggttaaaaacgaaaacgtagtacgtaggtaacctcggtaggtaggaacgggaccgtaattacctaccaacgttccacgtaaggaacaacccgaaaccgtaacaaagaacgtccaaacgtgttaactacgttacgaaacttaaagacgaaacgtacgaaccgttaggaacggtaacgggaacccggtacggaaccgacggtacttaggtaacttaaccgtaaccgtggttacgaaggtacggtaacgtaccgtacgttaacggttctaaccgtttacccggttattttaaggaccttccgg

SEQ ID NO: 45924 - DNA, 787 bp, Homo sapiens
  misc_feature: GYAE6OF01BG0L3.27.57.F02.1.454.CMB.1.raw
  modified_base (699)..(699): a, c, t, g, unknown or other
  misc_feature (699)..(699): n is a, c, g, or t
  modified_base (705)..(705): a, c, t, g, unknown or other
  misc_feature (705)..(705): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccataggacgtggggctgagcgttgggttttcccttgttgtcttagtttttgggaaggtcgtcctagtgtgaggtgctaacgtgggtggtacgttcgtgggagggtagggttggtcggtccgagtccgtaggaagaactcccgtgacgtactccttcctgtacgctacgtccttcgtcggtacttccgttaaccgtttagtagtttacgttggtattggaggtcgttccggggtacccgtccgtaacggtacccggtaccgggtaacgggggaagggggtccgttacggggttaccgggtttaccggtaccggtaaccctaaacgtaaaccgtaaaaccggaaggtaacggtaaaggggtaaacggtaaaaacgtaaaacgttaggttacggtacggtaccttcggtaggtacgggtaacggtccggtacttacccgacgtacgttacccgacggaaggaacgtaaaccccaaaccggaccgtaaaggaaccgttccgaacgttacgttaactccgtaagactaaacggtccgaacgtcgacgtaaggacgtacgccggacgaccgngttacncggtaacttcgaccttggacgtaggagttaaccgcctttaacgtcgttacctacctttccggttctttagacggtttcccgg

SEQ ID NO: 45925 - DNA, 825 bp, Homo sapiens
  misc_feature: GYAE6OF01AHMEE.27.57.F02.1.454.CMB.1.raw
tcagagcgtcgtctcacgaccggtgctcgatttagctcgatatagttgggtttgaggtctcagagaggagccttagccctggactccaacggcctttccacttggtgactcagcacggagcacagacggacccacatggaactggggctgagtcgttgggttttccttgttgcttaagttttagaggtgtccaggtgtaggaggtgactaacgtgggtcgtagtttcgtgggagggtaggttggtcggtacccaggtcccgtagggaacgtaacctccccgtaggaccgtccttccgttcctggtcgcgtaccgccgttcgtcggtactttacccgttacttttaggttaagttttacgttgggacttaggtacggtccggtttaccggggtcccgaccggtaacgtacccggtaccgggaaggggggtaaccgggtcgtacggggtcgtttccgggaccggtaacccaacgtaaacctaaaccggaaaggtacggtaaggggtaaaacggtaaaagtaaactggttacggtacggtacgtacgttagggtaacggggaccgggttacctacttacccggaacttacgtacccgtaacgtaacgaaccggaaaccccgtaaccgaacgtaaacgggtaacctacccgtagttacgttaaactccggtaacgtaacggaaacgtccggaaacgtccgttaaccggacgggtacggaacccggggaccgtaaggacccgtaacggttcgttataccgtttaacgtacgtaggggtcgaggtaacggcttccgtacttacgtcttacgttcgttacttgtccgtcggg

SEQ ID NO: 45926 - DNA, 820 bp, Homo sapiens
  misc_feature: GYAE6OF01B8UP9.27.57.F02.1.454.CMB.1.raw
  modified_base (692)..(692): a, c, t, g, unknown or other
  misc_feature (692)..(692): n is a, c, g, or t
  modified_base (744)..(744): a, c, t, g, unknown or other
  misc_feature (744)..(744): n is a, c, g, or t
tcagagcgtcgtctcacgaccggtgctcgatttagctcgatatagttgggtttgaggtctcagagaggagccttagccctggactaccaaggtcctttccacttggtgatcagcacggagcacagacgacccaccatggaacgtgggctgagcttggttttctgttgcttatttagaggtgtccagtgtgaggtgcgaacgttgggtaggtattcgtggggagggtaggttggttcggtcccaggccgttagggaacgtaaacgtccctaggacgtaccttccgtcctggtcgcgtacgcccgttagttcggtaactttccttaaccgttttaagtttagtttagttggtagttaggacgtcggtttccgggtacccgaccgttacgacccggtcgggaagggggtaacgggtcgtagggtacggtttccggacgaccaaaacgtaacgtaaaccgaaaggtaggtaaacggtaaagggttaaaaacgaacgtttaggtagttacggtagttacgtaggaacgggtaacggaccgttacgttaccaaccggtaccttaccgtaaccgtaaggaaccgaacccgaaaccggaccgaaagttaccggtactacgtacgtttaacgtccgtaagtaactaaacggtacgaaacggtaacgtaccggtaaacggcgggtaaccgaacccggggtanaaccccgggttaagtacccgttagttaaaccgtacgttagtcggggtaacgngtaacggtaaccgtaccgttacccgtacggtttacttacggtttaaccttttccggtagttacccgtttacccggg

SEQ ID NO: 45927 - DNA, 760 bp, Homo sapiens
  misc_feature: GYAE6OF01EK7E4.27.57.F02.1.454.CMB.1.raw
  modified_base (185)..(185): a, c, t, g, unknown or other
  misc_feature (185)..(185): n is a, c, g, or t
tcagagcgtcgtctcacgaccggtgctcgatttagctcgatatagttgggtttgaggtctcagagaggagccttagccctggactccaaggccctttccacttggtgatcagcacggagcacagacggacccaccatggaacgtgggctgagtcttgggttttccttgttgtcttatttagagtntcagtgtgagtgcagtggtgtattcgtaggaggtggtgtcggtccagtccgtaggagtaacctcccgtagacgtaccttccttccgtggtccgacgacgtcccttcgtaggtactttacccgttaacgtttttaaggttagtttacgttagggtacgtaggtaccggtccggttccggggtcccgaccctacggtaacccggtaccggggaaggggtaacgggtcggttacgggtacggtttaccggacggtaaacccaaacgtaaaacctaaaccggaaaggtaggaaaggggtaaaacgtaaaaggtaaaacgttgttacggtacgtacttcggtaggtaaccggaagggtaccttaactaccaccgttactcccgtaacacggaacgaccaacggaacaaagtacgtactacttagtactacgaagtaaccaaagtaccgaaacgtaccgtaccggtaaggaccgggtaaccggacggtacgaaccgtaccggttagtaaccggtacttacgtacgtcgaagacgtagtacgttacctacgtagttactacgttccttagttcgtcgtacgg

SEQ ID NO: 45928 - DNA, 816 bp, Homo sapiens
  misc_feature: GYAE6OF01BUINK.27.57.F02.1.454.CMB.1.raw
tcagagcgtcgtctcacgaccggtgctcgatttagctcgatatagttgggtttgaggtctcagagaggagccttagccctggacctccaaggcctttccacttggtgatcagcacggagcacagaggacccacatggaactggggctgagcttggttttccttgttgctattttagaaggtgtccagtgtgaggtgcaacgtggtggattcgtgggaggtaggtgtcggtcccagccgtagggagtaactccgtaggacgacttccgtccgtgtcgcgacggtccttcgtgtacgttccttaaccgttttaggttaagtttagtcgggtagtcggtacggtcggtaccggggtccccgaccgaacgacccgtaccgggaagggggaacggggtcgtaggggttacgttccggtacggaccctaaaacgtaaacctaaaaccgaaaggtaacgttaaggggaaaagggttaaaaacgaaaaccgtttagtaggttacggtacttcgtaggtacgggaacgggtaccgtacgttaccaacgttactaccgtacgaaacgtaacgaaccgaaacccgacctaaaagggtaaccgtacttaaaccgttgtaccgttcgtaacgtaaacgtaaacgtacaaaccgggtctaacccgggttaggaacccggaccgggtaacccgtacggggaacccgacgggttactaacggttacccttaaaccggtttgaccgggttaggtaacccgtaagggaacctcccggtttacgtaaacttcccggtacgtttttcccggttaccgttttgaccccgtttcgggg

SEQ ID NO: 45929 - DNA, 802 bp, Homo sapiens
  misc_feature: GYAE6OF01AC8S6.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtgggctgagtcttgggttttccttgttgcttattttaggaaggtgtccagtgtgaggtgacaacgtggtggtaattcgtgggaggtaggttgtcggtccaggccgttggagtaactcccgtagaacgtaccgtacttccgtgtcgctacgccctcgttggacttccttaaccgtttaagttaacggtttattaggaatagacggtccgttcggggtcccgtacccacgtacccggtacccggaagggggtaacggggtccgttggggtacggtttcggtccggaacctaaaccgtaaacttaaaccgaaaggacggtaaagggaaaagttaaaaacgtaaacgtagttacgggtacgtacgttcgtaggtacggtaacgggtccctacgttacccaaccgtacgttacccgaccgtaaggaccgaaaccgtaaaccggaaccggtaaagaccgttacaccgtttagtacgtactacggaaactaagaaccgtaacgtaccgaccgtaggacgtaacccggaccggtaacgaacccggtggtaaccgttagtaacttaccggtaccgttcggtcgggaacctaaggtaccgttaacccgttaggtttaccgtaaccgtttcccggtttacctttacccggttttcgaaccgttttcccgggg

SEQ ID NO: 45930 - DNA, 865 bp, Homo sapiens
  misc_feature: GYAE6OF01AKDIY.27.57.F02.1.454.CMB.1.raw
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcttgggttttcctgttgcttattttagaaggtgtccagtgtgaggtgcaacgtggtggnttcgngggaggtaggtgtggtccaggcctgggataactccctgacgactctccgtgtcgcacgccgttcgtggtactttccgtaacctttttaaggttaacggttttagttgggtagtaggtaggtccggtttacgggggttccccaccgtaacggtacccggttacccgggaaagggggggtaacgggggtccgttagggggtaacggtttccgggtacggaacccctaaaactaaacgtaaaaacccggaaggtaaggtaacggggtaaaaggttaaaaaacggaaaacgtttggtaacgggtacggtaaccgttcggttacgggtaggaaccggggtcccttaacgtttaaccccgaaccgttacttaccccgtaccggaaacgggtaacgtaaaccccgtaaaaccggaacccggtaaaaggtaaaccggtccctaaaccgtttagtaaccttcgtaaccggtaactaaaaggtaccgtaaaccgccgtaccgtaggaacgggaccggaccgggaacggaaccgtaccgggtattcgttaacgttaaaccgtagtacgggtacggaaccggtaaggtacggtaacccttaccggttacgttaccgttaccgtttttacccggttactttttcgggaccctttacccggggg

SEQ ID NO: 45931 - DNA, 909 bp, Homo sapiens
  misc_feature: GYAE6OF01EN522.27.57.F02.1.454.CMB.1.raw
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
tcagagcgtcgtctcacgaccggtgctcgatttagctcgatatagttgggtttgaggtctcagagaggagccttagccctggactccaaggtccctttccacttggtgatcagcacggagcacagacggaccccaccagtcggaacgtggggctgagtcgtttgggtttttccttggttgtactttattttaggaaggttgtccaggtgtggaggtnactacgtgggtagattcgtgggaggtaggtgtacggtccacgtcgnggaatacctccctgacgtcttccgtctggtcgcacgtcctcgttacggtacttaccttaaccgtttagttaacgtttagttaggtacgtaggtacgtcggttccggggtacccgaccgtacggtaaccgtaccggggtaagggggacggggtcgttacgggtacggtttccgggaaccgtaaacccgtaaacgtaaaaccggtaaaaccgtaaaggtaacgggttaaaacggggtaaaaagggtaaaacttaaaacggtaacggttaacgggtacggttaacggttacgggtacgggttaaacgggaaccggtacccgttaaccgttaaccctaacccgttaccgtaacccgttaacccgaaggtaaaccccgaaaccgtaaacccggtaaaccggtaaacggtaccgtaacccttacgttacggtaactttaccggtaaccgtaacgtaaaacggtacccgaaacgtacccgaacggtagggtaaccgggaaacccgggtaccggggaaacggcccggtaccgggtcgttaaaggttaccttaacggtacggttacggccggtaacggttaaacgtcgtaaccctttacgggttctaacccggtttacgttacccttttaccggtttagttcccgttacccgggg

SEQ ID NO: 45932 - DNA, 746 bp, Homo sapiens
  misc_feature: GYAE6OF01CLZ7V.27.57.F02.1.454.CMB.1.raw
tcagagcgtcgtctcacgaccggtgctcgatttagctcgatatagttgggtttgaggtctcagagaggagccttagccctggacctccaaggtccctttccacttggtgatcagcacggagcacgagacggacccaccagtcggaacgtgggctgtagcgttcgggttttcctgttcgacttagttttaagaaggtgtccaggtgtaggaggtcgacgaacgtgggtgtacgttcggtgggaagggtacgggtggtaccggtccgacggtccgttaggaacgtaaccgttccccgtagacgtacctccgttccgtggtcgactacgcccttaggtacgtacttccttaaacgtttgtaaggttagttagggatcggaacgtcgggtccgtacccgacgtaggaccgtacgggagggggtagtcggtaggtacggttccgtacgaaccaagtaacgtaaaccgagtaaggtaaaggtaaaacggtaaaagtaactagtcggtagacttggtagaccggaacggtcgtactacgacctacgtccgacgaagaacaaccgacgaaccgtaagtactacgtaacgttcgatccgtaactaataaccgtaacgacgtacgtaaccggtaggaacgcgggaacccggaggaaccgacgtaccttagtaacgtccgtaagttggtaccgaggactaaccgtacttccggtacttacccgggtactttcggttcgtaccggttcggtacccggg

SEQ ID NO: 45933 - DNA, 727 bp, Homo sapiens
  misc_feature: GYAE6OF01AHMSR.27.57.F02.1.454.CMB.1.raw
  modified_base (187)..(187): a, c, t, g, unknown or other
  misc_feature (187)..(187): n is a, c, g, or t
  modified_base (396)..(396): a, c, t, g, unknown or other
  misc_feature (396)..(396): n is a, c, g, or t
tcagagcgtcgtctcacgaccggtgctcgatttagctcgatatagttgggtttgaggtctcagagaggagccttagccctggactccaagcctttccacttggtgatcagcacggagcacagaggacccacatggaactggggctgagcttggtttccttgttgctattttagaaggtgtccagtgngaggtgcaactggtagtagttcgtggggaggtaggtggtcggtccgaggtccgtagggagtaactccccgtaggacgtacccttctccgtagtcgctagccttcgtgtacttctactttagtagttagttggatgacgtcgtcgggtacccgcgctaccgtccggaaggagggtaacgggcgttaggtacggttcgcggtaacccgaanaacgttaaaccgaggaagttagggaaaacggtaaaaacgtaacttaggtacgtacggtacttacggtacggtaagtaacgggggtccttaacgttacccaacctttaccgtacgtaaccgaacgtacgaaaccgtaaccgaacgtaaacgaaccgtagtaccgtactacgtagtaacgtaagaaacgtacgtaacgaccgggtaacgtagggaaccgaccgggttaaccgacggtaacgccgggttaactgggttaaaccttaggtaccgtacgtggaacggtagaccgttccgacttaaccggtctttattccgtttgttgttaacccgg

SEQ ID NO: 45934 - DNA, 770 bp, Homo sapiens
  misc_feature: GYAE6OF01AF1ZD.27.57.F02.1.454.CMB.1.raw
  modified_base (757)..(757): a, c, t, g, unknown or other
  misc_feature (757)..(757): n is a, c, g, or t
  modified_base (763)..(763): a, c, t, g, unknown or other
  misc_feature (763)..(763): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctggagtcgttgggttttccttgttgtcttattttagaacggtgtccaggtgtgaggtgcaacgtggtgtattcgtggaggaggtgtcggtaccaggtccgtaggaacgtaacgtccccgttaggacgtaccttccgttccgtcgtcgaccgtacgtcccgttcgttacggtaactttccccgttaaccgtttttaggttaagttttaggttaggtagttaggtaacggtccggtttaccgggggtacccgacccgtaacggtacccgttaccggggaaaggggggttacggggtcgttagggtaacggtttccgggacggaaccctaaaaccgtaaacgtaaaacccgtaagtaaggtaacgggtaaaagggttaaaaactaaacgttagtggttacggtaaccttaggtaggtacggaacggtccgtaacttaccgtaacctacttccgtaccgaacgtacgtaacccgaaaccgtacccaaaggtaaccgtcctacgttacgtactcgtacgaacgtaagtacgaacgtccgacgtacgacgacgacgacgacgacgtctagtactcgtagtgtagagtagctactacgtataccttacgttccgttntttcgngttccgg

SEQ ID NO: 45935 - DNA, 858 bp, Homo sapiens
  misc_feature: GYAE6OF01EJJZ2.27.57.F02.1.454.CMB.1.raw
  modified_base (118)..(118): a, c, t, g, unknown or other
  misc_feature (118)..(118): n is a, c, g, or t
tcagagcgtcgtctcacgaccggtgctcgatttagctcgatatagttgggtttgaggtctcagagaggagccttagccctggacctccaaggcctttccacttggtgatcagcacggngcacagagacccaccatggaactggggctgagtcttgggtttttccttggttgcttagttttacggaaggttcgtccgagttgtggaggttgaccaacgttgggtcggtatttcgtagggacgggtacgggttggttaccgggttcccaggtcccgtagggtaactaaccttccccgtaggacgtacctttaccgttccggtgttacgccgtaacgtcccgttacggttaggtaccttttaccgttaaccgtttttaggttaaggttttacgtttacggagttaggtaacggtccgttaccggggttccccgaacctaaccggttacccgtacgggaagggggaccggggttcttggggtaacggttccggacggtaccctaaaacgtaacgttaaaccgaagttacggtaacgggaaaaggttaaaacgaaaacgtttagtacgggttaacggactttacggaggttaacggggaaccggcctttaacttacccgaaccgtactacccgtacgacggtaacgtaaccgaaccgaaccgaaaggaccgttacctaacgttacgtacttcgaagtaacgaactaagaacgacgaccgtacggacggaccgaccgaacggtaacgccggttagtaccgttaacgttaccgtacgttcggtacggaacgaagtaccgtaaccttacccgttaacggttcctttacccttttacccgggttctttttaacggcgtttacccggg

SEQ ID NO: 45936 - DNA, 879 bp, Homo sapiens
  misc_feature: GYAE6OF01BALCP.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggggctgagtcgtgggttttccttgttgctattttagaaggtgtccagtgtgaggtgcaacgtggtggtattcgtgggaggaggtgtggtccaggccgtggagaactcccgtagacgacctctcctggtcgcgacgtccctcgtggtacttaccttaaccgtttagttagtttagttgggtacgtacggaggtccggttcggggtcccacccgtacggtaccgtacccgggaaggggggtaacggggtccgtacgggtacggtttacggtcgggaacctaaaaccgtaaaccgttaaaaaccgaaacggtaacgtaaagggggtaaaacggtaaaaaacgtaaaacgttaaggttacggtacgggtaaccttacggtacgggtaacggtaacggggacccgttaaacttcccgtaaacctaacgttcccgttaaccggaaacgtaaacgggaacccaaaaccgggtaacccgaaaacggtaaacggtaaccctaacggttcgttaaaccgtcgttaaccggaactaaaacggttaaccgaaaccgtaacgggtaacccggtaacggaacgggtacgggaaccggtaaccgggaaacgtaccgggtacggttactaaacggtttaccgtaaccgttagggtaacccggtagggaacggtaacggtaaccctttacccgtaaacggtttccttaacccgtttacccggtttttccgttttaacggacccgtttcccggg

SEQ ID NO: 45937 - DNA, 860 bp, Homo sapiens
  misc_feature: GYAE6OF01B75EE.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagtcttgggttttccttgttgtcttattttagaggtgtccagtgtgaggtcgctaacgtgggtcggattcgtgggaggaggtggtggtccgagtccgtggaacgaacgttcccgtgacgtaccttccgtccttaggtcgcctacggtcccttcgtaggtactttccgttaaccttttaaggttaagttttagttgggtactaggacgtccggtttacggggtcccgacccgtacggaacccgttaccgggaagggggtaacgggtcgttagggtacgttccggtacggaacctaaaacgtaaacgtaaaaccgtaaggtaacggtaagggaaacggtaaaactaaacgttagtaggtacggtacttacgtagggtaacggaaacgggtccgtaacttccgaccgtactccgtaccaaggaacccgtaaccgaaaccgtaaccgtaaacgggtaacttaccgtaaccgtttacggttaaccttaccggtaacgtaacctaaaacggttcgaaaaccggtacccggttaccggtaacggggaacggggttaacccgggaacccgggtaacgggtaaccccggttacgggtaccgtttaaccggttaacgttaacccgtttaacgttcggttaacgggtacgtagggtaacttacccgtaccgtttacggtaccgttaacgttttccgtttaacccttttggaacccgttaccggg

SEQ ID NO: 45938 - DNA, 861 bp, Homo sapiens
  misc_feature: GYAE6OF01AIIFR.27.57.F02.1.454.CMB.1.raw
  modified_base (187)..(187): a, c, t, g, unknown or other
  misc_feature (187)..(187): n is a, c, g, or t
  modified_base (210)..(210): a, c, t, g, unknown or other
  misc_feature (210)..(210): n is a, c, g, or t
  modified_base (844)..(844): a, c, t, g, unknown or other
  misc_feature (844)..(844): n is a, c, g, or t
tcagagcgtcgtctcacgaccggtgctcgatttagctcgatatagttgggtttgaggtctcagagaggagccttagccctggactccaaggtcctttccacttggtgatcagcacggagcacagacggacccaccatggaactggggctgagcttgggtttcctgtgctatttagagtgtccagtgngaggtgcaacgtggtggattcgngggaggtaggtgtcggtcccgagtccgtaggacgtactcccgtagaccgacttccgtccgtgtcgaccgtagcccttcgtggtacttacccttaccgtttaagttacgtttagttaggattacggtcggtccggtttccggggccccacccgtaaggtacccgttaccgggaaaggggggacgggtccgggttaggggttaaccggttccggtaccggtaccctaaaccgtaaaaccgttaaaaccggaaacggtaacggttaacggggtaaaaacggttaaaaacggttaaaaaccgttgttacgggtaacggtaccgttacggtagggtaaccgggggaacgggttaccctacgtttacccgaacccgttgtacccgtaccggtaaaggacgtaaccccggaaacccgaaccgtaaaaggttaaccgtccgtaaccggttttacgtaccgtacgttaaacgggaacccttaaaagtaccggtaaccgtaccggtaacccggtaagggaacccgggtacgggaacccgggtaaggaaccccggttacgggtacggttaaaccttcgttaaacccgtaggttgggaacgacgttagtacgtaacgtccgttaacgtccgttaacctttccggtnttttacgcggtaccggg

SEQ ID NO: 45939 - DNA, 213 bp, Homo sapiens
  misc_feature: GYAE6OF02HFSJA.27.57.F02.1.454.CMB.1.raw
  modified_base (170)..(170): a, c, t, g, unknown or other
  misc_feature (170)..(170): n is a, c, g, or t
  modified_base (173)..(213): a, c, t, g, unknown or other
  misc_feature (173)..(213): n is a, c, g, or t
tcagagcgtcgtctcacgaccggtgctcgatttagctcgatatagttgggtttgaggtctcaggacgaggagccttagccctggactccaaggcctttccacttggtgatcagcacggagcacagaggacccacatggaactggggctgagcggcttggcaaggcgctanagnnnnnnnnnnnnnnnnnnnnnnnnnnnnnnnnnnnnnnnnn

SEQ ID NO: 45940 - DNA, 530 bp, Homo sapiens
  misc_feature: GYAE6OF02H5XSC.27.57.F02.1.454.CMB.1.raw
  modified_base (348)..(348): a, c, t, g, unknown or other
  misc_feature (348)..(348): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggcccacggactggacctggggctaggagtcttcgggtttactgttgctattttagaaggtggtccaggtgtaggaggtcgactaaacgtggtggattctggaggaggtgtggtccagcctggagaatccctgagactctcctgtgcagcctctggattcacctttagtagttattggatgagctgggtccgccagacctccaggggaagggctgggagttcgnggccaaacataaaaccaagatggaaggtaaagaaaactatgtggactcgtgtgaaaggccgaattcaccatctccagagacaacgccaagaagtcactgtatctgacaaatgaacagcctagagagcgagacacggctgtatactactgtgcgagagatctagtcattccgcttttgattcg

SEQ ID NO: 45941 - DNA, 513 bp, Homo sapiens
  misc_feature: GYAE6OF02F6BU9.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaaggggctgggagttcgtggccaacataaaccaagatggaagtaaagaaaactatgtaggactctgtgaaggccattcacatctcagagacaacgaccaagaacgtcactgtatctgacaaatgaacagcctgagagccgagacacggctgtatactactgtgcgagagatcctagtcattccgtcttttgattcg

SEQ ID NO: 45942 - DNA, 515 bp, Homo sapiens
  misc_feature: GYAE6OF02II9SE.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgaggggaggggctggagttcgtggccaacataaaccaagataggaaggtaaagaaaactatagtggactctgtagaaggccgattcacatctcagagacaacgcaagaagtacactgtatctgacaatagaacagacctagagagcgaggacacggctgtatactactgtgcgagagatacctagtctattccgtcttttgatcg

SEQ ID NO: 45943 - DNA, 515 bp, Homo sapiens
  misc_feature: GYAE6OF02I3XYG.27.57.F02.1.454.CMB.1.raw
  modified_base (505)..(505): a, c, t, g, unknown or other
  misc_feature (505)..(505): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctgggagttcgtggccaacataaaccaagatggaaggtaaagaaaactatgtggactctgtggaaggccgattcaccatctccagagacaacgccaaagaagtcactgtatctgacaaatgaacagcctgagagccgaggacacgctagtatactactgtgcgagagatcctagtcattccgnttttgattcg

SEQ ID NO: 45944 - DNA, 511 bp, Homo sapiens
  misc_feature: GYAE6OF02H7RMV.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagtttattggattgagctgggtccgccagactccagggaaggggctggagttcgtggccaacataaaccaagatggaggtaaagaaactatgtggactctgtgaaggccgattcacatctccagagacaacgccaagaagtcactgtatctagcaaatgaacagcctgagagccgagacacggctgtatactactgtgcgagagatcctagtcacttccgcttttgattcg

SEQ ID NO: 45945 - DNA, 517 bp, Homo sapiens
  misc_feature: GYAE6OF02INNE4.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttccgtgtaggctatttagaaggtgtccagtgtgaggtgcaactggtggattctggaggaggtgtggtccagcctggagaatccctgagactctcctgtgcagcctctggattcacctttagtagttattggatgagctgggtccgcagactccagggaagggctggagttcgtggcaacataaaccaagatggaaggtaaagaaaactatgtaggactctgtgaagggccgattcaaccatctccagagacaacgccaaagaagtcactgtactctgactaaatggaacagcctgagagcgaggacacggctagatactactggtgacgagagatctagtctagttccgctttgatcg

SEQ ID NO: 45946 - DNA, 511 bp, Homo sapiens
  misc_feature: GYAE6OF02FVQJL.27.57.F02.1.454.CMB.1.raw
  modified_base (305)..(305): a, c, t, g, unknown or other
  misc_feature (305)..(305): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtgggtccagcctggagaatccctgagactctcctgtgcagcctctggattcacctttagtagttattggatgagctggggtccnccagactccagggaaggggctggagttcgtggccaacataaaccaagatggagtaaagaaaactatgtggactctgtgaagggccgattcacatctccagagacaacgccaagaagtcactgtatctgcaaatgaacagcctgagagccgaggacacggctgtatactactgtgcgagagatcctagtcattccgcttttgattcg

SEQ ID NO: 45947 - DNA, 511 bp, Homo sapiens
  misc_feature: GYAE6OF02I00B5.27.57.F02.1.454.CMB.1.raw
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctgggagttcgtggccaacataaaccaagataggaaggtaaagaaaactatgtaggactctgtgaagggccattcaccatctccagagacaacgccaagaagtcactgtatctgacaaatgaacagcctgagagcgagacacggctgtatactactgngngagagatcctagtcattccgcttttgattcg

SEQ ID NO: 45948 - DNA, 608 bp, Homo sapiens
  misc_feature: GYAE6OF02G0LU2.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagactccgaggggaagggctggagttcgtggaccaacataaaccaagatagggaaggtaaaagaaaactagtaggtagggaactcgtaggtaggaaacggggtccgtaattccgaacctattccgtacccgaaggaacgaaccaaaccgacccaaaggaacgtccaacgttgtaactcgtagacctaaagtcgaaacagacctaggaacgacgaccggaaggaaccgacggtactgtaactaccgtacgtggtcggacgagagtactcccgtagtcctacgtttccgtcttttagacttccg

SEQ ID NO: 45949 - DNA, 520 bp, Homo sapiens
  misc_feature: GYAE6OF02I4332.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctgggagttcgtggccaacataaacccaagatggaaggtaaagaaaactatagtggactctgtgaagggccgattcaccatctccagagacaacgaccaagaagtcactgtatctgacaaatgaacagcctgagagccgaggacacggctgtatactactgtgacgagagatccgtagtcattccgcttttgattccg

SEQ ID NO: 45950 - DNA, 512 bp, Homo sapiens
  misc_feature: GYAE6OF02JBLWX.27.57.F02.1.454.CMB.1.raw
  modified_base (441)..(441): a, c, t, g, unknown or other
  misc_feature (441)..(441): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattccacctttagtagttattggatgagctgggtccgccagactccgagggagggctggagttcgtggccaacataaaccaagatggaaggtaaagaaactatgtgactctgtgaaggccattcaccatctccagagacaacgaccaagaagtcactgtatctgacaaatgaacngcctgagagccgagacacggctagtatactactgtgacgagagactcctagtcattccgcttttgattccg

SEQ ID NO: 45951 - DNA, 509 bp, Homo sapiens
  misc_feature: GYAE6OF02IOJME.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccagggaaggggctgggagttcgtggccaacataaaccaagataggaaggtaaagaaaactatgtggactctgtgaagggccgattcacatctccagagacaacgccaagaagtcactgtatctgacaaatgaacagcctgagagccgagacacggctgtatactatgtgcgagagatctagtcattccgctttgattcg

SEQ ID NO: 45952 - DNA, 511 bp, Homo sapiens
  misc_feature: GYAE6OF02IL0S5.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgttgaggtgcaactggtggattctggaggaggtgtggtccagcctggagaatccctgagactctcctgtgcagcctctggattcacctttagtagttattggatgagctgggtccnccagactccagggaagggctggagttcgtggccaacataaaccaagatggaggtaaagaaactatgtaggactctgtagaagggccgattcacatctcagagacaacgccaagaagtcactgtatctgcaaatgaacagcctgagagccgaggacacggctagtatactactgtgcgagagatccgtagtcattccgcttttgatcg

SEQ ID NO: 45953 - DNA, 533 bp, Homo sapiens
  misc_feature: GYAE6OF02H99GR.27.57.F02.1.454.CMB.1.raw
  modified_base (521)..(521): a, c, t, g, unknown or other
  misc_feature (521)..(521): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctgggagttcgtggccaacataaaccaagatagggaaggtaaaagaaaactatagtaggactctgtgaagggccattcacatctaccagagacaaacgccaaagaagtcaactgtatctagacaaatgaacagacctagagacgccgaagacacggctagtatactactgtgacgagagtatccgtagtcattcccgtnttttcgattccg

SEQ ID NO: 45954 - DNA, 514 bp, Homo sapiens
  misc_feature: GYAE6OF02I8WJS.27.57.F02.1.454.CMB.1.raw
  modified_base (400)..(400): a, c, t, g, unknown or other
  misc_feature (400)..(400): n is a, c, g, or t
  modified_base (510)..(510): a, c, t, g, unknown or other
  misc_feature (510)..(510): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaagggctggagttcgtggccaacataaaccaagatggaaggtaaagaaaactatgtggactctgtgaaggccgattcacatcncagagacacgcaagacgtcactgtatctgacaaatgaacagcctagagagccgaggacacggctagtatactactggtgacgagagactctagtctagttccgtctttgnttcg

SEQ ID NO: 45955 - DNA, 511 bp, Homo sapiens
  misc_feature: GYAE6OF02HW6I6.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggtccgccagactccaggagggctggagttcgtggccaacataaaccaagatggaggtaaagaaaactatgtaggactctgtgaagggcgattcacatctccagagacaacgcaaagaagtcactgtatctgacaaatgaacagcctgacgagccgaagacacggctagtatactactgtgcgagagatcctagtcattccgtcttttgattccg

SEQ ID NO: 45956 - DNA, 532 bp, Homo sapiens
  misc_feature: GYAE6OF02I2K8L.27.57.F02.1.454.CMB.1.raw
  modified_base (303)..(303): a, c, t, g, unknown or other
  misc_feature (303)..(303): n is a, c, g, or t
  modified_base (439)..(439): a, c, t, g, unknown or other
  misc_feature (439)..(439): n is a, c, g, or t
  modified_base (451)..(451): a, c, t, g, unknown or other
  misc_feature (451)..(451): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccncagactccagggaggggctggagttcgtggccaacataaacccaagatgggaaggtaaaagaaaactatggtaggactctggtgaaagggccgattcaccatctccagagacaacgccaaagaagtcactgtatcngccaaatgaacngcctgagacgccgaggacacggctgtaatctaacgtgtgcgtagagacttccgtagttcacgtttccgcttttggattccg

SEQ ID NO: 45957 - DNA, 516 bp, Homo sapiens
  misc_feature: GYAE6OF02IF6JT.27.57.F02.1.454.CMB.1.raw
  modified_base (340)..(340): a, c, t, g, unknown or other
  misc_feature (340)..(340): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaagggctgggagttcgtggccaanataaaccaagatggaaggtaaagaaaactatagtggactctgtgaagggccattcacatctccagagacaacgccaagaagtcactgtatctgacaaatagaacagcctgagagccgaggacacggctagtatactactgtgcgagagatcctagtcattccgtcttttgattccg

SEQ ID NO: 45958 - DNA, 581 bp, Homo sapiens
  misc_feature: GYAE6OF02IYS9Q.27.57.F02.1.454.CMB.1.raw
  modified_base (268)..(268): a, c, t, g, unknown or other
  misc_feature (268)..(268): n is a, c, g, or t
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcggtcgtttcgtcgtaaggcgtactttaagtaaggtgtcagtgtgaggtgcaactggtggattctggaggaggtgtggtccagcctggagaatccctgagactctcctgtgcagcctntggattcacctttaggattattggatgagctgggtccncagactcgagggaggctggngttcgngacaacactaaacagagtaggaaagtaaagaaatgtgtggactcgtgtaggaggacgtactacacactactacgacgacgaacgaaccgacgaacgaacgtactacgttagtagtactacgtactaaacacgaacgacgacgtacgagacgacgaacgacggacggtacgtacgttacgtacgtacgtagtaggtacgacgtacgtacgtacgtacgtacgttaccgttaccgttcgtttacgtagtcg

SEQ ID NO: 45959 - DNA, 527 bp, Homo sapiens
  misc_feature: GYAE6OF02GFAQ3.27.57.F02.1.454.CMB.1.raw
  modified_base (513)..(513): a, c, t, g, unknown or other
  misc_feature (513)..(513): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagttgggtccgccagactccagggaaggggctgggagttcgtggccaacataaaaccaagatgggaaggtaaagaaaactatgtggactctgtgaagggccattcaccatctccagagacaacgccaaagaagtcactgtaatctgacaaatgaacagcctaggacgagccgaggacacggctagtatactactgtagcgagagatccgtagtcattccgnttttgacttctcgg

SEQ ID NO: 45960 - DNA, 566 bp, Homo sapiens
  misc_feature: GYAE6OF02IYRZZ.27.57.F02.1.454.CMB.1.raw
  modified_base (274)..(274): a, c, t, g, unknown or other
  misc_feature (274)..(274): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
tcagagcgtcgtctcacgaccggtgctcgatttagctcgatatagttgggtttggaggtctcagagaggagccttagccctggactccaaggcctttccaccttggtgatcagcacgggagcacagaggacccaccagtcggaactggggctgaggctgggttttccttgttgctattttagaaggtgtccagtgtgaggtgcaactggtggattctggaggaggtgtggtccagcctgggagaatcccctgagactctcctgtagcaggcctntggattcacctttagtagttattggatgagctgggtaccgccgagactccaggggaagggctggagttcgngggccaanataaaccgaagataggaaggtaaagaaaactagtgtaggactctgtagaacgggccgtattcaccgattcaccgaggagacaacgcaaagaatcgatgttatctagacaaatgaacagtccctagacgtagccggaagaccgaggtcgtagtactacttactggtggacggaagagtactccgttaggctacgttcccgtacttttgacttcg

SEQ ID NO: 45961 - DNA, 734 bp, Homo sapiens
  misc_feature: GYAE6OF02GZXF2.27.57.F02.1.454.CMB.1.raw
  modified_base (182)..(182): a, c, t, g, unknown or other
  misc_feature (182)..(182): n is a, c, g, or t
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (268)..(268): a, c, t, g, unknown or other
  misc_feature (268)..(268): n is a, c, g, or t
  modified_base (725)..(725): a, c, t, g, unknown or other
  misc_feature (725)..(725): n is a, c, g, or t
tcagagcgtcgtctcacgaccggtgctcgatttagctcgatatagtttgggttttgggaggtactcagagaggtagcccttagcccgtacggactccgaaggccctttccacttggtgattcagtccaccgagcacagaggacccaccatggaactggggacttggagacggtggtttcgtntaggctacttagtagtcgtcacgtgtntgtttcgnggatgagctcctgacgtgtgnggtccagccagagacttccgagaacgtacnctcgtatcgcagccgtgtcgagttccaacgttacgtaccgtattcggaccttgatcgttcgggtccgaccttaacggacggtcccaaggggtacgggacttaccgggagttaccgtagggtacccaaacggacgtaaaccgaaggttcgtacgggtagggttaaaactaaccgtttatacgttacggacctaccttagtaggaaacggtaccgtagtaccaaacgtctttcgaacccgtagtttacggacctaaacgtttaccttaacgtaacggttaccagttacgtacttacgttagaaccgtaaagtcgggtaaccttacgaccgtttcgggaaccgttaacgggacccgaaggttacggacccggttaacaacggtaatttaccgacggttcggtcgaccgaacgtacgtactttccggttaacttcgtaacgttttcccgtaccggtttacntttacccgg

SEQ ID NO: 45962 - DNA, 518 bp, Homo sapiens
  misc_feature: GYAE6OF02GN3PZ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccaggggaaggggctggagttcgtggccaacataaaccaagatggaaggtaaagaaaactatgtggactctgtgaagggccgattcaccatctcagagacaacgccaagaagtcactgtatctgacaaatgaacagcctagagagccgaggacacggctgtatactactggtgacgagagtatcctagtcattccgcttttgattccg

SEQ ID NO: 45963 - DNA, 515 bp, Homo sapiens
  misc_feature: GYAE6OF02HX8UN.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagataggaggtaaagaaaactatgtaggactctgtgaagggcgattcacatctcagagacaacgacaagaagtcactgtatctgacaaatagaacagacctaggacgagccgaggacacggctgtatactactgtgcagagactctagtcattccgcttttgattcg

SEQ ID NO: 45964 - DNA, 528 bp, Homo sapiens
  misc_feature: GYAE6OF02GUC3V.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttggaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccagggaaggggctggagttcgtggccaacataaaccaagatggagtaaagaaactatgtggactctgtgagggaccgattcgaccatctccagtagacaacgaccaagaagtacaactgtactacttgcaaatgaaacagctagagagccgaagacacggcagtatactacgtagtggacgcgaagatcctagtctaattccgtctttgtataccg

SEQ ID NO: 45965 - DNA, 538 bp, Homo sapiens
  misc_feature: GYAE6OF02HFSFR.27.57.F02.1.454.CMB.1.raw
  modified_base (497)..(497): a, c, t, g, unknown or other
  misc_feature (497)..(497): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcaccttttagtagttattggatgagctgggtccgtccagactccagggaaggggctgggtagttcgttggccaaacactaaaccaagaagtggaaggtaaagaaaactaatgtaggactctgttgaagggccgattcaccatctccagagacaacgccaagaagtacacttagtatcttgacaaatagaacagcctagagagccgagacgacgctgatactacgtgngcgagagactcgtacgtcgtactttccgcttttagattccg

SEQ ID NO: 45966 - DNA, 523 bp, Homo sapiens
  misc_feature: GYAE6OF02IBR2O.27.57.F02.1.454.CMB.1.raw
  modified_base (339)..(339): a, c, t, g, unknown or other
  misc_feature (339)..(339): n is a, c, g, or t
  modified_base (380)..(380): a, c, t, g, unknown or other
  misc_feature (380)..(380): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagagttattggatgagctgggtccgccagactccagggaaggggctggagttcgtggccaanataaaccaagatggaaggtaaaagaaaactatgtaggactntgtgaagggccattcaccatctccagagacaacgccaaagaagtcaacttgtatctagacaaatagaacagacctagagagccgaaggacacggctagatactactgtgcgagagatcctagtcattccgtcttttgattccg

SEQ ID NO: 45967 - DNA, 512 bp, Homo sapiens
  misc_feature: GYAE6OF02HGWL9.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctgggagttcgtggccaacataaaccaagatggaggtaaagaaaactatgtggactctgtgaagggcgattcaccatctccagagacaacgccaagaagtcactgtatctgcaaatgaacagcctgagagccgaggacacggctgtactactactggtgcgagagatcctagtcattccgctttgattcg

SEQ ID NO: 45968 - DNA, 594 bp, Homo sapiens
  misc_feature: GYAE6OF02FFXLT.27.57.F02.1.454.CMB.1.raw
  modified_base (269)..(269): a, c, t, g, unknown or other
  misc_feature (269)..(269): n is a, c, g, or t
  modified_base (314)..(314): a, c, t, g, unknown or other
  misc_feature (314)..(314): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (397)..(397): a, c, t, g, unknown or other
  misc_feature (397)..(397): n is a, c, g, or t
  modified_base (495)..(495): a, c, t, g, unknown or other
  misc_feature (495)..(495): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaaggtgtccagtgtgaggtgcaactggtggattctgggaggaggtgtgggttccaggcctgggacgaatccctgaagcctctcctgtgcagccctntggtacttctacctttagtagttattgggatgagtcgtgggtccnccagactccgaggggaacggggctggtacgtttcgnggacccaaanataaaaccgagataggaagtaaaacgaaaactgtagnggactcgtaggtaggaacgggtccattccaacctatccaccagacgaacaaccgtaccaaagaactcacttgtaactcgtacactaaatcggaaaccncgcgagacgacgacgtagactacgtctagtactacgagtggacgacgagtacgttacttaccgtacttaccgttaccgttccgttcgtttagacctcgg

SEQ ID NO: 45969 - DNA, 568 bp, Homo sapiens
  misc_feature: GYAE6OF02HRXCL.27.57.F02.1.454.CMB.1.raw
  modified_base (345)..(345): a, c, t, g, unknown or other
  misc_feature (345)..(345): n is a, c, g, or t
  modified_base (538)..(538): a, c, t, g, unknown or other
  misc_feature (538)..(538): n is a, c, g, or t
  modified_base (558)..(558): a, c, t, g, unknown or other
  misc_feature (558)..(558): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagacctccgaggggaaggggctgggagttcgtggccaanataaaaccaagatagggaaggtaaaagaaaactatggtaggacttcgtaggtaggaaggggcccgaatttccaaccctaatcctacccaaggaacgaaccaaaccgacccaaaggaaacgtacaacttgtactctagacaaatgaaacagcctagagacgccgaggacacggctgtatactatgtgccgaganacgtctacgtcattcccgtnttttgattcg

SEQ ID NO: 45970 - DNA, 512 bp, Homo sapiens
  misc_feature: GYAE6OF02GWILT.27.57.F02.1.454.CMB.1.raw
  modified_base (503)..(503): a, c, t, g, unknown or other
  misc_feature (503)..(503): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagatggaggtaaagaaaactatgtggactctgtgaagggccgattcaccatctccagagacaacgccaaagaagtcactgtatctgcaaatgaacagcctgagagccgaggacacggctgtatactactgtgcgagagatcctagtcattcccgnttttgatcg

SEQ ID NO: 45971 - DNA, 739 bp, Homo sapiens
  misc_feature: GYAE6OF02HOPPT.27.57.F02.1.454.CMB.1.raw
tcagagcgtcgtctcacgaccggtgctcgatttagctcgatatagttgggtttgaggtctcagagaggagccttagccctggactccaaggcctttccacttggttatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagtttattggatgagctgggtccgccagactccgaggggaagggctgggagttcggtggaccaacactaaaaccaagatagggaaggtaaaagaaaactagtaggtaggacttcgtaggtaggaaaggggtcccgtaagtttcccgaaaccctagttaccctacccgaaacggtaaacggaaacccaaaccggacccgaaaagggtaaacgttaccaaaccgttaggttaactttaccgtacggtaacctaaaaagttacggaaaacctacggacccgttagggaaacggaacggacccgggaacgggtaacccgaaccggggtaccttaacggttaacgtttaacccgttaaccgttgggtacgggaaccggtaaggtaacggtaacgttaccccgttaagttaccgttaacgttttcccggtttacctttttttaggaccgtttcccgttaccgggg

SEQ ID NO: 45972 - DNA, 617 bp, Homo sapiens
  misc_feature: GYAE6OF02HJIBG.27.57.F02.1.454.CMB.1.raw
  modified_base (302)..(302): a, c, t, g, unknown or other
  misc_feature (302)..(302): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtaggctatttagaaggtgtcagtgtgaggtgcaactggtggattctggaggaggtgtggtccagcctggagaatccctgagactctcctgtgcagcctctggattcacctttagtagttattggatgagcgtggggtccnccagactccgaggggaagggctggagttcgtggccaaacaataaaccaagagtagggtaaaggtaaaagaaaacttagtggtaggactcgtggtaggaaacgggccgtatttaccacctacgttcctaccgaaggaacgaaccgaaacgacccgaaaaggaacgtcaaccttgttaatactgactaaatcgaaacacgcctggaagacggaccgaaggaaccgacggtcgtacgtactaccttacgttggtcggacggaagtacgtaaccttcgttaacgttcgtactttcccgttacgttttagacgtttaccg

SEQ ID NO: 45973 - DNA, 532 bp, Homo sapiens
  misc_feature: GYAE6OF02F3G1A.27.57.F02.1.454.CMB.1.raw
  modified_base (528)..(528): a, c, t, g, unknown or other
  misc_feature (528)..(528): n is a, c, g, or t
tcagagcgtcgtctcacgaccggtgctcgatttagctcgatatagttgggtttgagggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagccctggagaatccctgagactctcctgtgcagcctctggattcacctttagtagttattgggaatgaagcttggggttccgccagactccaggggaaggggctgggagtttccgtgggccaacgataaaaccagatggaggtaaagaaaactataggtggactctgtagaagggccattcaccatctcagagacaacgccaaagaagtcactgatctgcaaatgaacagacctgacgagcgaggaacacggctagtactacgtactgtgcgagagactcctagtcattccgcttttgnttcg

SEQ ID NO: 45974 - DNA, 607 bp, Homo sapiens
  misc_feature: GYAE6OF02I2IFF.27.57.F02.1.454.CMB.1.raw
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattccactttagtagttattggatgagctgggtccnccagactccagggaagggctggagttcgtggaccaanataaaaccaagatagggaagtaaaagaaaactatggtaggactctaggtaggaagggtccgaattccgaacctaatcctaccaaggaacgaaccaaacgccaaaaggaactccaacttgtaactccgtagaccaaaattcggaaacaggtaccctaggaacgacggacccggaagaccgaacggctaggtaactacctacgtggtacgacggaagaacgtaacttcccgtaagttccaacgtttcccgactttttaggactttccgg

SEQ ID NO: 45975 - DNA, 546 bp, Homo sapiens
  misc_feature: GYAE6OF02GICZF.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcggtggtttcgtcgtaggcgtactttagtaaggtgtcagtgtgaggtgcaactggtggattctggaggaggtgtggtccagcctggagaatccctgagactctcctgtgcagcctctggattcacctttagtagttattggatgagctgggtccgccaggactccgaggggaaggggctgggagttcgtggccaacataaaccaagatggaagtaaagaaactatgtggactctaggtagaaaggccgaattcactatctcagagacaacgaccaaagacgtcactgtatctgacaaatgaacagccgtagacgacgccggaggacgacggtctagtatacgtacgtggtgacgaggacgtactccgtagtcctacgttccgtcttttagattcgg

SEQ ID NO: 45976 - DNA, 509 bp, Homo sapiens
  misc_feature: GYAE6OF02G096I.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagatggagtaaagaaaactatgtggactctgtgaagggccgattcacatctccagagacaacgccaagaagtcactgtatctgcaaatgaacagcctgagagccgaggacacggctgtatactactgtgcgagagatcctagtcattccgcttttgattcg

SEQ ID NO: 45977 - DNA, 539 bp, Homo sapiens
  misc_feature: GYAE6OF02F6LH3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgaggggaaggggctgggagttcgtggtacaacataaaccaagatagggaaggtaaaagaaaactatggtaggactcgtggtaggaagggccgattccaccatctacagagacaacgccaaagaacgtcactgtatctagacaaatgaaacagcctgagagccgaggacacggctagtactactactggtgacgagagtactcctagtctacttccgtcttttgattcg

SEQ ID NO: 45978 - DNA, 516 bp, Homo sapiens
  misc_feature: GYAE6OF02IGAEP.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgaggggagggctggagttcgtggccaacataaaccaagataggaaggtaaagaaaactatgtaggactctgtagaagggccattcaccatctcagagacaacgcaagagtcatgtatctgacaaatgaacagcctgagagccgaggacacggctgtatactacgtgtgcgagagtatccgtagtctacttccgtcttttgattcg

SEQ ID NO: 45979 - DNA, 520 bp, Homo sapiens
  misc_feature: GYAE6OF02HDNXJ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaaggggctgggagttcgtggccaacataaaccaagatagggaaggtaaagaaaactatgtggactctgtgaaggccattcaccatctcagagacaacgccaagaacgtcactgtatctgacaaatgaacagcctagagagccgaggacacggctgtatactactgtgcgagagtactcctagtcattccgtcttttgattcg

SEQ ID NO: 45980 - DNA, 703 bp, Homo sapiens
  misc_feature: GYAE6OF02ICS0E.27.57.F02.1.454.CMB.1.raw
  modified_base (345)..(345): a, c, t, g, unknown or other
  misc_feature (345)..(345): n is a, c, g, or t
  modified_base (397)..(397): a, c, t, g, unknown or other
  misc_feature (397)..(397): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtgggctgagcgttgggttttccttgttgcttattttagaggtgtccagtgtgaggtgcaacgtggtggtattcgtgggaggaggtggtcggtccgaggtccgttgggaagaactcccgtaggacgtacctcttccgtggtcgcacgtcctcgtggactttcctaccttttagtagtttattggattggagtcgttcgggtcccnccgaagacctccggaagggggaagggctgggtagtttcggtcggacccaaanaactaaaaccgaagtagtagggaaaggtaaaaagaaacttagtggtaggactcgtggtaggaacggggcctaagtttaccgaacctatccctaccgaaggtaacgaacgaaacgcccaaaaaggacggttaccaacgtttacggttaacttacgttacggaactaaaagttacggaaactacggtaccttagggaaacggacggaacccgggaaggaacccgtacggcctttagtaaccttaccgttacgtggtaggaccgaagtacgtactccgtagtcttacgttcccgttattttgacttccg

SEQ ID NO: 45981 - DNA, 527 bp, Homo sapiens
  misc_feature: GYAE6OF02G5GAB.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaaggggctgggagttcgtggccaacataaaccaagatggaaggtaaagaaaactagtgtaggactcgtgtaggaagggccgattcaccatctccagacgacaacgccaagaacgtcatgtatctgacaaatgaacagcctgagagccgaaggacacggctgtatactactggtgcgagagactcctagtcattcccgtcttttgattcg

SEQ ID NO: 45982 - DNA, 512 bp, Homo sapiens
  misc_feature: GYAE6OF02HIYYR.27.57.F02.1.454.CMB.1.raw
  modified_base (504)..(504): a, c, t, g, unknown or other
  misc_feature (504)..(504): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaaggggctgggagttcgtggccaacataaaccaagatggaagtaaagaaaactatgtggactctgtgaaggccgattcacatctcagagacaacgcaaagagtcactgtatctgcaaatgaacagcctagacgagccgaaggacacggctagtatactactgtgcgagagatcctagtcattccgtntttgatcg

SEQ ID NO: 45983 - DNA, 527 bp, Homo sapiens
  misc_feature: GYAE6OF02H98JU.27.57.F02.1.454.CMB.1.raw
  modified_base (362)..(362): a, c, t, g, unknown or other
  misc_feature (362)..(362): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagagtgtccagtgtgaggtgcaactggtggattctggaggaggtgtggtccagcctggagaatccctgagactctcctgtgcagcctctggattcacctttagtagttattggatgagctgggtccgcagactccgaggggaaggggctgggagttcgtggccaacataaaccaagatggaagtaaanaaactatgtgactctgtagaaggcattcacatctcagagacaacgccaagaacgtcacttgtatctagcaaatgaacagcctagagagccgaggacacggctgtaatactactggtcggacgaggaagacttaccgtagtcctagttcccgtcgttttagattcg

SEQ ID NO: 45984 - DNA, 634 bp, Homo sapiens
  misc_feature: GYAE6OF02HSREG.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtcagcctggagaatccctgagactctcctgtgcagcctctggattcacctttagtagttattggatgagctgggtccgccagactccagggaaggggctggagttcgtggaccaacataaaaccaagatgggaaaggtaaaagaaaactagtaggtacgggaacttcgttaggaggaaacggggcccgaagtttccaacccgtaacttcctacccgaacggaacgaaccgaaaccgacccaaagaacgtaccaaccttggttaactacgttagacaaaagtacgaaacgaacgacctaggacgaagaccggaaggaaccgacggacgttagtaacttacttaacgtagtcggacgaaggacgaacttccgttaacgtactacgtttcccgtacgtttttcgatttcccgg

SEQ ID NO: 45985 - DNA, 651 bp, Homo sapiens
  misc_feature: GYAE6OF02HN728.27.57.F02.1.454.CMB.1.raw
  modified_base (332)..(332): a, c, t, g, unknown or other
  misc_feature (332)..(332): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggagggctggagttcgnggccaacataaaccaagagtaggaaggtaaaagaaaactagtagtaggactcgtaggtaggaaacggggccgtaatttccaaccctatccctaccgaagaacgaaccgaaaccgaccaaaggaaacgtccaacgttagtaactcgttagaactaaaagtcgaaactacggacccgttaggaacgtaacggacccggaagggaacccgaaccgggaccttaggtaacttaccgtacgttagggtacggaccggtaaggtacgtaacttacccgttaaggttaccctacgttttccccggttctttttaggactttcccgg

SEQ ID NO: 45986 - DNA, 530 bp, Homo sapiens
  misc_feature: GYAE6OF02ISP5E.27.57.F02.1.454.CMB.1.raw
  modified_base (344)..(344): a, c, t, g, unknown or other
  misc_feature (344)..(344): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctattttagaaggtgtccagtgtgaggtgcaactggtggattctggaggaggtgtggtccagcctggagaatccctgagactctcctgtgcagcctctggatttcacctttagtagttattggatgagctggggtccgccagactccgaggggaaggggctgggagttcgtggccaaanataaaccaagatagggaaggtaaaagaaaactatgtaggactcgtgtggaagggccattcaccatctccagagacaacgcaaagaagtacactagtatctagcaaatgaacagactagagagacgaggacgacggctgtatactacgtgtgcgaggagatacctagtctattccgcttttgattcg

SEQ ID NO: 45987 - DNA, 513 bp, Homo sapiens
  misc_feature: GYAE6OF02FWWBQ.27.57.F02.1.454.CMB.1.raw
  modified_base (504)..(504): a, c, t, g, unknown or other
  misc_feature (504)..(504): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaagggctggagttcgtggccaacataaaccaagatggaaggtaaagaaaactatgtggactctgtagaagggccgattcaccatctccagagacaacgccaaagaagtccactgtatctgacaaatgaacagcctagagagccgagacacggctgtatactactgtgcgagagatctagtcattccntttgattcg

SEQ ID NO: 45988 - DNA, 518 bp, Homo sapiens
  misc_feature: GYAE6OF02JFS2J.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctgggagttcgtggccaacataaaccaagatggaaggtaaagaaaactatgtggactctgtgaagggccattcacatctcagacacaacgccaaagagtcactgtatctgacaaatgaacagcctagagacgccgagaccacggctagtatactatgtgcgagagactaccgtagtcacttccgtcttttgatccg

SEQ ID NO: 45989 - DNA, 561 bp, Homo sapiens
  misc_feature: GYAE6OF02GHX9K.27.57.F02.1.454.CMB.1.raw
  modified_base (263)..(263): a, c, t, g, unknown or other
  misc_feature (263)..(263): n is a, c, g, or t
  modified_base (333)..(333): a, c, t, g, unknown or other
  misc_feature (333)..(333): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaaggtgtccagtgtgaggtgcaactggtggattctggaggaggtgtggtccagcctggagaactccctgagactctcctgtgcagccctntggattcacctttagtagtttattggatgagctgggtccgcagactccgaggggaagggctggagttcgnggaccaacaataaaaccaagataggaaaggtaaaacgaaaactagtagtacggactcgtggtaggaacgggccgtaattccgactactctaccagacgacaaccgaccaaagaacgtcaactgtatctgacaaatagaacagtcctagagacgacgacggacgacggcgtagtatactactggtgacgagagtacgtacgtacgtctacttccgtcttttcgattccg

SEQ ID NO: 45990 - DNA, 517 bp, Homo sapiens
  misc_feature: GYAE6OF02GCEYR.27.57.F02.1.454.CMB.1.raw
  modified_base (467)..(467): a, c, t, g, unknown or other
  misc_feature (467)..(467): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
  modified_base (508)..(508): a, c, t, g, unknown or other
  misc_feature (508)..(508): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttctgtagctatttggaaggtgtccagtgtgaggtgcaactggtggattctgggaggaggtgtggtccagcctggagaatccctgagactctcctgtgcagcctctgattcacctttagtagttatggatgagctgggtccgccagactccgagggaaggggctgggagttcgtggccaacgataaaccaagagtgggaaggtaaaagaaaacttagtgtaggactctgtagaagggccattcacatctccagagacaacgccaagaagtcactagtatctgacaaatagaacagcctagagagcgagacncgatgtatactacngtgcgaganctacagtctagttccgtntttgattcg

SEQ ID NO: 45991 - DNA, 513 bp, Homo sapiens
  misc_feature: GYAE6OF02IL7SO.27.57.F02.1.454.CMB.1.raw
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
  modified_base (429)..(429): a, c, t, g, unknown or other
  misc_feature (429)..(429): n is a, c, g, or t
  modified_base (464)..(464): a, c, t, g, unknown or other
  misc_feature (464)..(464): n is a, c, g, or t
  modified_base (506)..(506): a, c, t, g, unknown or other
  misc_feature (506)..(506): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtcccgcagactccagtgaaggggctggagttcgnggccaacataaaccagataggaagtaaaagaaactntagtgaactcgtgtagaagggccgtattcactatctcagagacaacgccaagagtcatnatctgacaatgaacagcctagagacgccgaggacncggctgtatctactgtagcgagagactcctagtcatttccgntttgacg

SEQ ID NO: 45992 - DNA, 538 bp, Homo sapiens
  misc_feature: GYAE6OF02I7KP8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctgggaggaggtgtggtccagcctggagaatccctgagactctcctgtgcagcctctggattcacctttagtagttattggatgagctgggtccgccagactccaggggaaggggctgggagttcgtggccaacataaaccaagatggaaggtaaagaaaactatagtaagactctgtgaagggccgattcaccatctccagacgacaacgccaagaacgtcactgtatctgacaaatgaacagcctaggagacggccgaaggacacggctgtaactactctaggtgacgagagactaccgtagtcctacttcccgtcttttgattccgg

SEQ ID NO: 45993 - DNA, 518 bp, Homo sapiens
  misc_feature: GYAE6OF02GD9FF.27.57.F02.1.454.CMB.1.raw
  modified_base (467)..(467): a, c, t, g, unknown or other
  misc_feature (467)..(467): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccaggggaaggggctggagttcgtggccaacataaaccaagatggaaggtaaagaaaactatgtggactctgtgaagggccatcaccatctcagagacaacgccaagaagtacactgtatctgacaaatgaacagcctagagagccgaggacacggntgtatactactgcgacgagacgatcctagtctattccgtcttttgattccg

SEQ ID NO: 45994 - DNA, 548 bp, Homo sapiens
  misc_feature: GYAE6OF02H07RW.27.57.F02.1.454.CMB.1.raw
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
  modified_base (453)..(453): a, c, t, g, unknown or other
  misc_feature (453)..(453): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactntcctgtgcagcctctggattcacctttagtagttattggatgagctgggtccnccagactccgagggaagggctgggagttcgtggccaacataaaccaagatagggaaggtaaaagaaaactataggtaggactcgtgtaggaagggccgattcactatctccagagaacaaccgacaaagaactacactgtactactganaaatgaacagacctagagagaccgaggacacggctagtaatactacgtggcgacgagaagactccgtagtctacgtttccgtcttttgatttccg

SEQ ID NO: 45995 - DNA, 554 bp, Homo sapiens
  misc_feature: GYAE6OF02HQFWA.27.57.F02.1.454.CMB.1.raw
  modified_base (343)..(343): a, c, t, g, unknown or other
  misc_feature (343)..(343): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattccacctttagtagttattggatgagctgggtccgccagactccgagggaacggggctggagttcgtggccaanataaaccaagatggaaggtaaaagaaaactagtagtaggactcgtggtaggaaggggccgtaattcaaccatcctaccagaagaacaaacgaccaagaacgtacactgtatctagacaaatagaacagacctagagacgcgagaccgacggctagtatactactaggtcgcgagaagatacctagtctacttccgtacttttgacttccgg

SEQ ID NO: 45996 - DNA, 528 bp, Homo sapiens
  misc_feature: GYAE6OF02IC630.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgagggagggctggagttcgtggccaacataaaccaagatggaaggtaaagaaaactagtagtggactctgtggaaggccgtattcacatctccagagacaacgaccaaagaagtcacttgtatctgacaaatgaacagacctagagacgccgaaggaccacggctagtactactactgtgacgagagatcctagtctacttccgtcttttgattcg

SEQ ID NO: 45997 - DNA, 569 bp, Homo sapiens
  misc_feature: GYAE6OF02GVAQK.27.57.F02.1.454.CMB.1.raw
  modified_base (336)..(336): a, c, t, g, unknown or other
  misc_feature (336)..(336): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtaggctatttagaaggtgtcagtgtgaggtgcaactggtggattctggaggaggtgtggtccagcctggagaatccctgagactctcctgtgcagccctctggattcacctttagtagttattggattgagcgtgggtaccgccagactccgaggggaagggctggagttcggnggccaacataaaccaagtagtaggaaggtaaaagaaaactagtcggtaggactcgtggtaggaacggggcctattcaccatcctacaagagaccgaacgaccgaaagaacgtccaacgttgtactctagaccaaatacgaacacgacctaggagacgccggagaccgacggctagtatactactggtgcgagagacgtaccgtagtctacgtttccgtcttttagacttccgg

SEQ ID NO: 45998 - DNA, 664 bp, Homo sapiens
  misc_feature: GYAE6OF02I536H.27.57.F02.1.454.CMB.1.raw
  modified_base (304)..(304): a, c, t, g, unknown or other
  misc_feature (304)..(304): n is a, c, g, or t
  modified_base (330)..(330): a, c, t, g, unknown or other
  misc_feature (330)..(330): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtgggtccagcctggagaatccctgagactctcctgtgcagcctctggattcacctttagtagttattggatgagctgggtccncagactcagggagggctggagttcgnggcaacataaaccaagataggaaggtaaaagaaaactatacggtaggaacttcgtagtagggtaaacggggccgtaagtttaccgaacctagttccgtaaccccaaggaacgaaaccaaacggaccctaaaaaggaaacggttaccaacggttaaggttacttaccgttaggaactaaaagtacgaaaaccgaagtacccttaggaacgaacgggaccccggaaaggaacccgaaccgggtactaggttaaccttaaccgtaacgttcgtagaccggaacgtaaggacttaccggtacgttactacgtttaccgtcgtttttaggacttaccgg

SEQ ID NO: 45999 - DNA, 520 bp, Homo sapiens
  misc_feature: GYAE6OF02IR7GV.27.57.F02.1.454.CMB.1.raw
  modified_base (341)..(341): a, c, t, g, unknown or other
  misc_feature (341)..(341): n is a, c, g, or t
tcagagcgtcgtctcacgaccggtgctcgatttagctcgatatagttggggtttggaggtctcagagaggagccttagccctggactccaaggcctttccacttggtgatcagcacggagcacagaggacccacatggaactggggctgagctgggttttcctgttgctattttagaaggtgtccagtgtgaggtgcaactggtggattctggaggaggtgtggtccagcctggagaatccctgacgactctcctgtgcagcctctggattcacctttagagttattggatgagctgggtccgcagactccgaggggagggctggagttcgtggccaacanaaaccagatggaaggtaaagaaaactatgtaggactcgtgtggaagggccgaattcaccatctccagagacaacgacaaagaagtcactgtatctagacaaatgaacagcctagagagcgacggacacggactgtatactactagtgacgagagatctagtctatccgtctttgattcg

SEQ ID NO: 46000 - DNA, 663 bp, Homo sapiens
  misc_feature: GYAE6OF02J08D9.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgtaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttatggatgagcgtgggtccnccagactccgaggggaaggggctgggagttcgtggaccaactaataaaaccgagtaacgtgggaaaggtaaaagaaaactgtaggtggaaccttcgtggtaggaaacggggccgtaatttaccgaacctaacgtcctaccgaaggaacgaaccaaaccggacccaaaaggtaagtacctacgttacgttactaccgtaggaactaaacgtacgaaaccgtacggacccttagggaacgtaacggcccgggtaaacgggccgaaaccgggtctaacggttaactaccgtaacgttgggtacgacggaagtacgacttaccgtagtaccgtacgtttcccggtactttttagactttccgg

SEQ ID NO: 46001 - DNA, 526 bp, Homo sapiens
  misc_feature: GYAE6OF02I6HEI.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccagggaaggggctgggagttcggtggccaacataaaaccaagaatggaagtaaagaaaactatagtggactctgtgaagggccgattcaccatctccagagacaaacgcaaagaagtacacgtgtatctgacaaatgaacagccctagacgagaccggagacgacggctgtatactatgtcgcgagagatccgtagtcattccgcttttagattccg

SEQ ID NO: 46002 - DNA, 585 bp, Homo sapiens
  misc_feature: GYAE6OF02JKNHO.27.57.F02.1.454.CMB.1.raw
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
tcagagcgtcgtctcacgaccggtgctcgatttagctcgatatagttgggtttgtaggtctcagagaggagccttagccctcggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccaggggaagggctgggagttcgtggccaacataaaccaagatggaggtaaagaaaactnagtggactntgtgaagggcgattcaccatctccaganacaacgccaagagtcactagtatcgtgactaaatagaaacacgacctacggagaagcccggaaggaaccgtacgggaccttgtaaacgttctaacgtcggttaggcccggtaaagtagggaacctttaccgtacggttactacgtttacccgtccgtttttttagaactttcccgg

SEQ ID NO: 46003 - DNA, 522 bp, Homo sapiens
  misc_feature: GYAE6OF02F2WFY.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagatgggagtaaagaaaactatgtggactctgtgaaggccatcacatctcagagacaacgccaaagaacgtcaactgtatctgacaaatgaacagacctgagagccgaggacacggctagtactactaacgtgtagacgtagagattccgtagtcatttccgtcttttgattccg

SEQ ID NO: 46004 - DNA, 521 bp, Homo sapiens
  misc_feature: GYAE6OF02FH4PY.27.57.F02.1.454.CMB.1.raw
  modified_base (302)..(302): a, c, t, g, unknown or other
  misc_feature (302)..(302): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctggaggaggtgtggtccagcctggagaatccctgagactctcctgtgcagcctctggattcacctttagtagttattggatgagctgggtccncagactccagggaaggggctggagttcgtggccaacataaaccaagatggaaggtaaagaaaactatgtggactctgtgaagggccgattcaccatctccagagacaacgccaagaagtcactgtatctagcaaatgaacagctagagagccgaggacacggctagtatacgtactggtgacgagagactccgtagtctatttccgtcttttgattccg

SEQ ID NO: 46005 - DNA, 520 bp, Homo sapiens
  misc_feature: GYAE6OF02F8HN5.27.57.F02.1.454.CMB.1.raw
  modified_base (303)..(303): a, c, t, g, unknown or other
  misc_feature (303)..(303): n is a, c, g, or t
  modified_base (422)..(422): a, c, t, g, unknown or other
  misc_feature (422)..(422): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccncagactccgagggaaggggctgggagttcgtggccaacataaaccaagatgggaaggtaaagaaaactatgtggactctgtgaagggccattcaccatctcagagacaacgccaagaancactgtatctagcaaatgaaacagacctgagaggccgaaggaccacggctgtatactactgtgcgagagactccgtagtcacttccgtcttttgatcg

SEQ ID NO: 46006 - DNA, 532 bp, Homo sapiens
  misc_feature: GYAE6OF02G91AT.27.57.F02.1.454.CMB.1.raw
  modified_base (522)..(522): a, c, t, g, unknown or other
  misc_feature (522)..(522): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctgggagttcgtggccaacataaaccaagatagggaagtaaagaaaactatgtaggactcgtagtgaagggccattccacctatctcagagaccaacgaccaagaacgtcacttgtatctgacaaatgaacagccctagacgacgaccgaggacacggctagtatactacgtgtgacgagagatccgtagtcattccgtnttttgattcg

SEQ ID NO: 46007 - DNA, 544 bp, Homo sapiens
  misc_feature: GYAE6OF02ISOP3.27.57.F02.1.454.CMB.1.raw
  modified_base (341)..(341): a, c, t, g, unknown or other
  misc_feature (341)..(341): n is a, c, g, or t
  modified_base (416)..(416): a, c, t, g, unknown or other
  misc_feature (416)..(416): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (539)..(539): a, c, t, g, unknown or other
  misc_feature (539)..(539): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgagtgcaactggtggattctggaggaggtgtggtccagcctggagaatccctgagactctcctgtgcagcctcgtggattcacctttagtagttattggatgagctgggtccgccagacctccgagggaagggctggagttcgtggccaanaataaaccgaagagtaggaaggtaaagaaaactagtgtaggactcgtgtagaagggaccgatcaccatctcaganacacgacaagaactcactagtatntgacaaangtaacaggaccttagaagacgaccgtaagacgacggcgtagtactactaactggtgacggagagactacgtagtctatccggtcttttagnttacg

SEQ ID NO: 46008 - DNA, 516 bp, Homo sapiens
  misc_feature: GYAE6OF02FY5SA.27.57.F02.1.454.CMB.1.raw
  modified_base (338)..(338): a, c, t, g, unknown or other
  misc_feature (338)..(338): n is a, c, g, or t
  modified_base (396)..(396): a, c, t, g, unknown or other
  misc_feature (396)..(396): n is a, c, g, or t
  modified_base (460)..(460): a, c, t, g, unknown or other
  misc_feature (460)..(460): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaggtgtcagtgtgaggtgcaactggtggattctggaggaggtgtggtccagcctggagaatccctgagactctcctgtgcagcctctggattcacctttagtagttattggatgagctgggtccgccagactccgaggggaaggggctgggagttcgtggccaanataaaccaagatggaaggtaaagaaaactatgtaggactctgtgaaggccattcaccntctcagagacaacgcaaagagtcatgtatctgacaaatgaacagcctagagagcgagacacggntgtatactactggtgacgagagacgttcgtagtctacgttccgtcttttgattccg

SEQ ID NO: 46009 - DNA, 515 bp, Homo sapiens
  misc_feature: GYAE6OF02IQVEH.27.57.F02.1.454.CMB.1.raw
  modified_base (338)..(338): a, c, t, g, unknown or other
  misc_feature (338)..(338): n is a, c, g, or t
  modified_base (428)..(428): a, c, t, g, unknown or other
  misc_feature (428)..(428): n is a, c, g, or t
  modified_base (475)..(475): a, c, t, g, unknown or other
  misc_feature (475)..(475): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggagggctggagttcgtggccaanataaaccaagatggaaggtaaagaaaactatgtggactctgtgaagggcattcaccatctcagagacaacgccaagaagtcactgtatcngacaaatgaacagcctagagagaccgaggacacggctgtatactacnggtgacgagagatacctagtcattccgtacttttgattcg

SEQ ID NO: 46010 - DNA, 524 bp, Homo sapiens
  misc_feature: GYAE6OF02HILOB.27.57.F02.1.454.CMB.1.raw
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccncagactccagggagggctggagttcgtggccaanataaaccaagatggaaggtaaaagaaaactatgtaggactcgtgtggaagggccgattcaccatctaccagacgacaacgaccaaagaagtcactgtatctgacaaatgaacagcctgacgagccgagacgacggctagtatactactgtgcgagagactacctagtcattccgtcttttgattccg

SEQ ID NO: 46011 - DNA, 614 bp, Homo sapiens
  misc_feature: GYAE6OF02HEAZM.27.57.F02.1.454.CMB.1.raw
  modified_base (597)..(597): a, c, t, g, unknown or other
  misc_feature (597)..(597): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaagggctggagttcgtggccaacataaaccaagataggaaggtaaaagaaaactagtaggtaggactcgtgtaggaaggggccgtaatttccgaacctattcccgtacccgaaggaacgaaccaaaccgaccaaaggtaacgtacaacgttagtactcgtagaactaaagtacgaaacacgccgtaggaacgacggaccgaaggaccgacggcttagtaacttacctacgtaggtcggacgaggaagtaccttccgtaacgttcctaccgtttcccgtntttttacgactttccgg

SEQ ID NO: 46012 - DNA, 528 bp, Homo sapiens
  misc_feature: GYAE6OF02I51X4.27.57.F02.1.454.CMB.1.raw
  modified_base (519)..(519): a, c, t, g, unknown or other
  misc_feature (519)..(519): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaaggggctggagttcgtggccaacataaaccaagataggaggtaaaagaaactatgtggactcgtgtgaagggccgattcacatctccagagacaacgccaagaacgtcacgtgtatctgacaaatcgaacagacctagagacgaccggaggaccacggctagtatactacgtgtgcgagagactcctagtctagttccgtntttgattcg

SEQ ID NO: 46013 - DNA, 538 bp, Homo sapiens
  misc_feature: GYAE6OF02FPJGJ.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgaggggaagggctgggagtttcgtggccaacataaaaccaagatggaaggtaaagaaaactatagtggactcgtgtagaagggcctattcaccatctcagacgacaacgaccaaagaagtcaactgtatctagacaaatcgaacagcctagaagacgaccgaaggaccgacggctagtactactactggtgacgagagatccgtagtctattccgcttttgattcg

SEQ ID NO: 46014 - DNA, 554 bp, Homo sapiens
  misc_feature: GYAE6OF02IBUHT.27.57.F02.1.454.CMB.1.raw
  modified_base (458)..(458): a, c, t, g, unknown or other
  misc_feature (458)..(458): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaaggggctggagttcgtggccaacataaaaccaagagtaggaaggtaaaagaaaactaagtagtaggactactgtaggaaggggccgtaattccgaaccatcctccaagagaacaaccgaccaaaggatacactgtatcgnacaaatagaacagacctagagagccgagaccgacggctagtatactacgtgtgacgagacgtatccgttagctacgtttccgtcttttgacttcgg

SEQ ID NO: 46015 - DNA, 536 bp, Homo sapiens
  misc_feature: GYAE6OF02JBOMR.27.57.F02.1.454.CMB.1.raw
  modified_base (302)..(302): a, c, t, g, unknown or other
  misc_feature (302)..(302): n is a, c, g, or t
  modified_base (438)..(438): a, c, t, g, unknown or other
  misc_feature (438)..(438): n is a, c, g, or t
  modified_base (474)..(474): a, c, t, g, unknown or other
  misc_feature (474)..(474): n is a, c, g, or t
  modified_base (523)..(523): a, c, t, g, unknown or other
  misc_feature (523)..(523): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccnccagacctccgaggggaaggggctggagttcgtggccaacataaaccaagataggaaggtaaagaaaactatagtggactctgtgaagggccgattcacatctccagagacaacgccaaagacgtcacttgtatcngacaaatgaaacagcctggagagccgaggacacggntagtactactacgtggtgacgagagacttccgtagtctaagttcccgtnttttagattccgg

SEQ ID NO: 46016 - DNA, 576 bp, Homo sapiens
  misc_feature: GYAE6OF02JHJDI.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccncagactccgagggaaggggctgggagttcgtggccaacataaaccaagagtaggaaggtaaaagaaaactagtgtaggactacgtgtaggaaagggccgtaattccgacctagtacctccaagacgaccaaacgccaaagtacgtacacttacgtactctagactaaaatgaaacagaccctagaagacggaccgaggacgacggcctagtaactacgtactggtcgacgaagagtactacctaggtactagttccgtcgttttagacttccg

SEQ ID NO: 46017 - DNA, 567 bp, Homo sapiens
  misc_feature: GYAE6OF02HIV1A.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtattattggatgagctggggtccgccagactccgagggagggctgggagttcgtggccaacataaaccaagataggaaggtaaagaaaactatgtaggactcgtgtaggaagggcgattcaccatctacagagacaacgccaaagagtacacttagtactctgactaaatgaacagcctagacgacgaccgaaggaccgacggacttagtactacgttacgttggtagaccgaggtaacgacttacccgtaggttccctacgtttcccgtactttttaggactttccg

SEQ ID NO: 46018 - DNA, 877 bp, Homo sapiens
  misc_feature: GYAE6OF02JRTH4.27.57.F02.1.454.CMB.1.raw
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
tcagagcgtcgtctcacgaccggtgctcgatttagctcgatatagttgggtttgtaggtctcagagaggagccttagccctggactccaaggcctttccacttggtgatcagcacggagcacagaggaaccaccatggaactgggctgagctgggttttccttgttgctatttagaaggtgtccagtgtgaggtgcaactggtggattctgggaggaggtgtggtccagcctggatactccgnganactctctgtcacncgtctcgtagtacttccttacgtttagttagttagtggtagtaggtacgtcgggttccgggtccctacccggtaagtacccgtaccggggtaaaggggggacggggtccgttagggttaccggttacgggtacccggaaccctaaacaaaacgtaaaaccggaagttagggtaaggggttaaaacggtaaaaaacgtaaaacgtttacggtacggggttaaccgttacgttaccggttaagggttaaacggggggaacccgggggtaaccctttaacgtttaccccgaaaacccggttacctttaccccggttaaaccccggaaagggaaaacccggtaaacccgaaaacccggggtaaacccgtaaaagggtaaaacccgttcccgtaaacggtttaacgttaacgttaccggaacgtaaacgtaaaaggtaaaccggtaaacgccggttaaccgaaggggtaacgaaccgggtccgaaaacgggacccgaggttccgttaaagttacccttaaccgttcggttacgggtaacgggacgaaggttaacctaccggtttacccttaacgggtcccttaaccgggtttacccctttttacggtttagaccttacccggg

SEQ ID NO: 46019 - DNA, 540 bp, Homo sapiens
  misc_feature: GYAE6OF02IVDJW.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatcccctgagactctcctgtgcagcctctggattcacctttagtagttattggatgagctggggtccgcagactccgaggggaagggctgggagttcgtggccaacataaaccaagatggaaggtaaagaaaactatgtggactcgtgtagaagggccattcaccatctcagagacaacgccaaagaacgtcacttgtatctgacaaatgaacagcctagaaggacgccggaagggacacggactgtaatactacgtgtcgacgagagacttccgtagtctacgttccgtcttttcgattccgg

SEQ ID NO: 46020 - DNA, 515 bp, Homo sapiens
  misc_feature: GYAE6OF02IDSPH.27.57.F02.1.454.CMB.1.raw
  modified_base (339)..(339): a, c, t, g, unknown or other
  misc_feature (339)..(339): n is a, c, g, or t
  modified_base (505)..(505): a, c, t, g, unknown or other
  misc_feature (505)..(505): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggagggctggagttcgtggccaanataaaccaagatggaaggtaaagaaaactatagtaggactctgtgaagggccattcacatctccagagacaacgccaagaagtacactgtatctgacaaatgaacagacctgagagccgaggacacggctagtactactactgtgcgagagatctagtcattccgnttttgattcg

SEQ ID NO: 46021 - DNA, 519 bp, Homo sapiens
  misc_feature: GYAE6OF02GH7U5.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaagggctggagttcgtggccaacataaaccaagatggaggtaaagaaactatgtaggactctgtgaagggccgattcaccatctccagagacaacgccaagaagtcactgtatctgacaaatagaacagcctgagagccgagacgacgctagtatactacgtgtgcgagagactcctagtctacgttccgtcttttgattcg

SEQ ID NO: 46022 - DNA, 507 bp, Homo sapiens
  misc_feature: GYAE6OF02G5N4E.27.57.F02.1.454.CMB.1.raw
  modified_base (498)..(498): a, c, t, g, unknown or other
  misc_feature (498)..(498): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaaggggctggagttcgtggccaacataaaccaagatgggagtaaagaaaactatgtggactctgtgaagggccattcacatctcagagacaacgcaagaagtcactgtatctgcaaatgaacagcctgagagccgagacacggctagtatactactgtgcgagagatcctagtcattccgtntttgattcg

SEQ ID NO: 46023 - DNA, 559 bp, Homo sapiens
  misc_feature: GYAE6OF02HSCN7.27.57.F02.1.454.CMB.1.raw
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccncagactccgagggagggctggagttcgtggccaanataaaccaagataggaaggtaaagaaaactagtgtaggactcgtgtaggaaggggcctattccgaccatcctaccagaagacaacgaccgaaagaacgtacacttgtatctagacaaatagaacagacctgagagccgaagaccgacggctagtactactacgttaggcgacggaagagtactaccgttagtacctacgtttcccgtacttttcgacttcgg

SEQ ID NO: 46024 - DNA, 534 bp, Homo sapiens
  misc_feature: GYAE6OF02IAVF4.27.57.F02.1.454.CMB.1.raw
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
  modified_base (406)..(406): a, c, t, g, unknown or other
  misc_feature (406)..(406): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggattgagctgggtccnccagactccgagggaagggctggagttcgtggccaanataaaccaagacgtaggaaggtaaagaaaactatgtaggactctgtggaacggcgattcacatcncagagacaacgacaagagtcactgtatctagacaaatcgaaacacgactgaacgacgaccgaagaccacggctagtactactactgtcgacgagacgactccgtagtctattcccgtcttttgattcg

SEQ ID NO: 46025 - DNA, 531 bp, Homo sapiens
  misc_feature: GYAE6OF02IXTKT.27.57.F02.1.454.CMB.1.raw
  modified_base (453)..(453): a, c, t, g, unknown or other
  misc_feature (453)..(453): n is a, c, g, or t
  modified_base (501)..(501): a, c, t, g, unknown or other
  misc_feature (501)..(501): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaggtgtccagtgtgaggtgcaactggtggattctggaggaggtgtggtccagcctggagaatccctgagactctcctgtgcagcctctggattcacctttagtagttattggatgagcgtggggtccgccagactccgaggggaaggggctggagttcgtggccaacataaaccaagatgggaaggtaaaagaaaactatggtaggactctgtgaagggccattcaccatctcagacgacaacgaccaagaacgtcatagtatctagacaaatgaacngcctagacgagccgaaggacacggctagtatactactggtgacgaganactcctagtctacgttccgtctttgattcg

SEQ ID NO: 46026 - DNA, 605 bp, Homo sapiens
  misc_feature: GYAE6OF02JOADH.27.57.F02.1.454.CMB.1.raw
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (457)..(457): a, c, t, g, unknown or other
  misc_feature (457)..(457): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctattttagaagtgtccagtgtgaggtgcaactggtggattctggaggaggtgtggtccagcctggagaatccctgagactctcctgtgcagcctctggattcgacctttagtagttattggatgagctgggtccncagctccgagggagggctggagttcgtggaccaanataaaccaganggaaggtaaanaaactagtagtaggaactctggtagaagggccgtaattccgaactaacgtctaccgaagaacgaccaaacgtccaaaagaacggtactaacgtgttaanacgttagacctaaaagtcgtaaaccaggacccttaggaacgacggaccgtaaggaaccgtacgggactggttaaactacgtaacttcggtgacggtaagaagtactacccgtaaggtcctaattacccggtcttttacggacttccgg

SEQ ID NO: 46027 - DNA, 746 bp, Homo sapiens
  misc_feature: GYAE6OF02FGAPA.27.57.F02.1.454.CMB.1.raw
  modified_base (119)..(119): a, c, t, g, unknown or other
  misc_feature (119)..(119): n is a, c, g, or t
  modified_base (580)..(580): a, c, t, g, unknown or other
  misc_feature (580)..(580): n is a, c, g, or t
  modified_base (688)..(688): a, c, t, g, unknown or other
  misc_feature (688)..(688): n is a, c, g, or t
tcagagcgtcgtctcacgaccggtgctcgatttagctcgatatagttgggtttgaggtctcagagaggagccttagccctggactccaaggccctttccacttggtgatcagcacggancacagacggacccacagtggaacgtgggctgagtcgtttgggtttccttgttgtacttaagtttaggaaggtcgtccgaggttgtaggaggttcgacgtaacgtgggtaggtagttcggtgggaggtacgggttgtccggtccacgtccgtaggacgtacctccgtagacgtccttcgtccgtaggcgcctacgccttcgtacggttacttccgttaacgtttagtagttagtcggtacgtacgccggtcggtccggaccacgtacggtaccgtacgggaaggggtaccggtgtacggttacgttaccggaccgaaacccaaagtaaaccgtaaaccgaggttaacggtaagggaaaacgttaaaacgtaacgtgttacgggtacgtaccttaggtaccgggtacgggtacccgtacttacaacccgcttaacaccgacaaacgaccctacgacaacgtanactcgtacagactagactaatacgcgaacgcgtacgagaccgtacggacggttaacccgttagcgttaactacgttccgagtacgggtaaccgagtaaccggtttacncccgtttaacgcgttacccggtttaccgttacgtttccgtagggtacccccgtagggg

SEQ ID NO: 46028 - DNA, 520 bp, Homo sapiens
  misc_feature: GYAE6OF02HGSKY.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggagggctggagttcgtggccaacataaaccaagatggaaggtaaagaaaactatgtggactctgtgaagggccattcaccatctccagagacacgcaagaagtcactgtatctgacaaatgaacagcctagacgagccgaaggaccgacggctagtatactactgtgcgagagatccgtagtctacttccgtcttttgattccg

SEQ ID NO: 46029 - DNA, 639 bp, Homo sapiens
  misc_feature: GYAE6OF02JODN7.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaagggctggagttcgtggccaacgataaaccgaagagtacggaaggtaaaagaaaactagtaggtacggactcgtgtaggaagggccgattaccaaccgtactactccgaagaacgaaccgaaacgacccaaaggtaaacgtaccaacgttacgtaacttaccgtacgaactaaaacgtacgaaacaagtacccttaggaacgtaacggaccggaaaggaccgaacggtccgtagtaacttacgtacctaggtacggtacgaaggtacgaacgttaccgtacgtacctaacgtttcccgtacgtttttacgacgtttaccgg

SEQ ID NO: 46030 - DNA, 521 bp, Homo sapiens
  misc_feature: GYAE6OF02JA0B0.27.57.F02.1.454.CMB.1.raw
  modified_base (484)..(484): a, c, t, g, unknown or other
  misc_feature (484)..(484): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccaggggaaggggctgggagttcgtggccaacataaacccaagatagggaaggtaaaagaaaactataggtaggactctgtgaagggccgattcaccatctcagagacaacgccaaagagtcactgtatctgacaaatgaacagcctgagagccgaggacacggcagtatactangtgcgagagatcctagtctattccgtcttttgattcg

SEQ ID NO: 46031 - DNA, 522 bp, Homo sapiens
  misc_feature: GYAE6OF02G12MA.27.57.F02.1.454.CMB.1.raw
  modified_base (470)..(470): a, c, t, g, unknown or other
  misc_feature (470)..(470): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagatgggaaggtaaagaaaactatgtaggactctgtgagggccgattcacatctccagacgacaacgccaagaacgtcactgtatctgacaaatgaacagcctgagagccgaggacacggcngtatactactggtgacgaggagatccgtagtcacttccgtcttttgattccg

SEQ ID NO: 46032 - DNA, 721 bp, Homo sapiens
  misc_feature: GYAE6OF02JX4QL.27.57.F02.1.454.CMB.1.raw
  modified_base (314)..(314): a, c, t, g, unknown or other
  misc_feature (314)..(314): n is a, c, g, or t
tcagagcgtcgtctcacgaccggtgctcgatttagctcgatatagttgggtttgaggtctcagagagggagccttagccctggactccaaggcctttccacttggtgatcagcacggagcacagaggacccaccatggaactggggctgagctgggttttccttgttgcttattttagaaggtgtccagtgtgaggtgcaactggtggattcgtggaggaggtgtggtccagcctggagaatccctgagactctcctgtgcagcctcgtggacttcctacctttagtagtttattggatgagtcgtggggtccncgagacctccgaaggggaacggggctgggtaggtttcggtcgggacccaaacgaactaaaaccgaaggaagtaggggaaagtaaaaagtaaaaacttagtaggtacggtacttacgttaggtacgggaaacggggtcccgtaagtttcccgaacccgtattacccgtacccgaaaggaacgaacccaaaaccggtacccgaaaaggtaacgtaccgtaacttacggttaactaccgttacgaaccgtaaaataccggaaaccgtacggacccttagggaacgaacggacccgggaaggtaacccgacggtacttacgtaactacgttacgttcggtaacggacgtaaggtacgtaacgttaccgttaaggtacctacgtttcccggtcgtttttacgacgtttcccg

SEQ ID NO: 46033 - DNA, 535 bp, Homo sapiens
  misc_feature: GYAE6OF02F692S.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtggggtccgccagactccgaggggaagggctgggagttcgtggaccaacataaaccaagataggaaggtaaagaaaactatgtaggactctgtagaagggcgattcacctatctacagagacaacgaccaaagaacgtcaactgtactctagacaaatgaacagcctagagacgccgagacacggctagtactactagtgtgacgagagactccgtagtctagttcctcttttgattcg

SEQ ID NO: 46034 - DNA, 728 bp, Homo sapiens
  misc_feature: GYAE6OF02J1R6T.27.57.F02.1.454.CMB.1.raw
  modified_base (278)..(278): a, c, t, g, unknown or other
  misc_feature (278)..(278): n is a, c, g, or t
  modified_base (327)..(327): a, c, t, g, unknown or other
  misc_feature (327)..(327): n is a, c, g, or t
  modified_base (410)..(410): a, c, t, g, unknown or other
  misc_feature (410)..(410): n is a, c, g, or t
  modified_base (655)..(655): a, c, t, g, unknown or other
  misc_feature (655)..(655): n is a, c, g, or t
tcagagcgtcgtctcacgaccggtgctcgatttagctcgatatagttgggtttgtaggtctcagagaggagccttagccctcggactccaaggcctttccacttggtgatcagcacggagcacagaggacccaccatggaactggggctgagctgggttttccttgttgctatttagaaggtgtccagtgtgaggtgcaacgtggtggattctggaggaggtgtcgggtccagccgtgggagaacgtcccctggagacttcctccctgtgctagcctntggattccaccgtttagttagttacttggagtgacggctcggggtaccnccgagaccgtccgagggaaggggccgtggacggttcgtcgggaccaaacgaataaaccgaacggattagggaagggtaaaaanaaaaccgttagtaggtaggacttcgtaggtagggaacgggtaccgactttacccgaaccgtactaccgtacctaaggaacgaccgaaaaccgccgtaaaacggagttaaccaaccgttggtaactacgttacgaacgtaaacgtacgaaaacgacggtaccgacgggtaagaaccggacccgggaacgggaaccgaccgggtacttgggttaaacttacccttagttacggtcggaaccggtaanaaccgggttaacttaccccggttaggttaaccgtaacgtttcccggttaacgttttttacgtacgtttcccgg

SEQ ID NO: 46035 - DNA, 514 bp, Homo sapiens
  misc_feature: GYAE6OF02J1MYI.27.57.F02.1.454.CMB.1.raw
  modified_base (303)..(303): a, c, t, g, unknown or other
  misc_feature (303)..(303): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (482)..(482): a, c, t, g, unknown or other
  misc_feature (482)..(482): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccagggaaggggctgggagttcgtggccaacataaaccaagactggacggtaaanaaaactntagtggactctgtgaagggccgattcaccatctccagagacaacgccaagaagtcactgtatctgcaaatgaacagcctgagagcgagacacggctagtatactatggtncgagagatcctagtcattccgcttttgattcg

SEQ ID NO: 46036 - DNA, 517 bp, Homo sapiens
  misc_feature: GYAE6OF02GI309.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagatggagtaaagaaaactatgtaggactctgtgaagggccattcaccatctccagagacaacgccaaagaagtcaactgtatctgacaaatgaaacagcctgagagccgaggacacggctgtatactactgtgcgagagactccgtagtcattccgcttttgattccg

SEQ ID NO: 46037 - DNA, 554 bp, Homo sapiens
  misc_feature: GYAE6OF02ICDC5.27.57.F02.1.454.CMB.1.raw
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagctgggtccnccagctccgagggagggctggagttcgtggaccaanataaaccagagtaggaaggtaaaanaaactagtgtacgggactacgtgtaggaacggcgattccacatctaccgagacgaacaacgacaagacgtacaactgtactctagacaaatgaacacgctagagacgacggacgacgacggactagtactacgtatcgtcgacgagacgacgtccgttagtctacgtttccgtattttacgattaccgg

SEQ ID NO: 46038 - DNA, 555 bp, Homo sapiens
  misc_feature: GYAE6OF02FF6ZC.27.57.F02.1.454.CMB.1.raw
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
  modified_base (539)..(539): a, c, t, g, unknown or other
  misc_feature (539)..(539): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtgggtccagccctgggagaatccctgagactctcctgtgcagcctctggattcacctttagtagttattcggatgagctgggtccnccagactccagggaagggctggagttcgtggccaanataaaccagatggaagtaaagaaaactntagtggactcgtgtggaagggccgattccgaccatctccagagaccaaacgccaaagaacgtcacttgtatctgacaaatcgaaacagcctaggacgaaggccgaagggaccacgggcctagtactacgactgtagcgaagagtactccgtagtctacgtttcccgtntttttacgattcccgg

SEQ ID NO: 46039 - DNA, 524 bp, Homo sapiens
  misc_feature: GYAE6OF02H2DZL.27.57.F02.1.454.CMB.1.raw
  modified_base (514)..(514): a, c, t, g, unknown or other
  misc_feature (514)..(514): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatcccctgagactctcctgtgcagcctctggattcacctttagtagttattggatgagcttgggtccgccagactccagggaggggctggagttcgtggccaacgataaaccaagatggaaggtaaagaaaactatgtaggactcgtgtgaagggccattcacatctcagagacaacgcaaagaagtacactgtatctgacaaatagaacagacctgagacgccgaagacgacggctagtatactactgtgacgagagactctagtctacttccgtnttttgattcg

SEQ ID NO: 46040 - DNA, 516 bp, Homo sapiens
  misc_feature: GYAE6OF02FKXAF.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagctccagggaagggctggagttcgtggccaacataaaaccaagatgggaaggtaaaagaaaactatgtggactctgtgaagggccgattcaccatctccagagacaacgccaagaagtcactgtatctgacaaatgaacagcctgagagccgaggacacggctgtatactactgtgcgagagactcctagtctattccgcttttgattcg

SEQ ID NO: 46041 - DNA, 541 bp, Homo sapiens
  misc_feature: GYAE6OF02GAPBS.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccncccagactccgaggggaaggggctgggagttcgtggccaacataaaccaagatagggaagtaaaagaaaactataggtaggactcgtgtaggaagggccattcaccatctcagagacaacgcaagacgtacactgtatctagacaaatgaacactctagagacgaccgagacacggctagtactactacgtgtcgacgagacgtactacctagtctacgttccgtcttttagattccg

SEQ ID NO: 46042 - DNA, 535 bp, Homo sapiens
  misc_feature: GYAE6OF02JN08D.27.57.F02.1.454.CMB.1.raw
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
  modified_base (447)..(447): a, c, t, g, unknown or other
  misc_feature (447)..(447): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgtgctattttagaaggtgtccagtgtgaggtgcaactggtggattctgggaggaggtgtgggtccagcctgggagaatccctgagactctcctgtgcagccctctggattcacctttagtagttattggatgagctgggtccncagactccgagggaagggctgggagttcgtggccaacataaaccaagatagggaagtaaaagaaactntggtagaactctaggngaaacgggcattcacatctcagagacaacgacaagaatcatgtatcagacaaatgaacngacctgagacgcgaggacacggactagtactacgtacgtgtcgacgagaggtactaccgtagtccagttcccgtcgttttagacttcg

SEQ ID NO: 46043 - DNA, 517 bp, Homo sapiens
  misc_feature: GYAE6OF02GVECG.27.57.F02.1.454.CMB.1.raw
  modified_base (363)..(363): a, c, t, g, unknown or other
  misc_feature (363)..(363): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggagggctggagttcgtggccaacataaaccaagataggaaggtaaanaaactatgtggactcgtgtgaagggccattcacatctcagacgacaacgacaagaagtcactgtatctgacaatagaacagacctgagacgccgaggacacggctgtatactactgtgcgagagtactctagtcctattccgtcttttgattcg

SEQ ID NO: 46044 - DNA, 536 bp, Homo sapiens
  misc_feature: GYAE6OF02GGO38.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaagggctggagttcgtggccaacataaaccaagatggaaggtaaagaaaactagtgtaggaactcgtgtaggaagggccgtattccgaccatctccagacgacaacgccaaagaactacactgtactctgacaaatgaacagacctagagacgccgaggacacggactgtactactactggtgcgagagactcgtacgtctattccgtcttttgattccg

SEQ ID NO: 46045 - DNA, 521 bp, Homo sapiens
  misc_feature: GYAE6OF02I81JF.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccagggaaggggctgggagttcgtggccaacataaaccaagatggaaggtaaagaaaactatagtggactctgtgaagggccgattcaccatctaccagagacaacgccaaagaagtcactgtatctgacaaatgaacagcctagagagaccgagacacggctgtatactacgtgtgcgagagactctagtctacttccgtcttttgattccg

SEQ ID NO: 46046 - DNA, 531 bp, Homo sapiens
  misc_feature: GYAE6OF02H9IQ2.27.57.F02.1.454.CMB.1.raw
  modified_base (490)..(490): a, c, t, g, unknown or other
  misc_feature (490)..(490): n is a, c, g, or t
  modified_base (518)..(518): a, c, t, g, unknown or other
  misc_feature (518)..(518): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaaatccctgagactctcctgtgcagcctctggattcactttagtagttaattggatgagctggtccgcagactccagggagggctggagtcgtggccaacataaaccaagatggagtaaaagaaaactatagtggactctgtgaagggccgaatcacatctccagacgacaacgaccaaagaagtcaactgtaatctgactaaaatagaaacagaccttagacgaagccgaaggacacggctgtatactactgngtcgagagatcccgtagtcaattcccgnttttagattaccg

SEQ ID NO: 46047 - DNA, 568 bp, Homo sapiens
  misc_feature: GYAE6OF02F8KPE.27.57.F02.1.454.CMB.1.raw
  modified_base (536)..(536): a, c, t, g, unknown or other
  misc_feature (536)..(536): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagtttattggatgagcgtgggtccgccagactccgaggggaacggggctgggagttcggtggccaacataaaaccaagatagggaaggtaaaagaaaactatggtagggactcgtggtaggaaggggccgtaattccgaaccatccctacccaaggaacgaacaaacgacccaaagaacgtcaacttgtaactctgacaaagtcgaaacagcctaggagacgaccggaggacacggctgtactactactgtgcganagactcgtagtctacgttccgtactttgatcg

SEQ ID NO: 46048 - DNA, 518 bp, Homo sapiens
  misc_feature: GYAE6OF02H5NDN.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctatttttagaaggtgtccagtgtgaggtgcaactggtggattctggaggaggtgtggtccagcctggagaatccctgagactctcctgtgcagcctctggattcacctttagtagttattggattgagctgggtccgccagactccagggaaggggctggagttcgtggccaacataaaccaagatggaggtaaagaaaactatgtggactctgtgaaggccgattcacatctccagagacaacgccaaagaagtcactgtatctgacaaatgaacagcctgagagccgaaggacacggctagtatactactgtgcgagagatcctagtctagttccgtcttttgattccg

SEQ ID NO: 46049 - DNA, 518 bp, Homo sapiens
  misc_feature: GYAE6OF02IB83L.27.57.F02.1.454.CMB.1.raw
  modified_base (448)..(448): a, c, t, g, unknown or other
  misc_feature (448)..(448): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgaggggaagggctgggagttcgtggccaacataaaccaagatggaaggtaaagaaaactatgtaggactcgtgtaggaaggccgtattcaccatctccagagacaacgcaagaagtcactgtatctgacaaatgaanagcctagagagcgagacgacggctgtatactactgtgacgagagatacgtagtcattccgtctttgatcg

SEQ ID NO: 46050 - DNA, 729 bp, Homo sapiens
  misc_feature: GYAE6OF02I2HQ8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaggtgtccagtgtgaggtgcaactggtggattctggaggaggtgtggtccagcctggagaactccctgacgactctcctgtgcagcctctggacttcacctttagtagttattggatgagtcgtgggtccgcgagacctccgaaggggaacggggctgggacgttcggtggaccaaacgaataaaaccgaagtacgtagggaaaggtaaaaagaaaaactagtaggtaggaaccttcgtaggtacggaaacggggtcccgtaattacccgaacccgtaacttcccgtacccgaaaggaacgtaaacccaaaccggaacccaaaaggtaaacgtacccgtaacgttaggttaacttccgttagaacctaaaacgtacggaaaacctacggtacccgttaggaaacggtaccggacccggaaacgggtaacccgaaccgggtacttacggttaacttaccgttaacgttagggtacggaccggtaaggtaacgtaccgttacccgttaaggttacccttaacgtttccccggtacttttttacggactttcccggg

SEQ ID NO: 46051 - DNA, 519 bp, Homo sapiens
  misc_feature: GYAE6OF02F4F0N.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccgccagactccgagggaaggggctggagttcgtggccaacataaaccaagatggaaggtaaagaaaactatgtggactctgtgaagggcccgattcaccatctcagagacaacgaccaagaagtcactgtatctgacaaatgaacagcctgagagccgagacacggctgtatactactgtgcgagagatccgtagtctacttccgtcttttgattcg

SEQ ID NO: 46052 - DNA, 544 bp, Homo sapiens
  misc_feature: GYAE6OF02H8TCZ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagtttattggattgagcttggggtcccgccagacctccgaggggaaggggctgggagttcgtggccaacataaaaccaagatggaaggtaaaagaaaactatggtaggactctgtggaagggccattcacatctccagagacaacgccaaagaagtcactgtatctagacaaatgaacagaccgtagacgacggaccgaaggaccgacggactaggtatactactggtgacgagagactcctagtcattccgtcttttgatccg

SEQ ID NO: 46053 - DNA, 549 bp, Homo sapiens
  misc_feature: GYAE6OF02IXL73.27.57.F02.1.454.CMB.1.raw
  modified_base (341)..(341): a, c, t, g, unknown or other
  misc_feature (341)..(341): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaagggctggagttcgtggccaanataaaaccaagatagggaaggtaaagaaaactataggtaggaactctggtagaaggggccgattccacctatctccaagagacaacgaccaaagaacgtacacttagtatctagacaaatgaacagcctagagacgaccgaaggacacggctagtactactacgtgtggcgagagattaccgtagtctagttccgtcttttgacttcg

SEQ ID NO: 46054 - DNA, 730 bp, Homo sapiens
  misc_feature: GYAE6OF02HEA9Z.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgagggaagggctgggagttcgtggccaaacgataaaccaagatagggaagtaaaagaaaactatggtaggaactcgtaggtaggaaacggggtccgtaatttaccaaccctaattcccttacccgaaggaaacgtaaccaaaaccggacccaaaaggtaaacgttaccgaacttaggttaacttaccgttacggaacctaaaagttacggaaaaccgtaacggtacccgtaggtaacggaacggtacccgggaaacgggaaccgaaccggggtaccgttaaggttaaaccgttaaccgtttaacggttacgggttacggtaacccgggaagggtaacggtaaccgtttacccggttaaggtttacccgtaaaccgttttccccggtttaacgtttttttacggaccttttacccgggg

SEQ ID NO: 46055 - DNA, 517 bp, Homo sapiens
  misc_feature: GYAE6OF02GUVJM.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctggaggaggtgtgggtccagcctggagaatccctgagactctcctgtgcagcctctggattcacctttagtagttattggatgagctgggtccgcagactccagggaaggggctggagttcgtggccaacataaaccaagatggaaggtaaagaaaactatgtggactctgtgaagggccgattccacatctccagagacaacgccaaagaagtcactgtatctgcaaatgaaacagcctagagagccgagacacggctgtatactactgtgcgagagatccgtagtctagttccgcttttgattcg

SEQ ID NO: 46056 - DNA, 521 bp, Homo sapiens
  misc_feature: GYAE6OF02GJEY0.27.57.F02.1.454.CMB.1.raw
  modified_base (333)..(333): a, c, t, g, unknown or other
  misc_feature (333)..(333): n is a, c, g, or t
  modified_base (480)..(480): a, c, t, g, unknown or other
  misc_feature (480)..(480): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagctgggtccgccagactccgagggagggctggagttcgnggccaacataaaccaagatagggaggtaaagaaactagtgtggactctgtagagggcctatcacatctcagagacacgacaagaagtcactgtatctgacaaatgaacagacctagagacgcgaggacacggctgtactactactgngacgagagtactacgtacgtctagttccgtcttttgattcg

SEQ ID NO: 46057 - DNA, 548 bp, Homo sapiens
  misc_feature: GYAE6OF02GDJI1.27.57.F02.1.454.CMB.1.raw
  modified_base (335)..(335): a, c, t, g, unknown or other
  misc_feature (335)..(335): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagactccgaggggaagggctgggagttcgnggccaacataaaaccaagatagggaaggtaaaagaaaactatggtaggactctggtaggaacgggcctattcaccatctaccagacgaacaacgaccaaagaacgtcacttgtatctgacaaatgaaacagcctgagagaccgaggacacggctagtatactacgtgtcggacgagagtactaccgtagtctacgttccgtcttttgattccg

SEQ ID NO: 46058 - DNA, 587 bp, Homo sapiens
  misc_feature: GYAE6OF02HV236.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagctctcctgtgcagcctctggattccacctttagtagttattggatgagcgtgggtcccgccagacctccgaaggggaaggggctggagttcggtggccaacgaactaaaccaagagtagggaaggtaaaagaaaactatagtagggactcgtggtaggaaacgggtccgtaattccaccactacctaccgaaggacgaacaaacgaccaaagaacgtacacgtagtatctagactaaatagaactacgaccgtagagacggaccgaggaacgacggctagtactacgtactggtcggacgagagtactccgtagtactacgtttccgtcttttcgattcg

SEQ ID NO: 46059 - DNA, 732 bp, Homo sapiens
  misc_feature: GYAE6OF02JRSXN.27.57.F02.1.454.CMB.1.raw
  modified_base (182)..(182): a, c, t, g, unknown or other
  misc_feature (182)..(182): n is a, c, g, or t
tcagagcgtcgtctcacgaccggtgctcgatttagctcgatatagttgggtttgaggtctcagagaggagccttagccctggactccaacggcctttccacttggtgatcagcacggagcacagaggacccacatggaactggggctgagctgggttttccttgttgctattttagaaggtntccagtgtgaggtgcaactggtggattctggaggaggtgtggtccagccgtggagaatccctgacgactctcctgtgcagcctcgtggattctactttagtagttattggaactggtagtcgtgggtcccgcctaggacgtcccggaagggggaagggtcctggggtacgttcggtcgggtaccctaacgaacgttaaaacccaaggaacgttaggggaaagggttaaaaaccgtaaaaagtagtgggttacggtaacttcgtaacgggttacgggaaacggggtacccgtaatttacccggaaccgtagttaccctacgaagtaaacgacctaaccgaccgtaaagtacgtcgaacgttagtactacgtagaccaaagtcggaaacgcgtaccgtaggaacgaccggacccggaagggtacccgaacgggtaccttacgggttaacttacccgttacggttacggtcggtaccggtaagtaaaccggtacttaccggttaacgttcccgttaaccgtttccccggttatttttaccggacttacccggg

SEQ ID NO: 46060 - DNA, 519 bp, Homo sapiens
  misc_feature: GYAE6OF02F6E58.27.57.F02.1.454.CMB.1.raw
  modified_base (330)..(330): a, c, t, g, unknown or other
  misc_feature (330)..(330): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccagggagggctggagttcgnggccaacataaaccaagatggaaggtaaagaaaactatgtggactctgtgaagggccattcaccatctcagagacaacgccaaagaagtacactgtatctgacaaatgaacagacctgagagaccgagacacggctagtatactactggtgacgagagtatccgtagtctattccgtcttttgattccg

SEQ ID NO: 46061 - DNA, 541 bp, Homo sapiens
  misc_feature: GYAE6OF02FK0FY.27.57.F02.1.454.CMB.1.raw
  modified_base (338)..(338): a, c, t, g, unknown or other
  misc_feature (338)..(338): n is a, c, g, or t
  modified_base (457)..(457): a, c, t, g, unknown or other
  misc_feature (457)..(457): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagacctccgaggggaaggggctgggagttcggnggccaacataaaccaagatagggaaggtaaagaaaactatggtggactctggtagaagggccgattcaccatctccagacacaacgccaaagagtcacttgtactctgacaaatgaacngacctaggagacgccggaaggaccacggctagtatactacgtggtgcgagagtactcctagtctagtttccgcttttgattccg

SEQ ID NO: 46062 - DNA, 518 bp, Homo sapiens
  misc_feature: GYAE6OF02HJVII.27.57.F02.1.454.CMB.1.raw
  modified_base (436)..(436): a, c, t, g, unknown or other
  misc_feature (436)..(436): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagatggaaggtaaagaaaactatagtggactctgtgaagggccgattcaccatctcagagacaacgccaagaacgtcaactgtatctncaaatcgaacagacctgacgagaccgaggacacggctgtatactactgtgcgagagatcctagtcattccgcttttgattcg

SEQ ID NO: 46063 - DNA, 570 bp, Homo sapiens
  misc_feature: GYAE6OF02JMWHG.27.57.F02.1.454.CMB.1.raw
  modified_base (474)..(474): a, c, t, g, unknown or other
  misc_feature (474)..(474): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagtctgggtccgccagaccttccgaggggaaggggctgggacgttcggtggcccaaacagtaaaccaagatagggaaggtaaagaaaactatagtggactactgtaggaacggcgattcactatctaccagagacaacgccaaagacgtcactgtatctgacaaatgaacacgccgtagganacggacccgaaggaccgacggctaggtactacgtacgtaggtcgacggtagagtaccttacgtagtcgttacttccggtttctttagacttaccgg

SEQ ID NO: 46064 - DNA, 588 bp, Homo sapiens
  misc_feature: GYAE6OF02GUHM8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagactccgagggaagggctgggagttcgtggccaacactaaaccaagagtaggaaggtaaaagaaaactagtagtaggactcgtgtaggaacgggcatcacatctccagacgacaacgaccaaagaacgtcactgtatctgacaaatcgaacacgacctgacgacggaccgaaggaaccgacggacttacggttaacttaccgtacgttagggtcgacggaaggtacggtaacttccgtaacgttccgtaccgtttcccggttactttttacgatttcccgg

SEQ ID NO: 46065 - DNA, 572 bp, Homo sapiens
  misc_feature: GYAE6OF02FE3NW.27.57.F02.1.454.CMB.1.raw
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
  modified_base (458)..(458): a, c, t, g, unknown or other
  misc_feature (458)..(458): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctggaggaggtgtgggtccagcctggagaactccctgagactctcctgtgcagcctntggattcacctttagtagttattggatgagctgggtccncagctccgagggagggctggagttcgnggccaanataaaccagatgggaagtaaagaaaactntagtggactcgtgtaggaacgggccatccaccatcctacaagagaccaaacgccaaagaacgtcactgtacttctagactaaatcgaaacngcctagacgacgacccggaaggaccacgggtcgtagttaactaccgtaacgtggtacggacggtaagagtactaccgtagtacctacgtttccgtacttttaggactttcccgg

SEQ ID NO: 46066 - DNA, 549 bp, Homo sapiens
  misc_feature: GYAE6OF02GDZ35.27.57.F02.1.454.CMB.1.raw
  modified_base (161)..(161): a, c, t, g, unknown or other
  misc_feature (161)..(161): n is a, c, g, or t
  modified_base (171)..(171): a, c, t, g, unknown or other
  misc_feature (171)..(171): n is a, c, g, or t
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (181)..(182): a, c, t, g, unknown or other
  misc_feature (181)..(182): n is a, c, g, or t
  modified_base (184)..(185): a, c, t, g, unknown or other
  misc_feature (184)..(185): n is a, c, g, or t
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcggtgttcgtntagctattanagtntcngtnngnnatgngatcngagngtgtgtcagcctggagaatcctgagactctcctgtgcagcctntggattctacctttagtagttatggatgagctggtccgccagactccgagggagggctggagttcggngcaanacaaacagagtaggaagtaaagaaactagtgtagactcgtgtaggaacggccgtattccactactactcgagacgaacaacgaccgaaagacgtactactagtactcgtacgactaaagtacgaacacgtaccgtagacgacggccggaacggaacgacgacgtagtactactacgtggtcgacggagacgtactacgtacgtacgtaccgtttccgttacgttttacgactccg

SEQ ID NO: 46067 - DNA, 771 bp, Homo sapiens
  misc_feature: GYAE6OF02HG7SQ.27.57.F02.1.454.CMB.1.raw
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
tcagagcgtcgtctcacgaccggtgctcgatttagctcgatatagttgggtttggacggtacgtcaaggagacggagcctttagccctcggacctcccaaagggccctttccacgttggttccgagtcgacgcacggacgcgacagacggaccccaccatggaacctggggctcgaggctgggttttccttggttgctattttagaacggtgtccagtgtgaggtgcgactggtgattcgtggaggaggtgtggtccagcctggagaactccctgagactctcctgtgcagcctctggacttcgacctttagtagttagttggatgancgtcggggtccnccagacctccgaaggggaaggggctgggtacgtttcggtcgggaccaaacgaataaaaccaaggtataggggaaagtaaaaacgaaaactagtcggtagggaaccttcgtaggtaggaaacgggggtccctatttacccgaaccacttccctacccgaaggaacgaaaccgaaaccggaacccgaaaaggtaaacgtaccgtaaccttaggttaaacttccgttacggaacctaaaaagttccggaaaaccgacggtaccccgttaggaaccggaacgggacccggaaacgggaaccgtaaccggtaccgttaacggttacctaaccgtttaacggtacgggttacgaccgggtaaacgtaacggtaaccttacccgttaacggtccttaaaccggtttccccgttacgttttttacgaccgtttcccggg

SEQ ID NO: 46068 - DNA, 694 bp, Homo sapiens
  misc_feature: GYAE6OF02IB461.27.57.F02.1.454.CMB.1.raw
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggacctccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaatccctgagactctcctgtgcagtccttctggattcacctttagtagtttattggatggagcgttggggtcccnccgaagcctccgaggggaaggggctgggagttcgtacggaccaacgaataaaaccaagagtagggaaagtaaaacgaaaactagtaggtacggtactctaggtaggaaacggggccctaagtttcccaaccgtacttaccctacccgtaaaggaaacggaaaccaaaccggacccaaaaggtaacggtacctaaccgttaggttaacttaccgtagaactaaaagtcgtaaacgacgtacccgttaggaacggaaccggtacccgggaagggtaaccgaccgggtacttaggtaacttaaccgttaccgtaggtcggaccggtaagaacggtacttcccgtagtaccctagtttccccgttcgtttttacgacgttcccgg

SEQ ID NO: 46069 - DNA, 508 bp, Homo sapiens
  misc_feature: GYAE6OF02F1MID.27.57.F02.1.454.CMB.1.raw
  modified_base (467)..(467): a, c, t, g, unknown or other
  misc_feature (467)..(467): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccgccagactccagggaaggggctggagttcgtggccaacataaaccaagatggaggtaaagaaaactatgtggactctgtgaagggccattcaccatctcagagacaacgccaagaagtcactgtatctgcaaatgaacagcctgagagcgagacacggctgtanactactgtgcgagagatcctagtcattccgcttttgattcg

SEQ ID NO: 46070 - DNA, 518 bp, Homo sapiens
  misc_feature: GYAE6OF02HCLKM.27.57.F02.1.454.CMB.1.raw
  modified_base (333)..(333): a, c, t, g, unknown or other
  misc_feature (333)..(333): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgnggccaacataaaccaagataggaaggtaaagaaaactatagtggactctgtgaagggccgattcaccatctccagagacaacgccaagaagtcactgtatctgacaaatgaacagcctgagagccgaggacacggctagtatactactgtgcgagagactcctagtcattccgtcttttgattcg

SEQ ID NO: 46071 - DNA, 603 bp, Homo sapiens
  misc_feature: GYAE6OF02IW3F4.27.57.F02.1.454.CMB.1.raw
  modified_base (407)..(407): a, c, t, g, unknown or other
  misc_feature (407)..(407): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattccacctttagtagtttattggatggagtcgtgggtcccgccagacctccgaaggggaaggggctgggtagtttcggcggacccaaagaactaaaaccgaagagtagggaaggtaaaagaaaactagtggtaggactntaggtaggaacggggcctattaccaacctatcctaccaagacgaacacgaccaagacgtcaacttgtatcagacaaatcgaaacacggtcctagacgacgaccggaaggaaccgacggctttagaacttactacgtggtcgacgaggtactacgttcctaacggttctaacgtttcccgtacgttttgaccttcgg

SEQ ID NO: 46072 - DNA, 658 bp, Homo sapiens
  misc_feature: GYAE6OF02F3YDY.27.57.F02.1.454.CMB.1.raw
  modified_base (263)..(263): a, c, t, g, unknown or other
  misc_feature (263)..(263): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctggaggaggtgtggtccagcctggagaatccctgagactctcctgtgcagcctntggattcacctttagtagttattggatgagtcgtggggtcccgccagacctccgagggggaacggggctgggagttcggtggccaaacaataaacccgaagacgtagggaaggtaaaagaaaactagtaggtaggactcgtaggtagaaggggtccgtaattccgaaccatcctaccgaagtaacgaccaaacgcccaaaagaacgtccaacgttgtaacttcgtgactaaaatggaaacctggaccctgggaacgacggtacccggaagggtaaccacgggtccttaaggttaaccttaccgtaacgttagggtacggacggaaacggtacgaactttaccccggtaaggttccttaaaccgtttcccgggttactttttccggaatttcccgg

SEQ ID NO: 46073 - DNA, 566 bp, Homo sapiens
  misc_feature: GYAE6OF02HYPC3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgtgggttttctgttagctattttagaaggtgtccagtgtgaggtgcaactggtggattctgggaggaggtgtgggtccagcctggagaatccctgagactctcctgtgcagcctctggatttcacctttagtagtttattggatgagctgggtccgcagactccgaggggaagggctggagttcgtggaccaacataaaccaagatagggaaaggtaaaagaaaactagtaggtaggactcgtaggtaggaagggccgattcacctatctccagacgacaacgacaaagacgtacactagtatctagacaaatcgaacagccgtagagacgccggagacgacggtctagtactacgtacgtggtcgacgagacgtactccgtagtacctacgtttccggttcttttcgacttccgg

SEQ ID NO: 46074 - DNA, 672 bp, Homo sapiens
  misc_feature: GYAE6OF02H6AN7.27.57.F02.1.454.CMB.1.raw
  modified_base (558)..(558): a, c, t, g, unknown or other
  misc_feature (558)..(558): n is a, c, g, or t
  modified_base (602)..(602): a, c, t, g, unknown or other
  misc_feature (602)..(602): n is a, c, g, or t
  modified_base (610)..(610): a, c, t, g, unknown or other
  misc_feature (610)..(610): n is a, c, g, or t
tcagagcgtcgtctcacgaccggtgctcgatttagctcgatatagttgggtttgaggtctcagagaggagccttagccctggacctccaaggcctttccacttggtgatcagcacggagcacagaggacccacagtggaactgggcttgagctggttttccttgtgctattttagagtgtcagtgtgaggtgcacgtgggtggagttcgtggaggaggtggtggtccagccgtaggagtaactcccgtgagacctctcctgtgccacgtcctcgtggtacttcgacctttagtagtttagtggtagttcgacgtccgttcgggtacccgaccgaaggtaccgttccggaaggggacggggtccgtagggtacggtttcggtggacccgaaacgtaacgttaaaaccgaagagttaggggtaaaggtaaaagtaaaacgttagtacggtaggtactacgtggtaagggaaaccgggtccgtaagttcccaaccgtattcccgaccgaagaacgaactaacccgacgtaaagacgtacacgttagttaactcgaacgtanaaagtacgaacaacgtcgtagaacgcggaccgtaagacgtacgngtagtaanacgtacgtggcgacggagtaacgtagtaccgttgtactccgttacggtcgtttagcgttccg

SEQ ID NO: 46075 - DNA, 508 bp, Homo sapiens
  misc_feature: GYAE6OF02FGL0R.27.57.F02.1.454.CMB.1.raw
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccagggagggctggagttcgtggccaanataaaccagatggagtaaagaaaactntgtggactctgtgaaggccgattcaccatctcagagacaacgccaagagtcactgtatctgcaaatgaacagactagagagccgagacacggctagtatactactgtgcgagagatccgtagtctacttccgtcttttgattcg

SEQ ID NO: 46076 - DNA, 576 bp, Homo sapiens
  misc_feature: GYAE6OF02JESBM.27.57.F02.1.454.CMB.1.raw
  modified_base (292)..(292): a, c, t, g, unknown or other
  misc_feature (292)..(292): n is a, c, g, or t
  modified_base (472)..(472): a, c, t, g, unknown or other
  misc_feature (472)..(472): n is a, c, g, or t
  modified_base (516)..(516): a, c, t, g, unknown or other
  misc_feature (516)..(516): n is a, c, g, or t
  modified_base (565)..(565): a, c, t, g, unknown or other
  misc_feature (565)..(565): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgtgctattttagaggtgtccagtgtgaggtgcaactggtggattctggaggaggtgtggtccagcctggagaatcccctgagactctcctgtgcagcctctggattcacctttagtgttattggatgagntgggtccgccagactccagggaaggggctggagtttcgtgggccaacataaaacccgaagattggggaaggtaaacgaaaaacgttatagggtcggtaactcctaggttaggaaggggtcccgaatttcgacccaatccgtccaaggtagaacgaacgacaaagacgtcactggtattcngaccaaatcgaatacgccgtagaagtacggccgaggacaccggnttagtacgtactacgtggtcgacgagagacttctaggtccattcccgtntttgattcccg

SEQ ID NO: 46077 - DNA, 673 bp, Homo sapiens
  misc_feature: GYAE6OF02I2CC1.27.57.F02.1.454.CMB.1.raw
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaacgtggtggattctggaggaggtgtggtccagcctggagaatcccgtgagactctcctgtgcagccctctggtattccacctttagtagtttattgggattggagcttggggtccnccagactccggaggggaagggctagggagttcgtgggaccaaacgataaaacccgaagagttacggggaaggtaaaaagaaaactagttaggtacggaacttcgtaggtacggaacggggtccgtaattaccgaacctaagttcccgttaccgaagtaacgaactaaaccgaccaaaaggtaacggttacaaccttggttaactcgttacgactaaaagtacgaaacacggtacctgaacggacgaccggtaacggacgaaccggacgtagtaactacgttacgtcgacggtacgggaagtaacggacttaacccgtagttacgtaccgtttaccggttacctttttaggacctttccgg

SEQ ID NO: 46078 - DNA, 551 bp, Homo sapiens
  misc_feature: GYAE6OF02G2MI5.27.57.F02.1.454.CMB.1.raw
  modified_base (264)..(264): a, c, t, g, unknown or other
  misc_feature (264)..(264): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctntggattcacctttagtagtttattggatgagctgggtccgccagactccgaggggaaggggctgggagttcgtggccaacataaaccaagatagggaaggtaaaagaaaactatagtggaactctggtgaagggccattcaccatctccagacgacaacgccaaagaacgtcactgtatctgacaaatgaacacgacctagagacgccggaggacacggctagtatactacgtgtggacgaggaagacgttacctaggtacctattcccgtacttttcgacttccgg

SEQ ID NO: 46079 - DNA, 578 bp, Homo sapiens
  misc_feature: GYAE6OF02GR92V.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccaggggaaggggctgggagttcgtggccaacagtaaaaccaagagtagggaaggtaaaagaaaaacgtataggtaggacttcgtggtaggaaaggggcccgtaagtttccgaaccctattcctaccaagtaacgaaccaaacgacccaaagaacgtcaacttgtactctagacaaatcgaacagaccctagagacgccgaaggacacggctagatactaacgtggagcgaaggagatacctagtctacgttcgtactttgattccgg

SEQ ID NO: 46080 - DNA, 516 bp, Homo sapiens
  misc_feature: GYAE6OF02FKUNH.27.57.F02.1.454.CMB.1.raw
  modified_base (335)..(335): a, c, t, g, unknown or other
  misc_feature (335)..(335): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccgccagactccagggaaggggctgggagttcgnggccaacataaaccaagatggaggtaaagaaaactatagtggactctgtgaagggccgattcaccatctccagagacaacgccaagaagtcactgtatctgacaaatgaaacagcctgagagccgaggacacggctgtatactatgtgcgagagactcctagtcattccgcttttgattcg

SEQ ID NO: 46081 - DNA, 522 bp, Homo sapiens
  misc_feature: GYAE6OF02FT7BV.27.57.F02.1.454.CMB.1.raw
  modified_base (517)..(517): a, c, t, g, unknown or other
  misc_feature (517)..(517): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaaggggctgggagttcgtggccaacataaaccaagatggaaggtaaagaaaactatgtggactctgtgaagggccattcaccatctccagagacaacgaccaagaagtcactgtatctgacaaatgaacagacctagagagccgaggacacggctgtatactactgtgcgagagatccgtagtctattccgtcttttgnttccg

SEQ ID NO: 46082 - DNA, 594 bp, Homo sapiens
  misc_feature: GYAE6OF02ITDZ5.27.57.F02.1.454.CMB.1.raw
  modified_base (311)..(311): a, c, t, g, unknown or other
  misc_feature (311)..(311): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (464)..(464): a, c, t, g, unknown or other
  misc_feature (464)..(464): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtgggaggaggtgtgggtccaggcctggagaatccctgagacctctcctgtgcagcctctggattcacctttagtagttattgggatggagctggggtccnccagactccgaggggagggctggagttcgnggccaanataaaccaagataggaagtaaaagaaaactntaggtagaactntaggtaggaaagggtccgaattcactatctaccgagacgacaaaccgccaaagaacgtcaatagtacttcganaacaaatgaaacagcccgtagaagtacggaccggtaagaccgacggtcctagttaactacgttaactggtcggaacgagtaacgacgttacctaagttcctaacgtttcccgtatttttggacttcccgg

SEQ ID NO: 46083 - DNA, 748 bp, Homo sapiens
  misc_feature: GYAE6OF02I3A1I.27.57.F02.1.454.CMB.1.raw
  modified_base (331)..(331): a, c, t, g, unknown or other
  misc_feature (331)..(331): n is a, c, g, or t
tcagagcgtcgtctcacgaccggtgctcgatttagctcgatataggttgggtttgaggtctcagagaggagccttagccctggactccaaggcctttccacttggtgatcagcacggtagccacagaggacccacgatggaactcgggctgaggccttgggttttcctgttgctaagttttagaggtgtccagtcgtgagtgcaacgtggttggattcgtggaggtggtgtggtccagcctggagatccctgacgactctcctgtcgcgacgtcctcgtacggaacttcgacctttagtagttagttggattggaagtcgttgggttcccnccgaacggtacgttccgaagggtaacgggtcctacgggaacgttcgtacggacccgaaaccgtactaaaaccgaaggaacgttcgggaaaagggtaaaaacgaaaaaccgttagtaaggttacggtaaccttcgttaggttaaggtaaacggggtcccgtaatttacccgaaccgtacgttaccgtaccgaacggtaacggtaacccgtaaaccggtacccttaaaggtaaaccgttaccgaaccgttaacggttaaaccttaacgttacgtaaccgtaaagttacgaaaccgtacgtacccgttagaacgtacgacccggaagaccgtacgtacgtacgtacttacgtacgtacgtcgaccgaggaaccgtacgtccgttacgtccgtacgttcccggtcgtttcgacgttaccgg

SEQ ID NO: 46084 - DNA, 574 bp, Homo sapiens
  misc_feature: GYAE6OF02GGBMU.27.57.F02.1.454.CMB.1.raw
  modified_base (342)..(342): a, c, t, g, unknown or other
  misc_feature (342)..(342): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaagggctggagttcgtggccaaanaactaaaccaagatagggaaggtaaaagaaaactatggtaggactctaggtggaagggccgattcacatctcagagacaacgcaaagaactacactagtatctagacaaatgaactagacctagaagaggaccgaaggaccgacggctagtaacttactaacgtggtacgacggtaaggacgtaacgttaccgttagtcctaacgtttcccgtacgtttttcgacttaccgg

SEQ ID NO: 46085 - DNA, 580 bp, Homo sapiens
  misc_feature: GYAE6OF02G56K8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaagggctggagttcgtggccaacataaaccaagactagggaaggtaaagaaaactagtggtaggactcgtgtaggaacgggccgtattccaacctaatccctaccgaaggtaacgaaccaaaccgaccaaaaggaacgtccaacttagtactcgtagactaaatcgaaacacgcctagacgacgaccggaagaccgacggctagtactactactggtcgacgagacgacttacctagtcctactttccgtattttgattccgg

SEQ ID NO: 46086 - DNA, 660 bp, Homo sapiens
  misc_feature: GYAE6OF02HBK7T.27.57.F02.1.454.CMB.1.raw
  modified_base (641)..(641): a, c, t, g, unknown or other
  misc_feature (641)..(641): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggtattcacctttagtagttattggatgagcgtgggtccgccagacctccgaggggaacgggctgggagttcgtggaccaacataaaccaagagtagggaaggtaaaagaaaacttagtaggtacggtaactcgttacggtaggaaacggggtccgtaagttccaaccctatcctaccgaaggaacgtaaccgaaaccgaccaaaaggtaaacgtcctaacgttagttactctaggaacctaaaagtacgaaacacggacccgttaggaacggacggacccggaaggaaccgaccggtacttagtaacttaccgttacgtggtacgacggtaaggtaacgtaccttacccgtaagttacctacgttttacccggtntttttacggactttcccgg

SEQ ID NO: 46087 - DNA, 599 bp, Homo sapiens
  misc_feature: GYAE6OF02IKEQ4.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctattttagaaggtgtccagtgtgaggtgcaactggtggattctggaggagtgtggtccagcctggagaatccctgagacctctcctgtgcagcctcgtggatttcacctttagtacgttattggatgagctggggtccgcagctccgaaggggtaacggggctagggtacgttcggtggacccaacaagttaaacccaagacgtagggaaaggtaaaacgaaaactgtaggtaggtaacgtctggtagaacgggcctagttccaccgatcctaccagactacaaccgcaagaacgtcacgttgtatctgactaaactgaacagacctagacgacgccgaaggaccgacggacgttacgtaagttactagttcggtagtacgacgaacgtactaccgtaagtcctacgtttccgctttttacggatttcccggg

SEQ ID NO: 46088 - DNA, 571 bp, Homo sapiens
  misc_feature: GYAE6OF02I30XV.27.57.F02.1.454.CMB.1.raw
  modified_base (560)..(560): a, c, t, g, unknown or other
  misc_feature (560)..(560): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagactccgaggggaagggctgggagttcgtggccaacagtaaaccaagatgggaaggtaaaagaaaactagtagtaggactcgtgtaggaaaggggtccgaatttccaaccactcctccgaagtacggaaccaaacgcccaaaggaacgttcaacttgtattctagaactaaatcgaaacagcctagacgagaccggaagacacggctagtatactagtgtgaccgaggaacagtaccgtagtcagttcccgtntttagacttcg

SEQ ID NO: 46089 - DNA, 678 bp, Homo sapiens
  misc_feature: GYAE6OF02IT59T.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgtgctatttagagtgtcagtgtgaggtgcaactggtggattcgtgggaggaggtgtggtccaggcctggagaatccctgagactctcctgtgcagcctcgtgattcacctttagtagttattggatgagtcgttgggtccnccgagtacctcgaaggggagggtcttagggacggtttcggacggtaccaaacgtaacgtaaaaccgaagtacggtaacgggtaaacggtaaaaagaaaactttagtggtacggaacttcgtaggtaagggaaaccgggtccgtaacttaccgaaccgtatacccgtaccgaaaggacgtaaccgtaaaccggacctaaaaggaacgtaccgtaacgttagttaactacttacggaaactaaagtacgtaaaccgacgtacccgtagaaccggaaccgaccggtaaagaccgacggtacgtagttactacgttacgtcggtaggaccgtaggtaactctacgtttacgacttaccgttcggtactttgacttccgg

SEQ ID NO: 46090 - DNA, 515 bp, Homo sapiens
  misc_feature: GYAE6OF02G15UH.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaagggctggagttcgtggccaacataaaccaagatggaaggtaaagaaaactatgtggactctgtgaagggccattcacatctcagagacaacgccaagaacgtcactgtatctgacaaatgaacagcctgagagccgagacacggctagtatactactgtgacgagagactcctagtctattccgtcttttgattcg

SEQ ID NO: 46091 - DNA, 515 bp, Homo sapiens
  misc_feature: GYAE6OF02GK7PM.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagatggaggtaaagaaaactatgtggactctgtgaagggccgatcaccatctccagagacaacgccaagaagtcactgtatctgacaaatgaacagcctgagagccgagacacggctagtatactactgtgcgagagatcctagtctacttccgtcttttagattcg

SEQ ID NO: 46092 - DNA, 573 bp, Homo sapiens
  misc_feature: GYAE6OF02H72J9.27.57.F02.1.454.CMB.1.raw
  modified_base (303)..(303): a, c, t, g, unknown or other
  misc_feature (303)..(303): n is a, c, g, or t
  modified_base (529)..(529): a, c, t, g, unknown or other
  misc_feature (529)..(529): n is a, c, g, or t
  modified_base (561)..(561): a, c, t, g, unknown or other
  misc_feature (561)..(561): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgagggaaggggctagggagttcggtggaccaacaactaaaaccaagacgttagggaaggtaaaagaaaactagtaggtacggactactggtaggaacggggccgtaattacaaccgatcctaccgtagaacgaacaacgaccaagaagtcactagtactctagacaaatagaaacacgacctagagacgaccgaggacgacggctagtatactatgngacgagacgtactaccgtatacgtattccgtnttttcgattccg

SEQ ID NO: 46093 - DNA, 672 bp, Homo sapiens
  misc_feature: GYAE6OF02FYOAJ.27.57.F02.1.454.CMB.1.raw
  modified_base (268)..(268): a, c, t, g, unknown or other
  misc_feature (268)..(268): n is a, c, g, or t
  modified_base (345)..(345): a, c, t, g, unknown or other
  misc_feature (345)..(345): n is a, c, g, or t
  modified_base (383)..(383): a, c, t, g, unknown or other
  misc_feature (383)..(383): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcggtggtttcgtgtaggcgtactttagaaggtgtcagtgtgaggtgcaatggtggattctggaggaggtgtgggtccagccgtggagaatccctgagactctccgtgtcgcagccctntggattcacctttagtagtttattggattgagtcgtgggtccgcgagctaccgaggggaagggctgggatttccggnggaccaacgataaaaccaagtatagggaaggttaaaanaaaaacgttgtaggttaggaacttcgtagtaggaaacgggtccgtaacttaccacctaataccttcccgaaggacaaccgaaaccggacccaaaggtaacgtacctaacgtagttacctagttcgaactaaagtaacgtaacgtaacgaccgtacgtaacggaacgaaccggaacggaaccgacgtaccgtagttaacgtacgttacgtacggtacggtaccggaaggtaacgtacgttaccgtacgttaccgttaccgttaccggtttcctttacgttacgttaccgg

SEQ ID NO: 46094 - DNA, 546 bp, Homo sapiens
  misc_feature: GYAE6OF02HB1J7.27.57.F02.1.454.CMB.1.raw
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgaggggaaggggctgggagttcgnggccaacataaaccaagatgggaaggtaaaagaaaactataggtaggactcgtgtaggaagggccgtattccaccatcctaccagacgacaacgaccaaagaacgtcacgtgtatctgacaaatcgaaacagcctagagacgccgaaggacacggctagtactactacgtggtgcgaagagactctagtcacgtttccattttgattccg

SEQ ID NO: 46095 - DNA, 522 bp, Homo sapiens
  misc_feature: GYAE6OF02HI3XR.27.57.F02.1.454.CMB.1.raw
  modified_base (337)..(337): a, c, t, g, unknown or other
  misc_feature (337)..(337): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggagggtgtggtccagcctggagaatccctgagactctcctgtgcagcctctggattcacctttagtagttattggatgagctggggtccgccagactccaggggaaggggctgggagttcgnggccaacataaaccaagatggaaggtaaagaaaactatgtggactctgtagaagggccgattcaccatctccagagacaacgccaagaagtcactgtatctgacaaatgaacagcctagagagccgaggacacggctgtatactactgtgcgagagactcgtagtcattccgtcttttgattccg

SEQ ID NO: 46096 - DNA, 626 bp, Homo sapiens
  misc_feature: GYAE6OF02JYIC8.27.57.F02.1.454.CMB.1.raw
  modified_base (348)..(348): a, c, t, g, unknown or other
  misc_feature (348)..(348): n is a, c, g, or t
  modified_base (382)..(382): a, c, t, g, unknown or other
  misc_feature (382)..(382): n is a, c, g, or t
  modified_base (413)..(413): a, c, t, g, unknown or other
  misc_feature (413)..(413): n is a, c, g, or t
tcagagcgtcgtctcacgaccggtgctcgatttagctcgatatagttgggtttgtaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtgattctggaggaggtgtggtccagcctggagaatccctgagactctcctgtgcagcctctggacttcacctttagtagttattggatgagtcgtgggtccgccagactccgaaggggaaggggctggagttcggtggaccaanactaaaccagagtagggaagtaaagaaaactagngtaggactctaggtaggagggccagttcacntactccagaacgacaacgaccgaaagactacacttagtactactacgaactaaagtaccgaaacgtaacggcccttaggaacgtcggaaccggtaaggacccgacggtacttaggtaacttaccgtacgttacggtggaaccggagaacggtaacttacccggttaagttaccaacgttttacccggttactttttaacgggctttacccggg

SEQ ID NO: 46097 - DNA, 538 bp, Homo sapiens
  misc_feature: GYAE6OF02G4O0E.27.57.F02.1.454.CMB.1.raw
  modified_base (417)..(417): a, c, t, g, unknown or other
  misc_feature (417)..(417): n is a, c, g, or t
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
  modified_base (497)..(497): a, c, t, g, unknown or other
  misc_feature (497)..(497): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagccctctggattcacctttagtagttattggatgagtcgtggggtccgccagactccgaggggaagggctggagttcgtggccaacataaaccaagataggaaggtaaaagaaactagtaggtggactctgtaggaaggccgtatcacatcctcaganacaacgcaagancactgtactntgacaaatgaacacgaccgtgacgacggcgaagaccgacgatgtatactacgtggtcngagagtcgtaccttagtctacgttccgtcttttagcttcgg

SEQ ID NO: 46098 - DNA, 543 bp, Homo sapiens
  misc_feature: GYAE6OF02IUGVR.27.57.F02.1.454.CMB.1.raw
  modified_base (340)..(340): a, c, t, g, unknown or other
  misc_feature (340)..(340): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgcagactccgaggggagggctggagttcgtggccaanataaaccaagataggaagtaaagaaaactatgtaggactcgtagtggaagggcctaattcacctatcctaccagacgacaacgccaaagagtacacgttgtatctagacaaatgaacagacctagagagccgaaggacacggctagtatactaacgtggtcgacgaagagtactccgtagtctattccgtcttttgacttccg

SEQ ID NO: 46099 - DNA, 587 bp, Homo sapiens
  misc_feature: GYAE6OF02IGW29.27.57.F02.1.454.CMB.1.raw
  modified_base (337)..(337): a, c, t, g, unknown or other
  misc_feature (337)..(337): n is a, c, g, or t
  modified_base (518)..(518): a, c, t, g, unknown or other
  misc_feature (518)..(518): n is a, c, g, or t
  modified_base (574)..(574): a, c, t, g, unknown or other
  misc_feature (574)..(574): n is a, c, g, or t
tcagagcgtcgtctcacgaccggtgctcgatttagctcgatatagttgggtttgaggtctcagagaggagccgttagccctggactccaaggcctttccacttggtgatcagcacggagcacagaggacccaaccatggaactgggctgagctgggtttcctgttgctatttagaagtgtcagtgtgaggtgcaactggtggattgtggaggaggtgtggtcagcctggagaatcctgagctctcctgtcgcacgctctggattcctacctttagtagttattggatgagcgtggtcccgccagacctccagggaagggctggagttcgtggccaanagtaaaccagactaggaaggtaaagaaaactagttgacggactctaggtagaacgggtacgattcacctataccgcctaagagacctaaacgcccgtaaaaggaacgttcacgttatactcgttacggaataaaacgtcggaaacagccgtagacgaacgtccggaagaccgagtccgtanatacgttacaggtcggacgtagacgtaatccgttaacggctctttaccccggtttntttacgtgtaccg

SEQ ID NO: 46100 - DNA, 533 bp, Homo sapiens
  misc_feature: GYAE6OF02G9C33.27.57.F02.1.454.CMB.1.raw
  modified_base (331)..(331): a, c, t, g, unknown or other
  misc_feature (331)..(331): n is a, c, g, or t
  modified_base (451)..(451): a, c, t, g, unknown or other
  misc_feature (451)..(451): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgagggagggctggagttcgnggccaacataaaccaagatggaaggtaaagaaaactatgtaggactcgtgtaggaagggccgtattcaccatctaccagagacaacgccaaaggaactcactgtatctgacaaatgaacngacctagagacgcgaggaccacggctgtatactactggtcgacgagagtactcgtagtctacgttccgtcttttgattccgg

SEQ ID NO: 46101 - DNA, 531 bp, Homo sapiens
  misc_feature: GYAE6OF02GTSCE.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagacctccgagggaaggggctgggagttcgtggccaacataaaccaagatagggaaggtaaaagaaaactatggtggactcgtgtgaagggccgattccaccatctcagagacaacgacaagaacgtacactgtatctgacaaatagaacagacctagagagacgaggacacggctagtatactactgtgcgagagatccgtagtcacgttcctcttttagattcg

SEQ ID NO: 46102 - DNA, 570 bp, Homo sapiens
  misc_feature: GYAE6OF02HKDAN.27.57.F02.1.454.CMB.1.raw
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (460)..(460): a, c, t, g, unknown or other
  misc_feature (460)..(460): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttatggatgagctgggtccncagacctccgaggggagggctggagttcgtggccaanactaaaccaagatagggaaggtaaaagaaacttatggtaggactcgtggtaggaaggggccattcaccatctaccagacgacaacgacaaagagtcaacgtgtatctagacaaatgaaacncgacctagagacgaccgacggaacacggcctagttactacgtacgtggtacggacgaaggacgtacgttaccgtaggttacctacgtttcccgtctttttagacttccgg

SEQ ID NO: 46103 - DNA, 555 bp, Homo sapiens
  misc_feature: GYAE6OF02IFD52.27.57.F02.1.454.CMB.1.raw
  modified_base (304)..(304): a, c, t, g, unknown or other
  misc_feature (304)..(304): n is a, c, g, or t
  modified_base (542)..(542): a, c, t, g, unknown or other
  misc_feature (542)..(542): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctagagactctcctgtgcagcctctggattcacctttagtagttattggatgagctgggtccnccagacctccgagggagggctggagttcgtggccaacataaaccaagatgggaaggtaaaagaaaactatggtaggactctggtggaagggcctaattccacctatcctaccagacgacaacgaccaaagaacgtacacttagtactctagacaaatgaacacgacctagacgagaccgaaggacgacggctagtatactacgtggtcgacgagagactcctagtactacgttccgtnttttcgattccgg

SEQ ID NO: 46104 - DNA, 523 bp, Homo sapiens
  misc_feature: GYAE6OF02HNK6K.27.57.F02.1.454.CMB.1.raw
  modified_base (304)..(304): a, c, t, g, unknown or other
  misc_feature (304)..(304): n is a, c, g, or t
  modified_base (476)..(476): a, c, t, g, unknown or other
  misc_feature (476)..(476): n is a, c, g, or t
  modified_base (512)..(512): a, c, t, g, unknown or other
  misc_feature (512)..(512): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatcccctgagactctcctgtgcagcctctggattcacctttagtagttattggatgagctgggtccncagctccagggaagggctggagttcgtggccaacataaaccaagatggaagtaaagaaaactatgtaggactcgtgtagaagggccattccaccatctccagagacaacgccaaagaatcacttgtatctgcaaatgaaacagcctaggagagccgaggacacggctagtanactagtgtgcgagagactccgtagtctatttcccgnttttagattcg

SEQ ID NO: 46105 - DNA, 533 bp, Homo sapiens
  misc_feature: GYAE6OF02FO15K.27.57.F02.1.454.CMB.1.raw
  modified_base (448)..(448): a, c, t, g, unknown or other
  misc_feature (448)..(448): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgagggaaggggctggagttcgtggccaacataaaccaagatggaaggtaaagaaaactatagtggaactctgtgaagggccgattcaccatctccagacgacaacgccaagaacgtcactgatctgacaaatgaacngctgagagccgaggacacggctgtaatactacgtgtgaccgaagagtataccgtagtcctacgtttcccgtctttttcgattccg

SEQ ID NO: 46106 - DNA, 576 bp, Homo sapiens
  misc_feature: GYAE6OF02HJMVW.27.57.F02.1.454.CMB.1.raw
  modified_base (470)..(470): a, c, t, g, unknown or other
  misc_feature (470)..(470): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagctgggtccgcagactccgaggggaagggctggagttcgtggccaacataaaccaagatagggaagtaaagaaaactatagtggactcgtggtagaaggggcctattccaacctatcctccgaagacgaacaacgaccaaaggaactccaattgtaactctcgacaaatcgaaacngacctgaagacgccggaaggacgacggcttagtaactacgtactggtagaccggaagagacttaccgttaggtccttaagttcccgttactttttagactttccgg

SEQ ID NO: 46107 - DNA, 620 bp, Homo sapiens
  misc_feature: GYAE6OF02F04S3.27.57.F02.1.454.CMB.1.raw
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtgcagcctctggattcacctttagtagttattggatgagtctgggtccncagactccgaggggaaggggctgggagttcgtggccaanataaaccagatggaagtaaagaaaactatgtaggactcgtgtagaagggccattccacctatctaccagacgacaaccgccaaagaagtacacttagtattcgtaggacaaatacgaaactacgcccgttaggacggaacggaccggaagggaccaaaccgggtcgttaaggtaacttacctaacggttggttacggaccggtaaggtaacgtaacgttaccccgttaaggttaccctaacgttttaccccggtacttttttaggactttacccgg

SEQ ID NO: 46108 - DNA, 594 bp, Homo sapiens
  misc_feature: GYAE6OF02IACO6.27.57.F02.1.454.CMB.1.raw
  modified_base (342)..(342): a, c, t, g, unknown or other
  misc_feature (342)..(342): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaagggctgggagttcgtggaccaanaataaaccaagatagggaaggtaaaagaaaactataggtaggactacgtggtagagggaccgtattaccaaccgactcctacccgaagaacgaacgaaaccgaccaaaaggaacgtacaacttgtattcgtagtacaaatcgaaacacgtcctgaagacggccgaaggaccacggcgtagtatacctactggtagacggtagaacggtactccgttagtaccactttcccggtactttttacggatttccgg

SEQ ID NO: 46109 - DNA, 527 bp, Homo sapiens
  misc_feature: GYAE6OF02HQ4SX.27.57.F02.1.454.CMB.1.raw
  modified_base (344)..(344): a, c, t, g, unknown or other
  misc_feature (344)..(344): n is a, c, g, or t
  modified_base (439)..(439): a, c, t, g, unknown or other
  misc_feature (439)..(439): n is a, c, g, or t
  modified_base (495)..(495): a, c, t, g, unknown or other
  misc_feature (495)..(495): n is a, c, g, or t
  modified_base (523)..(523): a, c, t, g, unknown or other
  misc_feature (523)..(523): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagctgggtccgccaggactccgaggggaggggctgggagttcgtggccaanataaaccaagatggaaggtaaaagaaactatgtggactctgtagaagggccattcaccatctaccagagacaacgccaaagaatcactgtatctncaaatgaaacagcctgagagcgaggacacggctagtatacgtactggtgacgaganacgtcctagtcatttccggtcttttagntccg

SEQ ID NO: 46110 - DNA, 580 bp, Homo sapiens
  misc_feature: GYAE6OF02HV1QW.27.57.F02.1.454.CMB.1.raw
tcagagcgtcgtctcacgaccggtgctcgatttagctcgatatagttgggtttggggaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggagggctggagttgtggccaacataaaccaagataggaagtaaagaaaactatgtggactctgtagagggccattcacatctcagagacaacgacaagaagtcaactgtatctagacaaatgaacagacctaggaagacgccggaacggaaccgacggactacggtacttacctacgtaggtcggaccggaggaacgtaacgttacccgttaacggttccttaacgtttcccggttacttttttcggaacgttttacccgg

SEQ ID NO: 46111 - DNA, 534 bp, Homo sapiens
  misc_feature: GYAE6OF02IDV1R.27.57.F02.1.454.CMB.1.raw
  modified_base (339)..(339): a, c, t, g, unknown or other
  misc_feature (339)..(339): n is a, c, g, or t
  modified_base (522)..(522): a, c, t, g, unknown or other
  misc_feature (522)..(522): n is a, c, g, or t
  modified_base (529)..(529): a, c, t, g, unknown or other
  misc_feature (529)..(529): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagctgggtccgccagactccagggagggctggagttcgtggccaanataaaccagataggaaggtaaagaaaactataggtaggactctgtggaagggccgtattcaacatcctaccagagacaacgccaaagaagtcaattgtatctagactaaatgaacagcctagagacgccgaaggaccacggctagtatactactgtgacgagagatccgtagtctattccgtnttttcgnttccg

SEQ ID NO: 46112 - DNA, 704 bp, Homo sapiens
  misc_feature: GYAE6OF02IBKUR.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctggaggaggtgtggtccagcctggagaatccctgagactctcctgtgcagcctctggattcacctttagtagttattggatgagctgggtccgccagactccgagggagggctggagttcgtggccaagataaaccaagatagggaaggtaaaagaaaactatggtacggactactggtacggaaggggccgtatttaccgaacctagtccttacccgaaggtaacgaacgaaacccggtacccgaaaacggtaaacggttaacctaaccgttaggttaaacttccgttacggtaacctaaaaacgttacggaaaacgtaacgtaccccgttaggaacggaacggacccggaaagggaacccgaacgggacctttaaggttaacttaaccgttaaccgttagggttacggaccggtaacggaaggtaaccgttacccgttaaggttaccctaacgtttttaccccggtacgtttttttacggactttacccggg

SEQ ID NO: 46113 - DNA, 620 bp, Homo sapiens
  misc_feature: GYAE6OF02FXWE3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaaggtgtccagtgtgaggtgcaactggtggattctggaggaggtgtggtccagcctggagaatccctgagactctcctgtgcagcctctggtattctacctttagtagttattggatgagcgtgggtccgccagacctccgaggggaaggggtctgggtagttcggtggaccaactataaaacccaagactagggaaaggtaaagaaaacttgtggtacgggacttcgtaggtaggaacgggtccgaatttccgaaccacgtcctccaagacgaacaacgaccaaagaacgtcaacttgtagtctcgactaaataggaactacgaccgtgagtacggccggtaaggaacgacggctagtaactacgttacgtaggttcgacggtaacggagtaacgttacccgttagttaccgtaccgtttcccggtctttttacggacgtttccgg

SEQ ID NO: 46114 - DNA, 617 bp, Homo sapiens
  misc_feature: GYAE6OF02H1X0J.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagacctccgagggacggggctggagttcgtggccaacaataaaccaagagtagggaaggtaaaagaaaactagtggtaggactcgtaggtaggaacgggccgtaattccaacctatcctaccgaagaacgacaaacggaccaaaggtaacgtaccaacttggtaactccgtagaacctaaagtacgaaacagaccctaggaacgacggacccggaaggaccgacggtctagtactaccgttacgtggtcgacggtaggaagtaccgttaccgtagttccaaccgtttccggtactttttggaactttccgg

SEQ ID NO: 46115 - DNA, 764 bp, Homo sapiens
  misc_feature: GYAE6OF02JYXEZ.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttcctgtgctatttggagtgtccagtgtgaggtgcaactggtggattctggaggaggtgtggtccaggccgtggagaatccctgagactctcctgtgcacgcctcgtggacttcacgtttagtagttattggatgagtcgtgggtcccncagacctccggaaggggaaggggtcctggggacgttcggtcgggacccaaacgtaactaaaacccgagtagtaggggtaaaggtaaaacgaaaacgttagtaggtacgggaacttcgtagggtaacggaacggggtcccgtaatttaccccgacctaacgttacctacccgtaagggaacgaaaccgtaaaccgggacctaaaacgggtaacggttaccaaccgttaggttaacgttaccttagggaaacttaaaacgtacgggaaaacctacgggtaacccttaggggaaaggtaccggaaccccgggtaaagggaaccggttaacccgggacgttttaacggtaaccttacgttaaccgttaggggtaccggtaacgggaaagtaaccgggtactttaaccccggttaggttaaccttaacccgttttcccggttacgttttttacgacgtttcccgg

SEQ ID NO: 46116 - DNA, 894 bp, Homo sapiens
  misc_feature: GYAE6OF02H0Z9N.27.57.F02.1.454.CMB.1.raw
  modified_base (177)..(177): a, c, t, g, unknown or other
  misc_feature (177)..(177): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggactggggctgagcggtggtttcgtgtaggctattagaggtntcagtgtgagtgcatggtgattcgtgggaggaggttgtggtaccagccgtaggagaacttcccgtagagtaccttctccgttggcgaccacggtccctgtaggtactttacctaccgttttaaggttagtttaagttggtaagtcggagtccggttcggggtcccgaccgacggtaccgtaccgggaagggggaacggggtcgtagggtacgttcgggtacgggaacctaaaacgtaaacgtaaaaaccgaaaggtacggtaggggtaaaaggtaaaaaacgtaaaaacgtttagttacggggtaacggtaaccgtttcgttaaggggtaacgggggaaaccggggtacccgtttaactttaccccgaaacccggttacgttcccttaaacccgggaaaggaaaccgaaaacccggaaaacccgtaaacccggaaaaggtaaccggttaccctaaacggtttacggttaaaccttcggtaaacgtaaaccggtaaaaataacccgggtaaacgaccggtttaccgaaagggtaaacggaaccccgggtaaccgggtaaacgggaacccgtaaacgggttcgtttaaacgggttaaaccctttaccgttaacggttggggtaccggtaacgggacgtaacggttaccgtttacccggttagttaacccgtttaccggttttacccgttttaccggtttttagtacccgttttaccggg

SEQ ID NO: 46117 - DNA, 552 bp, Homo sapiens
  misc_feature: GYAE6OF02HL5N4.27.57.F02.1.454.CMB.1.raw
  modified_base (344)..(344): a, c, t, g, unknown or other
  misc_feature (344)..(344): n is a, c, g, or t
  modified_base (459)..(459): a, c, t, g, unknown or other
  misc_feature (459)..(459): n is a, c, g, or t
  modified_base (540)..(540): a, c, t, g, unknown or other
  misc_feature (540)..(540): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagacctccgaggggaagggctgggagttcgtggccaanataaaccaagatggaagtaaaagaaaactagtagtggaactcgtgtgaagggccgtattccaccatctccaagagaaccaacgccaagaatcaattgtatctgacaaatgaaacngacctagaagacggccgaggacacggctagtattactacgtggtgacgagtaacgcgttacctagtcctaattccccgttnttttcgattccg

SEQ ID NO: 46118 - DNA, 594 bp, Homo sapiens
  misc_feature: GYAE6OF02H579U.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccagggaagggctgggagttcgtggaccaacactaaaaccaagagtagggaaggtaaaagaaaactagtaggtaggtactctaggtaggaagggcctaattccacctatcctaccagacgaacaacgaccaaagagtacactgtatactgacaaatacgaacacgacctagaacgacggaccggaacggaaccgtacggacctagtaactaccttacgtggtcgacgaaggacgttactaccgtagtacctacgtttacccgtctttttacggatttacccgg

SEQ ID NO: 46119 - DNA, 579 bp, Homo sapiens
  misc_feature: GYAE6OF02HM7K9.27.57.F02.1.454.CMB.1.raw
  modified_base (567)..(567): a, c, t, g, unknown or other
  misc_feature (567)..(567): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagtcgtggggtccgccaggacctccgaggggaacgggcgtagggtagttcggtcggaccaaacgataaaccaagagtagggaaggtaaaagaaaactatgtaggactcgtgtaggaagggcctagttcactatctaccagagacaacgacaagaacgtcactagtatactgacaaatacgaaacagtacctaggaacgacggaccggaaggaaccgacgggctagttaactactacgtggtcggcgaacgagacctcgtagtctacgttcccgtnttttcgattccg

SEQ ID NO: 46120 - DNA, 530 bp, Homo sapiens
  misc_feature: GYAE6OF02GN6JC.27.57.F02.1.454.CMB.1.raw
  modified_base (499)..(499): a, c, t, g, unknown or other
  misc_feature (499)..(499): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaagggctggagttcgtggccaacataaaccgaagataggaaggtaaaagaaaactagtgtaggactctgtaggaagggcctattccaccatctaccagacgacaacgccaaagacgtcactgtatctgacaaatgaacagcctagagagccgaagcacggctgtactactactgtgacganattactctagtctattccgtctttgattccg

SEQ ID NO: 46121 - DNA, 674 bp, Homo sapiens
  misc_feature: GYAE6OF02I2FE7.27.57.F02.1.454.CMB.1.raw
  modified_base (306)..(306): a, c, t, g, unknown or other
  misc_feature (306)..(306): n is a, c, g, or t
  modified_base (340)..(340): a, c, t, g, unknown or other
  misc_feature (340)..(340): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctattttagaggtgtcagtgtgaggtgcaactggtggattcgtgggaggaggtgtggtccagcctgggagaatccctgagactctcctgtgacagcctcgtggatttcacctttagtagttattggatgagcgtgggtccncgagactccgaggggaacgggcgtggagttcggnggaccaagataaaccagacgtaggaaggtaaaanaaaacgtntaggtcggtacttacgtggtaggaacgggtccgtagttaccgaaccattcctaaccgaaggaacgtaaccgaaaccggtacccaaaaggtaactaccacgttaaggtaactccgttaaggaactaaaacgtcgaaacacggtccgttaacggaagaccggtaccggaaaggcccgacggtaaccgttaggttaacctacgtttaactgggtaacgtaccggaaggtacgtaaccttacccggttaacggttacttaccgttacccggtttacgtttttagaccgtttccggg

SEQ ID NO: 46122 - DNA, 522 bp, Homo sapiens
  misc_feature: GYAE6OF02F3NC4.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagctgggtccnccagactccgaggggaaggggctgggagttcgtggccaacataaaccaagatggaaggtaaagaaaactatagtggactctgtgaagggccgattcaccatctccagagacaacgccaagaagtcactgtatctgcaaatgaacagcctgagagccgagacacggctagtatactactgtgacgagagataccgtagtcattccgtcttttgattccg

SEQ ID NO: 46123 - DNA, 742 bp, Homo sapiens
  misc_feature: GYAE6OF02IH5IL.27.57.F02.1.454.CMB.1.raw
tcagagcgtcgtctcacgaccggtgctcgatttagctcgatatagttgggtttggtaggtctcagagaggagccttagccctggactccaaggcctttccacttggtgatcagcacggagcacagaggacccacatggaactggggctgagctgggttttccttgttgctattttagaaggtgtccagtgtgaggtgacaacgtggtggattgtgggaggaggtggtggtccagccgtggagtaactccctgagacctctcctgtgcacgcctcgtggattcctaccgttttagtagtttagttggtatggagtcgttcgggtcccgacgagtacctccggaaggggaaggggtctaggggtagtttccggtaggaccctaaaacaattaaaacccgaaggtaggtagggaaagggtaaaaactaaaaacttaggtaggtacgtaacgttcgttaggtaacgggaaacgggggtacctaagtttacccgaacgtacgtaccgtaacccgaaaggaaccgggaaacctaaaccgggaacccgaaaaaggtaaccggttaccaaacgttggtttaactacgtacgtaaacaaaagttaccgaaagaaccggtaccgtaggaaacgaccggaccggaacggtaaccggacggaacttcgtaaataccttacgtagggtacggaacggtaggtaacgtactaccgttagtaccttaaccgtttccggtttcttttaggaccttcgg

SEQ ID NO: 46124 - DNA, 652 bp, Homo sapiens
  misc_feature: GYAE6OF02HJXSE.27.57.F02.1.454.CMB.1.raw
  modified_base (340)..(340): a, c, t, g, unknown or other
  misc_feature (340)..(340): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagacctccgaggggaaggggcgtgggagttcggnggccaacataaaccaagagtaggaaggtaaagaaaactataggtaggactcgtaggtaggaacggggacccgtatttaccgaacctacttcctaccgaggaacgaaccaaaccggaccaaaggtaacgtacaacgttagtatacgtagaactaaagtcgaaacacgtacctaggaacgacggaccgaagggaaccgaacggtcctagttaacctacgttacgttacgggtggaaccggaagggtaacgaacgtttaccgttacggttaccgttaacggttttcccggttcgttttttaccggatttcccggg

SEQ ID NO: 46125 - DNA, 617 bp, Homo sapiens
  misc_feature: GYAE6OF02FYFEX.27.57.F02.1.454.CMB.1.raw
  modified_base (261)..(261): a, c, t, g, unknown or other
  misc_feature (261)..(261): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (377)..(377): a, c, t, g, unknown or other
  misc_feature (377)..(377): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctatttagaaggtgtccagtgtgaggtgcaactggtggattctggaggaggtgtggtccagcctggagaatccctgagactctcctgtgcagcctntggattctacctttagtagtttattggattggagtcgtgggtccgccagacctccgaaggggaagggctgggagttcggnggaccaanaataaaaccaagagtaggaaggtaaaanaaaactagtaggtaggaacttcgtaggtaggaacggggcccgtaatttccaaccgtatccaccgaagacgaaccaaaccgaccgaaagtaacgtactacgtagtactctagacaaagtagaacagtaccgtagaacgacggaccgaaggaccgacggtctacgtactacgtacgtaggttcgacggtaacgagtacgttaccgtacgttcttacgttcccgtacgtttttgactttccgg

SEQ ID NO: 46126 - DNA, 550 bp, Homo sapiens
  misc_feature: GYAE6OF02IMQFU.27.57.F02.1.454.CMB.1.raw
  modified_base (457)..(457): a, c, t, g, unknown or other
  misc_feature (457)..(457): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagacctccgagggaggggctgggagttcgtggccaacataaaccaagatggaaggtaaaagaaaactatagtggactctgtgaagggccgattcacctatcctccaagacgaacaacgaccaaagagtcactgtatcgtgacaaatgaaacngcctgagagccggaagacacggctagtaactactactggcgacgaagacgtacgtccgtagtacctacgttccgtttacttttagacttccgg

SEQ ID NO: 46127 - DNA, 789 bp, Homo sapiens
  misc_feature: GYAE6OF02JBDSG.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttcctgttgctattttagaaggtgtccagtgtgaggtgcaactggtggattctggaggaggtgtggtccagcctggagatccctgagactctctgtgcagcctctggattcacctttagtagttattggatgagtctacggggtcccgccagactccgaaggggaacggggtcttagggacggtttcggtacgggaccctaaacgaacgttaaaaacccgaaaggtagtacggggtaaaagggtaaaaacgaaaaaaccgtttagttaaggtacgggtaaccttcgttaggtacgggaaacggggtcccgtaagtttacccgaacccgtaatccgttaacccgaaggaaacgaacccgaaaaccggaacccgaaaacggaaacgtacccgtaaacgttacggttaaacttacggttaccgaactaaaagttaccggaaaacaacggttaccctaaggtaacggtaacggaacccggaagggaaacccgaccgggtaaccgttacgggttaaacgttaccgttaaccggtcgtttaacgggaaccggttaaacgggtaacggtaaccgttaccggttaacggttaccgttaaaccggtttccccgtacggttttttaacgaccgtttaacccggg

SEQ ID NO: 46128 - DNA, 540 bp, Homo sapiens
  misc_feature: GYAE6OF02JFC89.27.57.F02.1.454.CMB.1.raw
  modified_base (529)..(529): a, c, t, g, unknown or other
  misc_feature (529)..(529): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagacctccgagggaaggggctgggagttcgtggccaacataaaccaagatggaaggtaaagaaaactatagtaggactcgtgtagaagggccgattcaccactctccaagagacaacgccaaagacgtcactgtatcgtgacaaatgaacagacctgagacgaccgagacgacggctgtaactacgtacgtggtacgcgagagacttccgtagtcaatttccgnttttgattccg

SEQ ID NO: 46129 - DNA, 702 bp, Homo sapiens
  misc_feature: GYAE6OF02GM6V3.27.57.F02.1.454.CMB.1.raw
  modified_base (305)..(305): a, c, t, g, unknown or other
  misc_feature (305)..(305): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctcgtggattcacctttagtagttattggatgagcgtgggtccncgagacctccgaaggggaacgggctgggagttcgtggacccaaacaataaaccaagactagggaaaggtaaaagaaaacgttagtaggtacggaactcgtaggtaggaaacggggcctaagtttaccgaacctaactaccgtacccgaaggaacgaaccgaaaccggtaccgaaaagtaaacgtacctaacgttacggtaacttcgtacgaacgtaaacgttagaaacctacggtaccgttaggaaacggaaccggacccgggaaagggtaacccgaacgggtacgttaacggttaattaacccgttacgttacggtacggaacggaaggtaacgtaaccttaccggttaacgttaccttaacgtttacccggttacgtttttacgactttacccgg

SEQ ID NO: 46130 - DNA, 773 bp, Homo sapiens
  misc_feature: GYAE6OF02I0XUH.27.57.F02.1.454.CMB.1.raw
  modified_base (261)..(261): a, c, t, g, unknown or other
  misc_feature (261)..(261): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgcttattttagaaggtgtccagtgtgaggtgcaactggtggattcgtgggaggaggtgtggtccagcctggagaatccctgagactctcctgtgcngcctcgtggtattcctacctttagtagtttagttggattgagtcgtcgggtccaccgagaccgtccggaaggggaacggggtccgtagggtacgttcggacggtaccaaacgtaacgtaaaaccgaaggtagtaacggggtaaagttaaaacggaaaacgttagtacggttacggtaacgtttacgtaggtaacgggtaaacggggaccgtaagtttaccaacccgtaacgtacccttaccggaagaacgaacccgaaaccggtaccaaaacgggtaacgtaccttaacgttagttaaccgtaccgtaggtaaacccaaaagtaccggtaaaaccacgggtacccttagggaaaggtaacccggaccggaacgggtaacccgaaccgggtacttaacgggtaacttaccgttaccggtacgggttcggaaccggtaaggtaactacccgtttaaccgtaactttacccggtctttttaaccccggtttcgtttttacggaacctttcccggg

SEQ ID NO: 46131 - DNA, 537 bp, Homo sapiens
  misc_feature: GYAE6OF02G0QTT.27.57.F02.1.454.CMB.1.raw
  modified_base (335)..(335): a, c, t, g, unknown or other
  misc_feature (335)..(335): n is a, c, g, or t
  modified_base (466)..(466): a, c, t, g, unknown or other
  misc_feature (466)..(466): n is a, c, g, or t
  modified_base (527)..(527): a, c, t, g, unknown or other
  misc_feature (527)..(527): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagactccgaggggagggctggagttcggnggccaacataaaccaagatagggaaggtaaagaaaactatgtaggactctggtgaagggccgattcacctatctacagagaccaaacgccaaagaacgtacacgtgtatctgacaaatgaacagcctaganacggccgaggacacggactgtactacgtatgtgcgaagagtatacctagtctattcccgtntttgattcgg

SEQ ID NO: 46132 - DNA, 686 bp, Homo sapiens
  misc_feature: GYAE6OF02I2Z4I.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgacgactctcctgtgcagcctctggattccaacctttagtagttattggatgagtcgtggggtccgcagacctccgaaggggacgggctgggagttcgtggaccaacgataaaaccgaagtatagggaaaggtaaaagaaaactgtaggtacggaactcgtaggtaggaaacggggccgtaattccgaacctattcctaccgaaaggtacgaaaccaaaccggccaaaaggaacgtccaattggtaacttcgttagacctaaaagtcgaaactacggtacccgtaggaacggtaacggacccggaagggtaacccgaccggggttacttagggttaaccttaaccgttacgttacgggtacggaccggaaaggtaacgtaacgtttacccgttaaggttccttaaccgtttcccggtttaccgttttttagaccgtttcccggg

SEQ ID NO: 46133 - DNA, 674 bp, Homo sapiens
  misc_feature: GYAE6OF02GSDRQ.27.57.F02.1.454.CMB.1.raw
  modified_base (306)..(306): a, c, t, g, unknown or other
  misc_feature (306)..(306): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagacctctcctgtgcagcctctggattcacctttagtagttattggatgagcgtgggtccnccagacctccgaggggaagggctgggacgttcggtcggaccaacataaaaccgaagagtagggaaggtaaaagaaaactatagtaggactacgtggtaggaacgggccgtacgtttaccaacctactcctaccgaagaacggaaccaaccgaccgaaacgaacgtcaacttgtaactcgtagactaaatcgaaactacgaccgtaggaacggacggaccggaacgggaccgaaccgggaccgttacgtaacttaccgttaacgttcgggttcggaaccgggaacggtaaacggtaccgttacccggttaacggttcccttaaccggttttacccggtttccgttttttaccggtagttttaccccggg

SEQ ID NO: 46134 - DNA, 562 bp, Homo sapiens
  misc_feature: GYAE6OF02HNCTV.27.57.F02.1.454.CMB.1.raw
  modified_base (315)..(315): a, c, t, g, unknown or other
  misc_feature (315)..(315): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (559)..(559): a, c, t, g, unknown or other
  misc_feature (559)..(559): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctgggaggaggtgtggtccagcctggagaactccctgacgactctcctgtgcagcctcgtggtattcctaacctttagtaagtttattggatgagcgtgggtcccnccgagactccgaggggaggggctgggagttcggtcggaccaaagactaaacgacgaagtaagtaaggtaaagtaaaataaattgtaggtacgtactgtacggtaggaacgtcgtactaccgactctcacgagaacaacacgacaagcactatnactcgaanaataacncgaancgcgagacgacgacgagacncgtatnactactgngcganaagtntacctancgtactccttcgttacgttntcg

SEQ ID NO: 46135 - DNA, 646 bp, Homo sapiens
  misc_feature: GYAE6OF02HO2OT.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagtcgtcggggtccgccgagacctccgaaggggaacggggtctagggtacgttcggtcggacccaaacgaaactaaaaccgaaaggtagtagggtaaacggtaaaaagaaaacgttagtaggtacggtaacttcgtaggtaggaacggggtaccgtacgttaccaacctactccgtaccgaaggaacgaaccaaaccgaccaaagaacgtacaacgttagttaactcgttagaactaaagtacgaaacgacgtacctagaacgacgaccggaggaccgacggtctagtactacgtatggtagacggagacgtacttccgtaacgttcgtactttccgtacgttttagacttcgg

SEQ ID NO: 46136 - DNA, 683 bp, Homo sapiens
  misc_feature: GYAE6OF02HA14J.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtcagtgtgaggtgcaactggtggattcgtgggaggaggtgtggtccagcctggagaatccctgagactctcctgtgcagcctgtggattcctacctttagtagttattgggatggagcgtggggtccgccagacctccggaaggggaacggggtctagggacggttcggtacgggaccaaacgtaactaaaacccgaaaggtacgtagggaaaacggtaaaagaaaaacgttagttaggtaagggacttacgttaggtaagggaacggggtaccgtaattacccgaaccacttacctaccgaaggaacgaaaccaaaccgaccgaaaggtaacgtaccaacgtagttactacgtacgaacaaatacgaacgtacgtacctaggaacgacggaccgtaacggaccgacggtactagttaactaccgttaacgtggtacgaggaacggaagtaccttacccgttagtccttacgtttcccggttacttttacggacttccggg

SEQ ID NO: 46137 - DNA, 676 bp, Homo sapiens
  misc_feature: GYAE6OF02FSSST.27.57.F02.1.454.CMB.1.raw
  modified_base (667)..(667): a, c, t, g, unknown or other
  misc_feature (667)..(667): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatcccctgacgactcctcctgtcgcacgccctcgtggtacttcctaaccgttttaggttaagtttagttgggattggagtcggtcggggtccccgccgagacctccggaagggggaacggggtcgtagggtacggtttccggtcgggaacccaaacgtaaacgtaaaacccgaaggtaagtaggggaaaggtaaaagaaaacgtagtggtaggtactcgtagtagggaacgggaccgtatccaccatcctacgagacgaaccaaccgaccaaagaacgtcacgttagtactctagaactaaatacgaacgacgtaccgtagaacggacgaccgggagaaccgacggtacttaggttacttaccgttacgtgggtacgacggagtaacgtacttacccgtagttacctaccgtttcccgttcttttaccgngtttcccgg

SEQ ID NO: 46138 - DNA, 553 bp, Homo sapiens
  misc_feature: GYAE6OF02HRSRO.27.57.F02.1.454.CMB.1.raw
  modified_base (304)..(304): a, c, t, g, unknown or other
  misc_feature (304)..(304): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccnccagactccaggggaaggggctgggagttcggtggccaacataaaaccaagataggaaggtaaagaaaactatagnggactntgtgaagggcattcacatctaccagagacaaacgccaaagacgtacaacgtgtatctgacaaatcgaacagacctgagagccgaaggtaccacggctagtaatactacgtggtagcggaagtagtactccgttaagtctaacgtttcccgtactttttgacttccgg

SEQ ID NO: 46139 - DNA, 546 bp, Homo sapiens
  misc_feature: GYAE6OF02HX9D8.27.57.F02.1.454.CMB.1.raw
  modified_base (338)..(338): a, c, t, g, unknown or other
  misc_feature (338)..(338): n is a, c, g, or t
  modified_base (383)..(383): a, c, t, g, unknown or other
  misc_feature (383)..(383): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctattttagaaggtgtccagtgtgaggtgcaactggtggattctggaggaggtgtggtccagcctggagaatccctgagactctcctgtgcagcctctggattcacctttagagttattggattgagctgggtccgccagactccaggggaagggctggagttcgtggccaanataaaaccaagatagggaaggtaaagaaaactatggtaggaactntggtagaaaggggccgattcacctatctaccagacgacaacgaccaaagaacggtacactgtatctgacaaatgaacagcctagagacggaccgaggacacggactgtaatactactggtagacgagacgactacctagtactattccgtcttttagattccg

SEQ ID NO: 46140 - DNA, 569 bp, Homo sapiens
  misc_feature: GYAE6OF02FHT9R.27.57.F02.1.454.CMB.1.raw
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (495)..(495): a, c, t, g, unknown or other
  misc_feature (495)..(495): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtgggtccagcctggagaatcctgagactctcctgtgcagcctntggattcactttagtagttatggatgagctgggtccncagactccgaggggaagggctgggagttcgnggaccaanataaaaccaagagtagggaagtaaaagaaaactagtgtaggactcgtaggtagaacggggccatcaaccatctaccagacgaccaaacgccaaagacgtcaacttgtactcagaacaaatcgaaacagcctagacgacgaccggaagacacggtntagtaacttacgtagtggtcgacgaaggagtactacgttacgtcctaagttccccggtattttacggattccgg

SEQ ID NO: 46141 - DNA, 745 bp, Homo sapiens
  misc_feature: GYAE6OF02F5GWC.27.57.F02.1.454.CMB.1.raw
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
tcagagcgtcgtctcacgaccggtgctcgatttagctcgatatagttggggtttgaggtctcagagaggagccttagccctggactccaaggcctttccacttggtgatcagcacggagcacagaggacccaccatggaactggggctgagctgggtttcctgttgctattttagaggtgtccagtgtgaggtgcaactggtggattctgggaggaggtgtggtccagcctgganaatccctgagactctcctgtncagcctctggattcacctttagtattattggatgagctgggtccncagctccgaggggaagggctgggagttcggtaggccaanactaaacccagtagtagggaacggtaaagaaaacgtatagtacgggaaccttcgtcgtaggaacggggtccgagttccaacccgtatcccttaccaaggtaacgaaccaaaccggacccgtaaaaggaacgttccgaaacgttgttaaaccgttccttacgggaacctaaaaggtaccgaaaacggtacccgacccggtttaaggaacggaaccggtaaccccggggaaacgggttaacccgaaccggggttcccgttaagggttaaaccttacccgggttaaacttcggggttaagggtcccggtaaaggtaaccggttaaccggtttccccggttaaacgtttacccggtaaaccgtttttccccccgggtaacttttttttaccgggaacttttcccccggg

SEQ ID NO: 46142 - DNA, 569 bp, Homo sapiens
  misc_feature: GYAE6OF02GBVMW.27.57.F02.1.454.CMB.1.raw
  modified_base (337)..(337): a, c, t, g, unknown or other
  misc_feature (337)..(337): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgcagacctccgaggggaacgggctgggagttcgnggaccaacataaaccaagatggaagtaaagaaaactgtgtgactctgtaggaaggccattcacatctacagacgacaacgcaaagatcacttgtatctagacaaatcgaacacgcctaggaacgacggaccggaaggaccgacggtacttagtaactacgtacgtggtcggaccggtaaggaacgtacttaccgttagtaccgtagttcccggtactttttacgacttccgg

SEQ ID NO: 46143 - DNA, 520 bp, Homo sapiens
  misc_feature: GYAE6OF02GV8TS.27.57.F02.1.454.CMB.1.raw
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagctccagggagggctggagttcgtggccaacataaaccaagataggaaggtaaanaaaactatgtagactctagngaagggccattcacatctaccagagacaacgaccaaagaacgtcactgtatctagacaaatgaacagcctagagacgcgaggacacggctagtatactatggtgacgagagactcctagtctattccgtcttttgattcg

SEQ ID NO: 46144 - DNA, 620 bp, Homo sapiens
  misc_feature: GYAE6OF02FWZ1N.27.57.F02.1.454.CMB.1.raw
  modified_base (607)..(607): a, c, t, g, unknown or other
  misc_feature (607)..(607): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctggtttcctgttgctattttagaaggtgtccagtgtgaggtgcaactggtggattctggaggaggtgtgggtccagcctggagaatccctgagactctcctgtcgcagcccttctgggattcaccttttaggtagtttattggattggagcgtggggtcccgcagactccgagggaagggctgggacgttcggtggacccaacgtaataaacccgaagatgggaaggtaaaagaaaactagtagtaggacttcgtagtaggaaacgggccgtaagttacccaccgtaatcccgttaccgaaggtaacgaaccgaaacgacccaaaagaacgtacgaacttaagtaacttcgtacgaactaaatacgaacgtacgacctagagacggaccgaggaaccgacggtacgtgtaactactacgtggtggacgaagacgtataccaggtactacgttccgtnttttcgattccgg

SEQ ID NO: 46145 - DNA, 668 bp, Homo sapiens
  misc_feature: GYAE6OF02J2NG3.27.57.F02.1.454.CMB.1.raw
  modified_base (589)..(589): a, c, t, g, unknown or other
  misc_feature (589)..(589): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgtgctattttagaaggtgtccagtgtgaggtgcaacgtggtgattctgggaggaggtgtggtccagccgtggagaactccctgagaccttctcctgtcgcagcctcgtggtattacctacttttaggttacgttattgggacttgagtccggtgggtcccgcagaccgtccggaaggggtaacggggtctgggtacgttccggtcggaccctaaagaaacgttaaaaccgaaggtacgtaaggggaaacgtaaaaagtaaaaccgttgttacggtacgtaacttcgtaggttaacgggaccgggttaccgaacgtttaccaaaccgttactccgtaacgaacgggaacaaccgaaccgaccgaaagtaacgtcacttgtactacgtagactaaatcgaaactgaccgtagagacgaccgtaagacncggactagtaactccgtagttacgcggtacgagtactactccgttactccgtacgttccgttacgtttagaccttcggg

SEQ ID NO: 46146 - DNA, 555 bp, Homo sapiens
  misc_feature: GYAE6OF02HLUDM.27.57.F02.1.454.CMB.1.raw
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagagttattggatgagcgtggtccgccagactccgagggagggctggagtgtgccaanataaaccaagataggaaggtaaanaaaactatggtaggactctggtagaagggccgattcacatacacagagaacaacgacgaaagaagtacaactggtatactagacaaatagaaacacgactagagagaccgaagaacgacgacgtagtaactacgtactgtggagaggaagtacgtacctacgtactacgtttacccggtctttttacgacttccgg

SEQ ID NO: 46147 - DNA, 529 bp, Homo sapiens
  misc_feature: GYAE6OF02GJVE5.27.57.F02.1.454.CMB.1.raw
  modified_base (432)..(432): a, c, t, g, unknown or other
  misc_feature (432)..(432): n is a, c, g, or t
  modified_base (452)..(452): a, c, t, g, unknown or other
  misc_feature (452)..(452): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtcctgcctggagaatccctgagactctcctgtgcagccctctggattcacctttagtagttattggatgagtctggggtccgccagactccgaggggaaggggctggagttcgtggccaacataaaccaagatagggagtaaagaaaactatagtggactctgtgagggccattcaccatctacagagacaacgccaagacgtcactntatctgacaaatgaacagcngagagccgaggacacggctagtactactacgtgtggacgagagatccgtagtctacgtttccgtcttttgacttccg

SEQ ID NO: 46148 - DNA, 607 bp, Homo sapiens
  misc_feature: GYAE6OF02GV17P.27.57.F02.1.454.CMB.1.raw
  modified_base (178)..(178): a, c, t, g, unknown or other
  misc_feature (178)..(178): n is a, c, g, or t
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (395)..(395): a, c, t, g, unknown or other
  misc_feature (395)..(395): n is a, c, g, or t
  modified_base (472)..(472): a, c, t, g, unknown or other
  misc_feature (472)..(472): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgtggtttcgtgtagcgtatttagaggtntcagtgtgagtgcaatggtggattnggaggaggtnggtccagccaggagaatccctagagactcgtcctgtgacagtcctgtggattcgaaccgtttagagtttaattggacttggagtctcgggggtacccncaagccgtccgaaggggaacgggctgggatttcggnggacaaactagtaaaaccgagtagtaggaagtaaaagaaactgtaggngtactacgttggagaacgggtctaagttcaccgtatctacagaacaacaacgacctaagatcgtactgtaatcgtanacaatagaacacgacgtagaacgacggacgacgaccgtacggtacgtagtacgtacgtacgtacggtcgtacggtaacgtaacgtaacgttaccgttacgtaccgttaccgttacgtttcgtttacgacgtccgg

SEQ ID NO: 46149 - DNA, 565 bp, Homo sapiens
  misc_feature: GYAE6OF02IMUGY.27.57.F02.1.454.CMB.1.raw
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
  modified_base (522)..(522): a, c, t, g, unknown or other
  misc_feature (522)..(522): n is a, c, g, or t
  modified_base (552)..(552): a, c, t, g, unknown or other
  misc_feature (552)..(552): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggttttcgtgttagcgtattttagaaggtgtccagtgtgaggtgcaactggtggattctggaggaggtgtggtccagcctggagaatcccctgagactctcctgtgcagcctctggacttcacctttagtagtttattggatgagtcgtggggtcccgccagaccgtccgaggggaacgggctgggacgttcggtggaccaacgaataaaccgaagagtagggaaggtaaaagaaaacgtagtaggtaggactcgtagtaggaaggggccgaatttccaaccattcctccgaagacgaacaacggccaaagacgtcactgtactcngacaaatgaacngctgagcgcgagacgagctagactatcgtgngacgagtagactactagtctacgttccgtnttttacgattccg

SEQ ID NO: 46150 - DNA, 533 bp, Homo sapiens
  misc_feature: GYAE6OF02IEJA6.27.57.F02.1.454.CMB.1.raw
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (385)..(385): a, c, t, g, unknown or other
  misc_feature (385)..(385): n is a, c, g, or t
  modified_base (449)..(449): a, c, t, g, unknown or other
  misc_feature (449)..(449): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcactttagtagttattggatgagctgggtccncagacctccgaggggaagggctggagttcgnggaccaacataaaccaagagtaggaaagtaaagaaaactagtagtggactntagtgaagggcattcacatcacagagacaacgcaaagacgtcactgtatctagacaatacgaangacctgagacgccgaagacacggtctagtatactagtcggtgaccgaggagtactacctagtctacttccgtacttttgattcg

SEQ ID NO: 46151 - DNA, 618 bp, Homo sapiens
  misc_feature: GYAE6OF02G9ETQ.27.57.F02.1.454.CMB.1.raw
  modified_base (606)..(606): a, c, t, g, unknown or other
  misc_feature (606)..(606): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagactccgaggggaagggctgggagttcgtggccaacactaaaccgaagagtagggaagtaaagaaaactagtagtaggactcgtaggtaggaacggggccgtaattccaaccctattcctacccgaagaacgaaccaaacggacccaaaggaacgtccaacgttagttactaccttaggaacaaaagtcggaaactacggacccttaggaacgtacggacccggaaggaaccgaccggtactaggtaactacgttaacgtggtcggacgagagtaccttctacgtctacttcccggttntttagattccgg

SEQ ID NO: 46152 - DNA, 526 bp, Homo sapiens
  misc_feature: GYAE6OF02IWPJH.27.57.F02.1.454.CMB.1.raw
  modified_base (302)..(302): a, c, t, g, unknown or other
  misc_feature (302)..(302): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttcctgttgctattttagaggtgtccagtgtgaggtgcaactggtggattctggaggaggtgtggtccagcctggagaatccctgagactctcctgtgcagccctctggacttcacctttagtagttattggatgagcgtgggtccnccagactccgaggggaaggggctgggacgttcggtggccaacataaaccagatggaaggtaaanaaactangtgactntgtgaaggccatcaccatcncagagacaacgacaagatcatgtattcagacaaatgaacagctagagagccgaggacacggcctgtactactacgtgcggtcgagacgacttacgtacgtctacttcggtacttttggacttccgg

SEQ ID NO: 46153 - DNA, 717 bp, Homo sapiens
  misc_feature: GYAE6OF02HKJCP.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcacgcctctggattcacctttagtagttattggatgagcgtgggtccgccagacctccgaggggaggggctggtagttcgtcggaccaacaactaaaccaagagtagggaaaggtaaaagaaaacttagtaggtacggtaactcgttaggtagggaaacgggtcccgtaatttccgaaccctacttacccgtacccgaaggaacgaaaccgaaaccgacccgaaaaggtaacgtaccgtaaccgttaggttaacttaccgttaggaacctaaaagttaccggaaacctacggtacccgttaggaaccggaacggacccggaagggaacccaaccgggtcttaagggttaaccttaaccgttaaccgttcgggtaacggacggtaaggtaacgtaccgttacccggttaagttccgtaaccgttttccccgggttacttttttacggacctttacccggg

SEQ ID NO: 46154 - DNA, 543 bp, Homo sapiens
  misc_feature: GYAE6OF02GER12.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccgccagactccgagggaaggggctgggagttcgtggccaacataaaccaagatagggaaggtaaagaaaactataggtaggactcgtgtaggaagggccattcaccatcctccagagacaacgaccaaagaacgtccactgtatctagacaaatgaacagcctagagacgccgaaggacgacggctagtatactatgtggacgagagactccgtagtctacgttccgtcttttgattccgg

SEQ ID NO: 46155 - DNA, 676 bp, Homo sapiens
  misc_feature: GYAE6OF02G1RKA.27.57.F02.1.454.CMB.1.raw
  modified_base (302)..(302): a, c, t, g, unknown or other
  misc_feature (302)..(302): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcctgtgctatttagaaggtgtccagtgtgaggtgcaactggtggattcgtggaggaggtgtggtccagcctggagaatccctgagactctcctgtgcagcctctggattccacctttagtagttattggatgagcgtgggtccnccagactccgagggaagggctggagttcgtggcccaaagataaaccaagacgtagggaaaggtaaaagaaaacttagtaggtaggtaacttcgtagtagggaaggggtcccgtaatttccgaaccctagttcccttaccgaaacgtaacggaacccaaaccggtacccgaaaaggtaaacggtaccaacgttacgtaattaccgttagaacctaaagtacgaaaccgacggtaccctaggaacgacggacccggaagggtaacccgacgggtaccttagggtaaccttaccgttacgttggtacggacggaaggtaacgtacttacccgttacggttcctacgtttacccggttactttttaggactttccggg

SEQ ID NO: 46156 - DNA, 656 bp, Homo sapiens
  misc_feature: GYAE6OF02FQ9RK.27.57.F02.1.454.CMB.1.raw
  modified_base (308)..(308): a, c, t, g, unknown or other
  misc_feature (308)..(308): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtgcagcctctggacttctacctttagtagttattggatgagcgtgggtcccncagacctccgaggggaacgggctgggagttcggcggaccaaacaactaaaaccgaagataggggaaaggtaaaacgaaaacgttagtaggtacggaacttcgtaggtacgggaaacggggtccctaagttaccaacccgtatccgtacccgaagaacgaaccgaaaccggaccaaagaacgtctaacgttagtaacttccgtagaactaaagtacgaaaccgacgtaccgtaggaacggacggaccggaaggaaccgacggtcttagtaactaccgttacgtggtgacggtaagacgtacttaccgtaggttaccttacgtttcccggttacttttacggacttccgg

SEQ ID NO: 46157 - DNA, 518 bp, Homo sapiens
  misc_feature: GYAE6OF02IQSJS.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaaggggctgggagttcgtggccaacataaaccaagatggaaggtaaagaaaactatagtggactctgtagaagggccgaattcacatctccagagacaacgaccaaagaagtcactgtatctgacaaatgaacacgacctgagagccgagacacggctgtatactactgtgcgagagatctagtcattccgcttttgatcg

SEQ ID NO: 46158 - DNA, 658 bp, Homo sapiens
  misc_feature: GYAE6OF02GF6H4.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaactggtgattcgtggaggaggtgtggtccagcctggagaactccctgagactctcctgtgcagcctcgtggtacttctacctttagtagttattggatgagcgtcgggtccgccagaccgtccggaaggggaaggggcgtgggtacggttcggtcggaccaaacaacgtaaaaccgaagtagtagggaaaggtaaaagaaaactagtaggtaggtactgtaggtaggaacggggtccgtaattccaacctacttacctaccgaaaggaacgaaccgaaaccggacctaaaaggtaacgtcctaacgttagtactacgtagaacaaagtacgaaactacgaccgtaggacgacggaccggaaggaccgacggtacgtagttaactacgtacgtggacggacgacggtaacgtaccttaccgtagttacctaccgtttccggttacttttagactttccgg

SEQ ID NO: 46159 - DNA, 610 bp, Homo sapiens
  misc_feature: GYAE6OF02HTBDB.27.57.F02.1.454.CMB.1.raw
  modified_base (270)..(270): a, c, t, g, unknown or other
  misc_feature (270)..(270): n is a, c, g, or t
  modified_base (336)..(336): a, c, t, g, unknown or other
  misc_feature (336)..(336): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgtgctattttagaaggtgtccagtgtgaggtgcaactggtggattcgtgggaggaggtgtggtccagcctggagaatccctgagactctcctgtgcagtcctctggnttcacctttagtagttattggatggagtctgggtccgcagactccgagggagggctggacgttcgngaccaacataaaccaagagtaggaaggtaaaagaaaactagtgtaggtactcgtagtaggaaacgggctacttacaaccctatcctaccgagaacgaaccaaacggaccaaggaaactccaactagttacactaagaactaaagacgaaacacgtccctaggaacggacggacccggaagggaaccgacgtaccgtagtacctacgtacgtggtacgacggtaagacgtactaccgttacgtccgtactttaccggttcttttacgacttccgg

SEQ ID NO: 46160 - DNA, 523 bp, Homo sapiens
  misc_feature: GYAE6OF02JDWJ1.27.57.F02.1.454.CMB.1.raw
  modified_base (302)..(302): a, c, t, g, unknown or other
  misc_feature (302)..(302): n is a, c, g, or t
  modified_base (471)..(471): a, c, t, g, unknown or other
  misc_feature (471)..(471): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccncagactccgagggaagggctggagttcgtggccaacataaaccagatggaagtaaagaaaactatgtaggactctagtggaagggccgaattcaccatctcagagacaacgccaagaactcacttgtatctacgacaaatgaacagcctagagacgccgaggacacggntagtatactatgtgcgagagatccgtagtctaattccgtcttttagattccg

SEQ ID NO: 46161 - DNA, 767 bp, Homo sapiens
  misc_feature: GYAE6OF02H65Q3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagagtgtccagtgtgaggtgcaactggtgattcgtggaggaggtgtggtccagcctgggacgaatccctgagacctcctcctgtcgcagtcctcgtaggtactttcctaaccgttttagtagtttagttggatgtagcgttcggggtcccgccgtagacctccggaagggggaacggggtcctagggacggtttccggtacgggacccctaaaacgtaaacgtaaaacccgaaaggtagtaggggtaaaaggtaaaaacgtaaaactaggttacggtaacgggtaacttccggtagggtaacggaaacgggggtaccccgttaagtttacccaaccgtaactcccgttacccgaaaggaaccggaaactaaaccggaaccgaaacggtaaacggtaccgtaacgttcggtttaactacgttaacgaacctaaaatacggaaacacggtacccttaggaacggacggacccgggaacggaaccggaccgggtacttaggttaaccgtacgttaacgtggtacgaggtaacgaacgttactaccgtttacgttaccgttaacgttccccggtttacgtttttacggctttaccgg

SEQ ID NO: 46162 - DNA, 607 bp, Homo sapiens
  misc_feature: GYAE6OF02GJ2IS.27.57.F02.1.454.CMB.1.raw
  modified_base (489)..(489): a, c, t, g, unknown or other
  misc_feature (489)..(489): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagactccgaggggaagggctgggagttcgtggccaacataaaccgagagtaggaaggtaaaagaaaactagtaggtaggactcgtggtaggaacggggccgtaattccgaacctagtcctacccgaagacgaaccaaaccgccaaaggtaactacacttgtactcgtagactaaagtcgaacncgactagagacgacgaggaccacgggcttagtactacgtacgtggtacgacggtaagtaacgtaccttaccgttacggttccttaaccgtttccggtttacgttttaggactttccgg

SEQ ID NO: 46163 - DNA, 547 bp, Homo sapiens
  misc_feature: GYAE6OF02IJSVX.27.57.F02.1.454.CMB.1.raw
  modified_base (301)..(301): a, c, t, g, unknown or other
  misc_feature (301)..(301): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaggtgtccagtgtgaggtgcaactggtggattctggaggaggtgtggtccagcctggagaatccctgagactctcctgtgcagcctctggattcacctttagtagttattggatgagctgggtccncagactccgaggggaagggctgggagttcgtggccaacataaaccaagatagggaaggtaaagaaaactagtggtaggactcgtggtaggaaacggggcctaattccaccgatctaccagagacaacgaccaaagaacgtcactagtatctgacaaatagaacagcctagagagaccgagacgacggctagtactactacgtgtcgacgagagactaccgtagtcacgttccgtacttttgattcg

SEQ ID NO: 46164 - DNA, 611 bp, Homo sapiens
  misc_feature: GYAE6OF02HKAE0.27.57.F02.1.454.CMB.1.raw
  modified_base (338)..(338): a, c, t, g, unknown or other
  misc_feature (338)..(338): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggagggctgggagttgtggccaanataaaccaagatggaaggtaaagaaaactatgtaggactctgtggaaacgggccgtattccaaccatcctccaagagaaccaaacgcccaaaggaactacaacttagtacttctgacaaatcgaaacagtaccctaggacgacggaccggaacggaaccgaacgggtacttacggtaactaccgttaacgtcggttcggacgaaggaaggtacttacccgttaacggttaccgtaacgtttcccggtttacttttttacgggacttttcccgg

SEQ ID NO: 46165 - DNA, 598 bp, Homo sapiens
  misc_feature: GYAE6OF02H2M9A.27.57.F02.1.454.CMB.1.raw
  modified_base (302)..(302): a, c, t, g, unknown or other
  misc_feature (302)..(302): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagctgggtccncagactcgagggagggctggagttcgtggccaacataaaccagataggaaggtaaaagaaaactagtggtaggacttcgtaggtaggaagggccgtaatttccgacctattccacccgagacgaacaaacgaccaaagaacgtacacttgtactctagacaaatacgaacacgtacctagaagacggaccggaaggacgaacggctagttaactaccgttacgtggtacggacggaaggaagtacttacccgttagttaccgttacgtttcccggttacgtttttagactttccgg

SEQ ID NO: 46166 - DNA, 555 bp, Homo sapiens
  misc_feature: GYAE6OF02IRZ9T.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaagggctggagttcgtggccaacaataaaccaagagtaggaaggtaaaagaaaactatgtaggactacgtgtagaagggccaattcaccatctaccagagaacaacgacaaagaagtacactgtatctgacaaatcgaaacacgacctagaacgagaccgaaggaccgacggctagtatactacgtgtcgacgagacgtaacttccgtagtctagttccgtacgttttacgattccgg

SEQ ID NO: 46167 - DNA, 575 bp, Homo sapiens
  misc_feature: GYAE6OF02HVTYT.27.57.F02.1.454.CMB.1.raw
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (532)..(532): a, c, t, g, unknown or other
  misc_feature (532)..(532): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggggctgagctgggttttccttgttgctattttagaaggtgtccagtgtgaggtgcaactggtggattctggaggaggtgtggtccagcctggagaatccctgagacctctcctgtgcagcctctggattcacctttagtagtttattggatgagcgtgggtccgcagactccgaggggaagggctggagttcgngaccaanataaaccaagataggaaggtaaaagaaaactatacgtaggactcgtgtggaaacgggtccgaatttccgaccaatcctaccaagacgaacaaaccggtaccaaaggtaagtccaacgttagttatacttcgacaaaatgaaacagcctagacgagccgaaggaccgaacggctagtacttagtctcgngccgagtagactctagtcctagtttacccgtattttgattccg

SEQ ID NO: 46168 - DNA, 657 bp, Homo sapiens
  misc_feature: GYAE6OF02IX0IT.27.57.F02.1.454.CMB.1.raw
tcagagcgtcgtctcacgaccggtgctcgattttagctcgatatagttgggtttggaggtctcgagagaggagtccttagccctggactccaaggccgtttccacttcggtgatcagtcacggagtcacagacggacccacatggaactgggctgagctggtttctgtgctatttagaggtgtcagtgtgaggtgcaactggtgattctggaggaggtgtggtccagcctggagaatccctgagactctcctgtgcagcctctggattcgacctttagtagtttattggatgagcgtgggtccgcagactccgaggggaagggctgggagttcgtggaccaaacaactaaaccgaagtagtagggaaagggtaaaacgaaaaacttaagttaggtacggaacttcgtaggttagggaaaggggcccgtaagttccaacctaagttcctacccagaagaaccaaacggaccaaaggaacgttacaacttagtaattcctagacaaaagtgaaacacggacccgttagaacgtacgggccgaaacgggaccgtaacggtcgtagttaacgttaccgtaagttcggtacggcgtaagaagtaccgtaccgtttagtaccgttaccgtttacccggttacttttttacggacctttaccgg

SEQ ID NO: 46169 - DNA, 560 bp, Homo sapiens
  misc_feature: GYAE6OF02FZXHC.27.57.F02.1.454.CMB.1.raw
  modified_base (451)..(451): a, c, t, g, unknown or other
  misc_feature (451)..(451): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgagactctcctgtgcagcctctggattcacctttagtagttattggatgagcttggggtccgccagactccgaggggaaggggctgggagttcggtgggccaacgaactaaaccaagagtgggaaggtaaaagaaaactataggtaggacttcgtgtaggaagggccgattcaccatcctcagtacacaacgccaagaagcatgtatcngacaaatgaacagctgagacgacgacggacgacggtctagtactacgtactggtagcggaagagtactaccgtagtacctagtttcccgttacttttacgctttaccgg

SEQ ID NO: 46170 - DNA, 538 bp, Homo sapiens
  misc_feature: GYAE6OF02HAQ68.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgagggaaggggctgggagttcgtggccaacataaaccaagatcggaggtaaagaaaactatgtaggactcgtgtagaagggccattcaccatctaccagagacaacgccaaagaacgtcactgtactctagacaaatcgaacagtcctagagagccggaaggacacggactagtactactacgtgtcgcgagagacttccgtagtcattccgtcttttagacttcg

SEQ ID NO: 46171 - DNA, 552 bp, Homo sapiens
  misc_feature: GYAE6OF02GJE36.27.57.F02.1.454.CMB.1.raw
  modified_base (384)..(384): a, c, t, g, unknown or other
  misc_feature (384)..(384): n is a, c, g, or t
  modified_base (449)..(449): a, c, t, g, unknown or other
  misc_feature (449)..(449): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgaggggaagggctgggagttcgtggaccaacataaaccaagagtaggaaggtaaagaaaactagtagtgactntgtagaagggccattcaccatctccagacgacaacgccaaagacgtcacttgtatcagacaaatnaacagcctagacgacgaccgaggaccacggctagtactactacgtggtagacgaggtagtacttccgtagttctacgtttcccgtagttttacgactttccgg

SEQ ID NO: 46172 - DNA, 612 bp, Homo sapiens
  misc_feature: GYAE6OF02FQWUX.27.57.F02.1.454.CMB.1.raw
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgagactctcctgtgcagcctctggattctacctttagtagttattggatgagcgtgggtccgccagacctccgaggggaacgggctggagttcgnggccaanataaaccagagtaggaagtaaagaaaactatgtaggactcgtgtaggaagggtcctagttccacctatcccgtaccgaaggtacgaaccaaaccgacccaaaggtaacgtaccaacgttgtacttcgtagaactaaagtcgaaactacgaccgttaggaacgaggacccgaaggaacccaggtcgtagttaacttacgtaacgtggtacggacggaaggtacgacttaccgtagtaccgttacgttcccggtatttttggattcccgg

SEQ ID NO: 46173 - DNA, 516 bp, Homo sapiens
  misc_feature: GYAE6OF02F51ME.27.57.F02.1.454.CMB.1.raw
  modified_base (339)..(339): a, c, t, g, unknown or other
  misc_feature (339)..(339): n is a, c, g, or t
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctggaggaggtgtggtccagcctggagaatccctgagactctcctgtgcagcctctggattcactttagtagttattggatgagctgggtccgccagactccgagggaagggctggagttcgtggccaanataaaccaagagtggaagtaaagaaaactatgtaggactntgtgaaggccgattcacatctcaganacaacgcaagagtcagtgatctgacaaatgaacagacctggagacgaccgagacacggctagtactactactgtgacgagacgatcctagtctacgttcgtctttgattcg

SEQ ID NO: 46174 - DNA, 610 bp, Homo sapiens
  misc_feature: GYAE6OF02JHTHL.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagacctccgaggggaaggggctgggacgttcgtcgggaccaaacataaaacccaagagtagggaaggtaaaagaaaactagtaggtggaacttctaggtaggaaacgggccgtaattccaaccgatctaccgagaacgaacaacgaccaaagaagtacactacgtaatccgtagaccaaatcggaaacacgtaccctaggagaacgacccggaggaaccgacgggtactagttaactacttaacgtggttcggacgaggtaagacttccgtacgtctaaccgttccgtacttttgacttaccgg

SEQ ID NO: 46175 - DNA, 635 bp, Homo sapiens
  misc_feature: GYAE6OF02HHCQB.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctcgtggacttctacctttagtagtttattggatgagcgtgggtcccgccagacctccgagggggaacggggctgggagttcggtggacccaacgaactaaaccaagagtagggaaaggtaaaagaaaactagtaggtaggactcgtggtaggaacgggcctattccacctatcctaccgaagacgaccaacgaccaaagacgtaccattgtactctagacaaatcgaaacgacgccgtaggaacgacggacccggaacgggaaccgaccggcgttagtaacgttaccgttacgttggtcggacgaaggtaacgtacgtttacccgtaacggttaccgttacgtttcccggtacgttttttcggactttcccgg

SEQ ID NO: 46176 - DNA, 584 bp, Homo sapiens
  misc_feature: GYAE6OF02HG57C.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcagctggtggattctggaggaggtgtggtccagcctggagaatccctgagactctcctgtgcagcctctggattcacctttagtagttattggatgagctgggtccgccagactccgagggaaggggctgggattcggtggaccaacataaaaccaagagtaggaaggtaaaagaaaactagtaggtggtaactcgtagtggaacgggccgtattaccactactcctaccgagacgacaacgaccaaagaacgtcaacgtgtactctcgacaaagtacgaacacgccgtagacggagacccgaggaccacggtccgtagtacgtactacgttggtcggacgtaggacgtacgtaccttagtccgttaacgtttccgttacgtttgtacg

SEQ ID NO: 46177 - DNA, 546 bp, Homo sapiens
  misc_feature: GYAE6OF02HMR9M.27.57.F02.1.454.CMB.1.raw
  modified_base (535)..(535): a, c, t, g, unknown or other
  misc_feature (535)..(535): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagtttattggatgagctgggtccgccagactccgaggggaaggggctggagttcggtggccaacaataaaaccaagatagggaaggtaaaagaaaactatggtagactctgtaggaagggccgtattcacatctccaagacgacaacgaccaagaagtcactgtatctgacaaatgaaacagcctagagacgaccgaaggacacggctagtatactactggtgacgagacgtataccgtagtcctattcccggtnttttcgattcg

SEQ ID NO: 46178 - DNA, 718 bp, Homo sapiens
  misc_feature: GYAE6OF02IXUPV.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggtattctggaggaggtgtggtccagcctggagaactccctgagactctcctgtgcagcctctggtattcacctttagtagttatggatgagtcgtgggtcccgccagactccgaggggaacggggtctgggacgtttcggcggaccaaacgaactaaaccgaagtagtacgggaaaggtaaaacggtaaaactaagtaggtacggtaccttagtcgtagggaacggggtcccgtaagtttaccaacccgtactaccgtacccgaaggtaaccgtaaacctaaacccggaccaaaagggtaaccggtacctaaccggtttagtaaccttacggtcgtaaacctaaaagttacggaaaaccgaccggtaaccctagggaaccggtaccgggacccggtaaacgggaccgtaaacgggtcctaggtaacttacgttaacgtcggtaaggtacgaacggacgtaacttacccgttacgtacgtaccgtttccgttaccgttttagaccctttacggg

SEQ ID NO: 46179 - DNA, 774 bp, Homo sapiens
  misc_feature: GYAE6OF02G0EME.27.57.F02.1.454.CMB.1.raw
  modified_base (266)..(266): a, c, t, g, unknown or other
  misc_feature (266)..(266): n is a, c, g, or t
  modified_base (311)..(311): a, c, t, g, unknown or other
  misc_feature (311)..(311): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttcctgttgctattttagaaggtgtccagtgtgaggtgcaactggtggattctgggaggaggtgtggtccagcctggagaactccctgagactctcctgtgcagcctntggattctacctttagtagtttattggatgagtcgtggggtcccncagactccggaaggggaacggggctgggtacgtttcggtcgggaccaaactaataaaacccgaaggacgtaggggaaaggtaaaagaaaacttagtaggtaggtacttcgttgggtaggaacggggtcccgtaagtttccaacccgtattacccgtaccgaaagtaacggaaccaaaccggacccgaaaggtaaccgttacctaaccgttaggttacttaccgtaggtaacctaaaaagttacggaaaacccgtacggtacccgttaggaaaccgggaacgggaccccgggaaacgggtaaccgtaacccgggggttacttacgggtttaaacgttaaccccgttacggttcgggttacgggaccggttaaagggaacggttacccttttacccgggttaacggtttcccttaaccggtttttccccggtttacgtttttttaccggaaccttttccccgggg

SEQ ID NO: 46180 - DNA, 677 bp, Homo sapiens
  misc_feature: GYAE6OF02IAJWU.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagtttattggatgagcgtgggtccgccagactccgagggaaggggctgggagttcgtggccaacataaaccaagatagggaaggtaaagaaaactataggtaggactctggtaggaacggggacctattaccaaccacttacctacccgaagaacgtaaaccaaaccgacccaaaaggaacgttaccaaccgttgtaacgtccttaggaacctaaaagtacgaaaccgtaacgtaccccgtaggaacgaacggaccccggaaacggggaacccgaccgggtaccttacgggtaacttaaccgttaccgttagggtacggaccggtaaggtaacgtaaccttacccgttaggtaccttaccggttttcccggtacttttttacggacttttacccggg

SEQ ID NO: 46181 - DNA, 541 bp, Homo sapiens
  misc_feature: GYAE6OF02HECZT.27.57.F02.1.454.CMB.1.raw
  modified_base (303)..(303): a, c, t, g, unknown or other
  misc_feature (303)..(303): n is a, c, g, or t
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
  modified_base (500)..(500): a, c, t, g, unknown or other
  misc_feature (500)..(500): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccncagactccgagggagggctggagttcgtggccaagataaaccaagatagggaaggtaaacgaaaactataggtggactactggtagaacgggccgtaattcacctatctaccgagacgaacaacgaccaagaagtcatgtatctgacaaatgaacngacctaganacggaccgaggacacggctagtactacagtgngacgagagactacctagtcctattccgtcttttagattcgg

SEQ ID NO: 46182 - DNA, 898 bp, Homo sapiens
  misc_feature: GYAE6OF02I651Y.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaacgtggtggtattcgtgggaggaggtgtcggtccaggccgtgggagaactcccgtagacgacctctcctgtcgcacgcctcgtggtacttccgtacctttaagtagtttagttggaattggagtcggtcgggtcccacgacgtaccgtaccggaagggggaacggggtccgtaggggtacggtttccgggtacgggaaccctaaaaccgtaaacgttaaaaacccgaaggtaacggttaagggggtaaaaacgggtaaaaaacgtaaaaacgttagttaacgggttaaccggaacgtttaccggttaggggtaaaccggggtaacggggtaccgtaacgtttacccggaaacccttacgttacccgtacccggaaagggaaacccggtaaacccaaaacccgggtaaacccgtaaaaacgggtaaaccgttaccgtaaaccgttaacggtttaaacctttaccggtaacgggaaaccttaaaaaggtaccggtaaaacctaccgggttaacccgtaagggaaacggttaaccgggaaccccgggaaagggaacccgtaacggggtacctttaaagggttaaccgttacccgttaaacgttcgggtaacggaacgggtaaacgtaccggtaaccgttttaacccggaacgtttccgttaacccggtttacccggtttcgttttaacggaccttcccgggg

SEQ ID NO: 46183 - DNA, 632 bp, Homo sapiens
  misc_feature: GYAE6OF02G3J5N.27.57.F02.1.454.CMB.1.raw
  modified_base (264)..(264): a, c, t, g, unknown or other
  misc_feature (264)..(264): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctntggattcacctttagtagttattggatgagctggggtccgccagactccgaaggggaagggctggagttcgtggccaacataaaccaagatagggaaggtaaaagaaaactagtggtaggactcgtggtaggaacggggtccgtaattccgacctatccgtaccgaaggaacgaaccaaacgacccaaaggtaacgtcaacttaggtactcgtgacaaaatgaaaccaggaccctaggaacgaacggcccggaaggaccgaacgggtcttaggtaacttacgttacgtggttacggacggtaagtaacggtacttacccgtaacggttctaaccgtttcccggttacgtttttacggactttacccgg

SEQ ID NO: 46184 - DNA, 643 bp, Homo sapiens
  misc_feature: GYAE6OF02JU6I8.27.57.F02.1.454.CMB.1.raw
  modified_base (544)..(544): a, c, t, g, unknown or other
  misc_feature (544)..(544): n is a, c, g, or t
tcagagcgtcgtctcacgaccggtgctcgatttagctcgatatagttgggtttgtaggtctcagagaggagccttagccctggactccaagcctttccacttggtgatcagcacggagcacagaggacccaccatggaactggggctgagctgggttttccttgttgctattttagaagtgtcagtgtgaggtgcaactggtggattctgggaggaggtgtcggtccagcctggagaactccctgagactctcctgtagcagcctctggattcacctttagtagtttattgggattgagtcgttgggtccggtccacggactacccgtaggggaaggggtctgggagttcggtggaccgaaacgactaaaccgaaggagtagggtaacggtaaaagaaaaacttgtaggtacggtaactccgtaggttaggaacggggtccgaagtttccgaacctacgtacctaccgtaaggaccgtaacaaaccggtccgaaagaaccggtacacgttacgtatacgtcgtacaagtacgtacacgaccgtnacggaacgacccggagaccgtaacgctagtactactacgtcggtaggacgagtaagacgtacctaggttccaacgtttccctacggtttagacttccgg

SEQ ID NO: 46185 - DNA, 616 bp, Homo sapiens
  misc_feature: GYAE6OF02GW219.27.57.F02.1.454.CMB.1.raw
  modified_base (348)..(348): a, c, t, g, unknown or other
  misc_feature (348)..(348): n is a, c, g, or t
  modified_base (398)..(398): a, c, t, g, unknown or other
  misc_feature (398)..(398): n is a, c, g, or t
tcagagcgtcgtctcacgaccggtgctcgatttagctcgatatagttgggtttgtaggtctcagagaggagccttagccctggactccaaggcctttccacttggtgatcagcacggagcacagaggacccaccatggaactggggctgagctgggtttccttgtgctatttagaagtgtccagtgtgaggtgcaactggtggattctggaggaggtgtggtccagcctggagaatccctgagactctcctgtgcagcctctggtacttcctacctttagtagtttattggatgacgctgggtcccgcagactccgaggggaagggctgggagttcggtggaccaaanaataaaccgaagagtagggaaaggtaaaacgaaaactatggtagaccttntacggtaggaacgggccgtatccacatctaccagacgacaaaccgaccgaaagacgtacacgtagtaagtcacgacaaacgtagaaacgaccgctagacggacaccggaggaaccgacggcctagtaaccgtactacgtacggtcggaccggtaagaacggtactacccgttagttaccgttaccgtttccgtttaccgtttttaggaccttaccggg

SEQ ID NO: 46186 - DNA, 605 bp, Homo sapiens
  misc_feature: GYAE6OF02GK2S2.27.57.F02.1.454.CMB.1.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (541)..(541): a, c, t, g, unknown or other
  misc_feature (541)..(541): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcgtggtttctgtagctattagaggtgtcagtgtgaggtgcaactggtggattctggaggagtgtggtccagcctgganaatcctgagactctcctgtncagcctntggattcactttagtagttattggattgagcgtcgggtccnccagtacctccgagggaagggcgtggacgtttcgcggacctaacataaacccgagagtacgggaaggttaaaagaaactataggcggtaactcgtgtacggaagggtcctaattccgacctagtcctccgagtaacgacaaaccgaccgaaaggtacgtcaacgtgtatcgtagactaaagtcgaaccagacctaggaagacggaccgaaggaccgaacggtgtacgtaacgttacctacgttagngtaccggaagataaccgttccgtacggttctaacctttccggtacttttagacccgtttaccgg

SEQ ID NO: 46187 - DNA, 558 bp, Homo sapiens
  misc_feature: GYAE6OF02FM3UA.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctggaggaggtgtggtccagcctggagaatccctgagactctcctgtgcagcctctggattcacctttagtagttattggatgagctggggtccgccagactccgaggggaaggggctggagttcgtggccaacataaaccgaagatggaaggtaaagaaaactatggtaggactctgtgaagggccgattcaccatcctccagacgacaaaccgaccaaaggaagtaccacgttagtattctagactaaagtgaacagcctagagaggccggaggaccacggctagtactactacgtggtcgacgagacgtacgtcctaggtcctacgttaccggtcttttgattccg

SEQ ID NO: 46188 - DNA, 593 bp, Homo sapiens
  misc_feature: GYAE6OF02IVVQT.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatcccctgagactctcctgtgcagcctctggattcacctttagtagttattggatgagctggggtccgccagacctccgaggggaaggggctgggagtttcgtggacccaaacgataaaaccaagaataggaagtaaagaaaactatgtagactctaggtaggaagggcattacaccatcctaccagtacgacaaacgaccaaagtaacgtactaacgtagttatcgtagaactaaatacgaacagtaccctaggacgacgaccggagggaaccgacgggcttagtaatacgttactggtgaccggagagacttaccgtacgttacctacgttcccggtactttttggattcccgg

SEQ ID NO: 46189 - DNA, 578 bp, Homo sapiens
  misc_feature: GYAE6OF02JN994.27.57.F02.1.454.CMB.1.raw
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcagcctctggattcctacctnttagtgttattggatgaggctggtcnccagacgtccgagggaagggcttgggagttccgaggccaaacagtaaaccaaggataagggaagttaaaagaaacgtagtagtaggacttcgtaggtcgaagggtcccgaattcgacctaatactacccgaagaacgaccaaacggacccaaagaacgtcaactgtactactagacaaagtgaacagaccgtagacgagccgaggacacggactacgtatacgtacgtgtacgacgtagacgtacgtctacgtcgtactttccgtacttttgacg

SEQ ID NO: 46190 - DNA, 530 bp, Homo sapiens
  misc_feature: GYAE6OF02FGLRB.27.57.F02.1.454.CMB.1.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccagggaagggcnggagttcgtggccaacataaaccagatggagtaaagaaactatgtgactctgtggaagggccgattacaccatctcagacgacgaacgaccaaagaacgtacacgttgtattctgacaaatagaacagacctgaagacgaccgaaggaccaggctagtatacactggtcgcgagagtatcctagtctacttccgtcttttcgattcg

SEQ ID NO: 46191 - DNA, 607 bp, Homo sapiens
  misc_feature: GYAE6OF02I1XMA.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggaaccaccatggaactggggctgagctgggttttccttgttgctattttagaaggtgtcagtgtgaggtgcaactggtggattctgggaggaggtgtggtccagcctggagaactccctgagactcctcctgtgcagcctctggacttcacctttagtagtttattggatgagcgtgggtccgccagacctccgaggggaggggctgggagttcggtggaccaacaactaaaaccaagagtagggaaaggtaaaagtaaaactagtagtaggacttcgtagtaggaacgggtccgtattaccaccgtatcctaccaaggacgtaaccgaaccgaccaaaggaacgtcctaacgttagtactcgtagaacaaagtcgaaacacgacctaggaacggacgaccggaacgaccgacgggtactagttactaccttagtggtcgacgagacgtactcgtagtctacgttccttgtttacgattcgg

SEQ ID NO: 46192 - DNA, 538 bp, Homo sapiens
  misc_feature: GYAE6OF02FGRYQ.27.57.F02.1.454.CMB.1.raw
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
  modified_base (481)..(481): a, c, t, g, unknown or other
  misc_feature (481)..(481): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctntggattcacctttagtagttattggatgagctggtccncagactccaggggagggctggagttcgtggaccaanataaaccaagatagggaagtaaagaaaactagtaggtggaactcgtgtaggaaggggccaattccaccatcctcaaggacgaacaacgaccaaagacgtacactagtatcngacaaangaacagcctgagagcgagacacggntgtatactacgtgtgacgagtacgataccgtagtctacttccgtacttttgacttcg

SEQ ID NO: 46193 - DNA, 541 bp, Homo sapiens
  misc_feature: GYAE6OF02IUH41.27.57.F02.1.454.CMB.1.raw
  modified_base (415)..(415): a, c, t, g, unknown or other
  misc_feature (415)..(415): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaaccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagcgtggggtccgccagactccgaggggaagggctgggagttcgtggccaacataaaccaagatgggaaggtaaagaaaactatagtggactcgtgtaggaagggccattcaccatctccaganacaacgccaagaacgtcacttgtaatctagactaaatgaaacacgctgaagacggccgaaggaccacgggctagtactactacgtgtgcgagagactcctagtctacgttccgtcttttgattccg

SEQ ID NO: 46194 - DNA, 697 bp, Homo sapiens
  misc_feature: GYAE6OF02HOGD3.27.57.F02.1.454.CMB.1.raw
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctcgtggattctacctttagtagtttatggatgagtcgtcgggtccgccagactccgaggggagggctagggagttcggnggaccaaanacgtaaaaccaaggagtagggaaaggtaaaaagaaaactagtaggtagggaccttacgtggtacgggaaacggggtacctaatttaccaaccgtactacccgtaccgaagaacgaacccgaaaccgaacccgtaaaggaaacgtaccgaacttacgttaactcttacgaacctaaaagtacgtaaaaccgacggtacccgtaggaacggacgggaacccggtaaagggacccgtaaaccgggtacttacggttaacttaccgttaacgttacgggtcgaccggtaaggacgtaccgtaccgttaacgttccgtaacgttttcccggttactttttaggtcttaccgg

SEQ ID NO: 46195 - DNA, 734 bp, Homo sapiens
  misc_feature: GYAE6OF02JFF7D.27.57.F02.1.454.CMB.1.raw
  modified_base (336)..(336): a, c, t, g, unknown or other
  misc_feature (336)..(336): n is a, c, g, or t
  modified_base (474)..(474): a, c, t, g, unknown or other
  misc_feature (474)..(474): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctattttagaaggtgtccagtgtgaggtgcaactggtggattctggaggaggtgtggtccagcctggagaatccctgagactctcctgtgcagcctctggattcacctttagtacgttattggatgagtcgtgggtccgccagactccgagggaagggctgggagttcggngaccaacgataaaaccaagtagtagggaaggtaaaacgaaaactagtggtaggactcgtaggtaggaagggccgtattccgaacctatcctacgagtacgaacaacgccaaaggaagtcaactggttaactccgttanaaccgtaaaagttcgaaaacgacggtacccttaagggaacggaaccgggacccgggttaaacgggaaaccgtaacccggggtacgtttaacggttaaaccgtttacccggttaacggtttcgggtaaccggggtacccgggtaaaaaggggtaaccggttaaccgttttaacccccggtttaaacgggtttccccgttaaaccggttttttccccccgggtttaccggttttttttacggaaccgtttttacccccgggg

SEQ ID NO: 46196 - DNA, 533 bp, Homo sapiens
  misc_feature: GYAE6OF02II0G1.27.57.F02.1.454.CMB.1.raw
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
  modified_base (484)..(484): a, c, t, g, unknown or other
  misc_feature (484)..(484): n is a, c, g, or t
tcagagcgtcgtctcacgaccggtgctcgatttagctcgatatagttggggtttgaggtctcagagaggagccttagccctggactccaaggcctttccacttggtgatcagcacggagcacagaggacccaccatggaactggggctgagctgggttttcctgttgctattttagagtgtccagtgtgaggtgcaactggtggattctggaggaggtgtggtccagcctggagaatccctgagactctcctgtgcagcctctggattcacctttagtagttattggatgagtctggggtccncagactccgaggggaagggctggagttcgtggccaanataaaccaagataggaaggtaaagaaaactntaggtaggactcgtgtgaaagggccgattccgaccatctaccagacgacaacgccaaagaacgtcactgtatctagactaaatgaacagacctagagacgccgaggacacggntgtatactactgtgcgagagactccgtagtcattccgtctttgattccg

SEQ ID NO: 46197 - DNA, 634 bp, Homo sapiens
  misc_feature: GYAE6OF02HFQVO.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggagggaggtgtggtccagcctggagaatccctgagactctcctgtgcagcctctggattcacctttagtagttattggattgagcgtgggtccgccgagacctccgaggggaaggggtctgggagttcggtggccaacgaataaaccaagagtagggaaggtaaaagaaaacgtagtaggtaggactcgtaggtaggaacgggtccgtattccaacctactcctaccgagacgaaccaacgaccaagaacgtacaactgtacttacgtcgaactaagtacgaacgacgaccgtagaacggacggtaccggaacgggaccgaccggtcgttagtaactaccgtacgttggtacggacggtaacggagacttaccgtacggttacctaccgtttcccggttacgtttttacggactttcccgg

SEQ ID NO: 46198 - DNA, 598 bp, Homo sapiens
  misc_feature: GYAE6OF02JCJL9.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattctacctttagtattattggatgagcgtggggtccgccgagacctccgaaggggaacggggctgggagttcggtggaccaaacgaactaaaaccaagagtagggaaaggtaaaagaaaactagtagtaggaacttcgtaggtaggaacgggaccgtagttcaaccgtatcctaccgaaggacgaacaaccgaccaaagaacgtacacttagtactctagacaaatcgaaacacgacctaggagacgacggacgaacgacggctagtaactactagtcggtacgacgaagacgtactcgtacgtctacgttccgtcgttttagacttcgg

SEQ ID NO: 46199 - DNA, 637 bp, Homo sapiens
  misc_feature: GYAE6OF02IXL5X.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggagtgtccagtgtgagtgcaactggtggattctggaggaggtgtggtccagcctggagaatccctgagactctcctgtgcagcctctggattcacctttagtagttattggatgagctgggtccgcagacctccgagggagggctggagttcgtggccaacgataaaaccaagagtagggaaggtaaaagaaaactataggtaggaacttcgtaggtaggaaaggggccgtaatttccaaccctagttccctaccgaacggaacgaaccaaaccggaccctaaaaggaacgtcctaacgttagtacttctagaacctaaatcggaaactacggacccttaggaacggaccggaccgggaacggtaccgaacgggtctaagtacctaacgttacgtggtacggacgtaggaacgtacttaccgtacgttccgtaacgtttcccggtattttacggacttccgg

SEQ ID NO: 46200 - DNA, 688 bp, Homo sapiens
  misc_feature: GYAE6OF02IYE04.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctattttagaaggtgtccagtgtgaggtgcaactggtggattctggaggaggtgtggtccagcctggagaatccctgagactctcctgtgcagcctctggattcacctttagtagttattggatgagtcgtcgggtccgcagacgtccgaggggaaggggctagggtacgttcggtcggccaaacaacgtaaaaccaagagtaggaaggtaaaagaaaactagtaggtggacttcgtagtaggaacgggtccgtattaccgaacctagtaccctccgaagacgaaccctaaaccgaccgtaaaacggtaaacgtacaaccgttcggtaacttccgtagaactaaagtaccggaaacacggtaccctaggaacggtaccggaccggaacgggaacccgtacgggtaccgttagttaacgttacccgttaaggtttccggtaaggaccggtaagtaagttacccttaacccgttacgttaccttaaacccgtttcccggttttacctttttacgtacctttccgg

SEQ ID NO: 46201 - DNA, 674 bp, Homo sapiens
  misc_feature: GYAE6OF02HAEL1.27.57.F02.1.454.CMB.1.raw
tcagagcgtcgtctcacgaccggtgctcgatttagctcgatatagttgggtttgaggtctcagaaaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtcctgcctggagaatccctgagactctcctgtgcagcctctggattcacctttagtagttattggatgagtcgtggggtcccgccgagaccgtcccgaggggaacggggcttggggtagtttcggtcgggacccaaactaacgtaaaaccaagtagttagggaaagggtaaaaagaaaaaccttagtaggttaggaacttacgtaggttacggaaacggggcccgtaatttacccaacctacttcctacccaaggaacgaaccaaaccggaccaaacggaacgtcctaacgtagttactcgtagacctaaaatcggaaaccacgcctaggacgtaacgacccggaggaaccgaacgggtctacgttaactacctacgttggtcggacgtagaacgtacttaccgttaggtactaccgtttccggttactttttacgacttccgttacggg

SEQ ID NO: 46202 - DNA, 535 bp, Homo sapiens
  misc_feature: GYAE6OF02HR7RD.27.57.F02.1.454.CMB.1.raw
  modified_base (196)..(196): a, c, t, g, unknown or other
  misc_feature (196)..(196): n is a, c, g, or t
  modified_base (265)..(265): a, c, t, g, unknown or other
  misc_feature (265)..(265): n is a, c, g, or t
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaagtgtccagtgtgaggtgnaactggtggattctggaggaggtgtggtccagccctggagaactccctgagactctcctgtgcagcctntggattcacctttagagttatggatgagcgtgggtccncgagacctccgagggagggctggagttcgngaccaanataaacanagtaggaaggtaaanaaactagtgtagactgtagtaggacggcgtatacgacctatctacagagaacaacgacaagacnactgtanctnanaatacganagcagagacgacgacgacgacggctagtactacgtataggtcgagaacgagtactcgtacgtctacgttaccgtcttttcgattacgg

SEQ ID NO: 46203 - DNA, 574 bp, Homo sapiens
  misc_feature: GYAE6OF02FGYS6.27.57.F02.1.454.CMB.1.raw
  modified_base (304)..(304): a, c, t, g, unknown or other
  misc_feature (304)..(304): n is a, c, g, or t
  modified_base (479)..(479): a, c, t, g, unknown or other
  misc_feature (479)..(479): n is a, c, g, or t
  modified_base (562)..(562): a, c, t, g, unknown or other
  misc_feature (562)..(562): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagtctgggtccnccagactccgaggggaaggggctgggagttcggtggcccaacataaaaccaagatgggaaggtaaagaaaactatagtggaactcgtgtaggaacgggccgattccaaccatccgtaccaagacgaccaaccgaccaaagaacgtcaacgtgtatcgtagactaaagtcgaaacngcctagagacgccggaagaccacggtctgtaactacaacgtggtacgacggtagagtacttcccgtagtcctatttcccggtnttttagactccg

SEQ ID NO: 46204 - DNA, 551 bp, Homo sapiens
  misc_feature: GYAE6OF02G8Y6C.27.57.F02.1.454.CMB.1.raw
  modified_base (455)..(455): a, c, t, g, unknown or other
  misc_feature (455)..(455): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagcgtgggtccgccagctccgagggagggctggagttcgtggccaacataaaccaagagtaggaaggtaaaagaaaactagtagtggtactctggtaggaaggggcctattcaccatctaccgagagaaccaacgcaagacgtcacttgatctagactaaancgaacagcctagagacgccgagacacggctgtactactacgtgtcggacgaggagtactccgtacgtactacttccggttacttttcggattccgg

SEQ ID NO: 46205 - DNA, 622 bp, Homo sapiens
  misc_feature: GYAE6OF02F2BRU.27.57.F02.1.454.CMB.1.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (484)..(484): a, c, t, g, unknown or other
  misc_feature (484)..(484): n is a, c, g, or t
  modified_base (504)..(504): a, c, t, g, unknown or other
  misc_feature (504)..(504): n is a, c, g, or t
  modified_base (536)..(536): a, c, t, g, unknown or other
  misc_feature (536)..(536): n is a, c, g, or t
  modified_base (609)..(609): a, c, t, g, unknown or other
  misc_feature (609)..(609): n is a, c, g, or t
tcagagcgtcgtctcacgaccggtgctcgatttagctcgatatagttgggtttgaggtctcagagaggagccttagccctggactccaaggcctttccactgggtgatcagcacggagcacagaggacccaccatggaactggggctgagcggtcgtttcgtcgtaggcgtactttagaaggtgtcagtgtgagtgcagtggtggattcnggaggnggtgtggtccaggcctggagaactccctgagactctcctgtgcacgcctcgtggattcctacctttagtagtttattgggattgacgtgttgggtcccgcacggacctccgaaggggaacgggacgtggtaggttcggtcggaccaactaactaaaaccgaagagtagggaaaggtaaaacgaaaaactgtaggttaggaaccttcgtggtagggaacggccgtaattccacctatccacgaagacgaacaacggtacaaagtaaccnctattgtatcgacgactaanacgaactggactagacgacggacgtacggacncggtactagtaactcgtacgtggtacggagaagtcgttacgttaccgtacggttaccttacgtttaccggttntttacgacctcgg

SEQ ID NO: 46206 - DNA, 665 bp, Homo sapiens
  misc_feature: GYAE6OF02F2ACO.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaactccctagagactctcctgtgcacgcctcgtggtacttctactttagtagttattggatgagtcgtcgggtccgccgagaccgtccggaggggtaacgggcgtagggtacgttcggcggaccaaacgtaactaaaaccgaagagtagggaaaggtaaaagtaaaactgtaggtacggtactcgtaggtacggtaacgggtccgtaagttccaaccgtatccctaccgaaggaacgaaacccgtaacggacctaaaggtacgtacctacgttagtactcgtaacgaactaaagtccgaaacgtacgtaccgtaggaacgaccggaccggaacgtaaccgaccgggtcttaagtaaccgttacacgttggtcgacggagtaaccgtacttaccgtacgtacctacgttccgttacttttagcttccgg

SEQ ID NO: 46207 - DNA, 649 bp, Homo sapiens
  misc_feature: GYAE6OF02I807V.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccnccagactccgaggggaagggctgggagttcggtggccaaacactaaaaccgaagacgtagggaaggtaaaacgaaaacttagtaggtaggaacttcgtaggtaggaacgggtccgtatttccaaccattcctaccgaagacgaacaacgaccaaagaacgtacctaacgtgtactcgtagacaaagtacgaaacagtaccctagaacgtacgaacccggagggaaccgtacgggtaccgtagtttaacgtaccgttacgttacggtggaaccggtaggtaacgtacgtttacccgtaagttacccgtaacgtttaccccggttcgtttttaggacctttcccggg

SEQ ID NO: 46208 - DNA, 562 bp, Homo sapiens
  misc_feature: GYAE6OF02IH6VU.27.57.F02.1.454.CMB.1.raw
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (458)..(458): a, c, t, g, unknown or other
  misc_feature (458)..(458): n is a, c, g, or t
  modified_base (495)..(495): a, c, t, g, unknown or other
  misc_feature (495)..(495): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatcccctgagactctcctgtgcagcctctggtattctacctttagtagttattggatgagcgtgggtccgcctagacctccgaggggagggctgggagttcgtggccaacataaaccaagataggaaggtaaaagaaaactntagtggactntgtaggaggccgagttcacctactctaccgaagacgaacaaccgaccgaaagtaaacgtcaacttcgtanctagacaaatcgaaacagtctagacgacgacgagacncggctagtactactctggcgacgagtagtactaccgtagtactacgttcccgtattttcgacttcgg

SEQ ID NO: 46209 - DNA, 592 bp, Homo sapiens
  misc_feature: GYAE6OF02G4N5O.27.57.F02.1.454.CMB.1.raw
  modified_base (335)..(335): a, c, t, g, unknown or other
  misc_feature (335)..(335): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggatgagctgggttttccttgttgctattttagaaggtgtccagtgtgaggtgcaactggtggattctggaggaggtgtggtccagcctggagaactccctgagactctcctgtgcagcctcgtggattcacctttagtagtttattggatgagcgtgggtccgccagctccgagggagggctggagttcgnggaccaacgataaaccgaagataggaaggtaaagaaaactagtgtaggactcgtggtaggaagggtccgattccacctatcctaccgaagacacgaacgaccaaaggaacgtcaacgttgtactcacgactaaagtacgaacagccaggagcggacccgaaggaccgacggtctacgtactacgtacgttgtcggacgaggtaactacgttacccgtaagttccgtacgtttacccggttattttacgactttccgg

SEQ ID NO: 46210 - DNA, 558 bp, Homo sapiens
  misc_feature: GYAE6OF02ISF8B.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgagggaggggctgggagttcgtggccaacataaaccaagatagggaagtaaagaaaactatagtagactctgtagaagggcatcaccatctacagacgacaacgccaaagagacacgtgtactctagacaaatcgaaacacgacctaggacgaacgccgggaacggaccgacgggctagttactacttacgttgcgtacgaaggtagacttccgtagtacctactttcccgtcttttagacttccgg

SEQ ID NO: 46211 - DNA, 539 bp, Homo sapiens
  misc_feature: GYAE6OF02IFA5F.27.57.F02.1.454.CMB.1.raw
  modified_base (294)..(294): a, c, t, g, unknown or other
  misc_feature (294)..(294): n is a, c, g, or t
  modified_base (377)..(377): a, c, t, g, unknown or other
  misc_feature (377)..(377): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgancgtgggtccgccagactccgagggagggctggagttcgtggccaacataaaccaagatggaaggtaaagaaactatgtgactntgtgaggcgtattcacatcncaganacacgcaaagatcactgtatctacgataaatgaacagacctagacgacgacccgaaggaaccacggtactagttataccgttactggtcgacgagaacgtactccgtagtactacgttcccgtcttttcgattccgg

SEQ ID NO: 46212 - DNA, 766 bp, Homo sapiens
  misc_feature: GYAE6OF02GMEUF.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtgggctgaggctgggtttcctgttgctatttagaaggtgtccagtgtgaggtgcaactggtggattctggaggaggtgtggtcgagcctggagaatcctgagactctctcgtgcagcctctggtactcttacctttacgttagttaattggtagtgagcgtgggtccgtccagactccgtaggggaaggggcgtggtagttcggtcggtccgaaacaataaaacccgaaagtaagtagggaagggtaaaacgaaaaacgttaagtagtacggtaacgtactaggtagggaaacggggccgtaacttccaaccgtacttcctccgaaggaacgtaccgaaaccgacccaaaagggaacgtcctaaacttggtaaccttacgagtaaccgtaaaacttcggaaaaacgtaccgaacccggttggaaacgtacgggtacccgttaaacgggaaccggtacccgggttaaacgtttggtttaaaccgttaaccggttttaaacccggtttgggttaccggggtaacggtaaacgggtaacgggttaacctttaccccggttaacggttttaacttacccggttttaccccgttttagggtttttttacccgaccggttttaaccccggg

SEQ ID NO: 46213 - DNA, 649 bp, Homo sapiens
  misc_feature: GYAE6OF02I0EB4.27.57.F02.1.454.CMB.1.raw
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
  modified_base (334)..(334): a, c, t, g, unknown or other
  misc_feature (334)..(334): n is a, c, g, or t
  modified_base (450)..(450): a, c, t, g, unknown or other
  misc_feature (450)..(450): n is a, c, g, or t
  modified_base (461)..(461): a, c, t, g, unknown or other
  misc_feature (461)..(461): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctatttagaaggtgtccagtgtgaggtgcaactggtggattcgtgggaggaggtgtggtccagccgtggagaactccctgagactctcctgtgcagcctcgnggattccacctttagtagttatggactgagctgggtccncagactcgagggagggctggagttcgnggccaacataaaccgagatagggaagtaaaagaaaacttgtgtaggactcgtggtagacgggtccgattaccaccgtactcctacgaagacgaaccgaacgaccaaagaaccgtanacttgtactcncgacaaagtacgaaacgtacgaccgtaggaacgacgtaccggaacgggaaccgtacgggacttaacggtaacttacctaaccgggttaggtccggtacggaaacggtacggtaacgttaccccggttaacgttacccgttaaccgtttttaccccggttaccgttttttacggaccgttttacccggg

SEQ ID NO: 46214 - DNA, 598 bp, Homo sapiens
  misc_feature: GYAE6OF02F8YEA.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaaggtgtccagtgtgaggtgcaactggtggattctggaggaggtgtgggtccagcctggagaatccctgagactctcctgtgcagcctctggattcacctttagtagttattggatggagcgtgggtccnccagacctccgaggggaaggggctgggagttcgtcggaccaacataaaccaagagtggaagtaaagaaaactgtggtaggactcgtaggtagaacggggcctagttccaaccatcctaccaaggacgaaccaaacggacccaaaggaacgtcctaacgtagttatccgtagaacaaatagaactacgcctagaacgacggaccggacgacacgggtactagtaactcgttaacgtgtggaccgaagaacgtacttacgtaagtccttacgttcccgttagttttacgacttccgg

SEQ ID NO: 46215 - DNA, 770 bp, Homo sapiens
  misc_feature: GYAE6OF02G75J5.27.57.F02.1.454.CMB.1.raw
  modified_base (338)..(338): a, c, t, g, unknown or other
  misc_feature (338)..(338): n is a, c, g, or t
  modified_base (675)..(675): a, c, t, g, unknown or other
  misc_feature (675)..(675): n is a, c, g, or t
  modified_base (751)..(751): a, c, t, g, unknown or other
  misc_feature (751)..(751): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctggtttcttgttgctatttagagtgtcagtgtgaggtgcaacgtggtggtatttcgtgggaggtagggttggtgggtacccaggtcccgttgggaagtaactcccgtaggacgtaccgttcctccgtggtcgcacgcctcgtggtacttctacctttagtagtttagttggatgagtcgtcgggtcccncgagtaccgtccggaggggaacgggtcgtgggtacgtttcggacggaccaaaactaactaaaaccgaaggtaacgtagggtaaagggtaaaaacgtaaaaaccttaggtacggtaacggtacgttacgttagggtaacgggaaacggggtcccgtaatttacccgaaccgtaccgtttaccctaacccggaaacgtaaaccggaaaccgaaaccccgtaaacccgaaaaagggtaacgtaacccgtaaccgttaaaggttacctaccgttaaggaaaccctaaaagtaccgaaacgtacgtaccggtagaacgggaccgaaccgtagacgtaccgtnttacgtaactcgttaacgtgggtcggaacgtaacggattaccttaccggtaacttccgttacgtttacccggtttnttttaccgagttacccggg

SEQ ID NO: 46216 - DNA, 769 bp, Homo sapiens
  misc_feature: GYAE6OF02JA426.27.57.F02.1.454.CMB.1.raw
  modified_base (302)..(302): a, c, t, g, unknown or other
  misc_feature (302)..(302): n is a, c, g, or t
  modified_base (391)..(391): a, c, t, g, unknown or other
  misc_feature (391)..(391): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttctgtgctatttagaaggtgtccagtgtgaggtgcaactggtggattctgggaggaggtgtgggtccagcctgggagaactccctgagactctcctgtgcagcctctggattcactttagtagttattggatgagcgtgggtccncagactccgaggggaagggctggagttcgtggacccaacgaataaaacccgaaggtagtacggggtaaaggtaaaaacgaaaaacgttnttagggtacggtaacttcgtagggtaacgggaaacggggtcccgtaaatttcccgaaccctacgttaccccgtaaccgtaaacgggaaccggtaaaccgaaaacccgggacccgaaaaacgggtaaaccggttaccctaaaccgggtttaacggtttaaccgtttaccgttacggtaaacccttaaaaagttaccgggaaaaccgtacggtaacccggttagggaaaccgggaaccggtacccgggaaacgggtaaccggaaaccgggtcttaacggttaacttaccgttacgtacgggtacggtacggtaaggaacgtacgttacccgttaacggttccttaaccggtttcccgttacgtttttacggactttacgg

SEQ ID NO: 46217 - DNA, 634 bp, Homo sapiens
  misc_feature: GYAE6OF02JS7X2.27.57.F02.1.454.CMB.1.raw
  modified_base (267)..(267): a, c, t, g, unknown or other
  misc_feature (267)..(267): n is a, c, g, or t
  modified_base (587)..(587): a, c, t, g, unknown or other
  misc_feature (587)..(587): n is a, c, g, or t
  modified_base (627)..(627): a, c, t, g, unknown or other
  misc_feature (627)..(627): n is a, c, g, or t
tcagagcgtcgtctcacgaccggtgctcgatttagctcgatatagttgggtttgtaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctgggagaatccctgacgactctcctgtgcagcctntggattctacctttagtagtttattggatgagcgtcgggtcccgccagaccgtccgaaggggaacggggtctagggattcgggtggacccaaactagtaaaaccaagagtagggtaaggaaaagtaaaacgtagtgtaggacttacgtggaggtaacgggccgtaacttcgaaccagttccctaccgaagacaaccgaaaccgaccgtaaaacgaacggtcctaaacctggttaactcctagaacctaaagtacgaaacctggacccttagggacgtaggacccgaaggacctacggcgtagtactactacgtggtaacnggtaagacgtcgtacttacggataccgttccgtcgtttancgttccg

SEQ ID NO: 46218 - DNA, 535 bp, Homo sapiens
  misc_feature: GYAE6OF02GFRU5.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaagggctgggagttcgtggccaacataaaccaagatggaaggtaaagaaaactatgtaggactctgtgagggcgattcaccatctccagagacaacgaccaagaagtcactgtatctgacaaatgaaacagcctaggagagccggaggacacggctgtattactacgtgtagcggagagtactacctacgtcctactttcccgtctttttcgattccg

SEQ ID NO: 46219 - DNA, 557 bp, Homo sapiens
  misc_feature: GYAE6OF02HBEK4.27.57.F02.1.454.CMB.1.raw
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
  modified_base (406)..(406): a, c, t, g, unknown or other
  misc_feature (406)..(406): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctntggtattctacctttagtagttattggatgagcgtgggtccnccagactccgagggaagggctggagttcgtggaccaacataaaccaagataggaagtaaagaaaactatagtagactctgtaggaacggctatcacatcncagacgacaacgacaagaacgtcatgtatctagacaaatacgaacacgctagacgacgccgaaggacgacggtactagtacttacgtagttggtacgacggacgagtaacttccgtagttcgtacgtttcccggtactttttagacttcgg

SEQ ID NO: 46220 - DNA, 533 bp, Homo sapiens
  misc_feature: GYAE6OF02FUX63.27.57.F02.1.454.CMB.1.raw
  modified_base (304)..(304): a, c, t, g, unknown or other
  misc_feature (304)..(304): n is a, c, g, or t
  modified_base (521)..(521): a, c, t, g, unknown or other
  misc_feature (521)..(521): n is a, c, g, or t
  modified_base (528)..(528): a, c, t, g, unknown or other
  misc_feature (528)..(528): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccncagactccgaggggaagggctgggagttcgtggtcaacataaaccaagatggaagtaaagaaaactatgtggactctgtagaagggccgatcaccatcctccagagacaacgccaaagaacgcactagtattctgacaaatagaacagcctagagagccggaaggaccgacggctagttatactacgtggtgcgagagactcgtagtctattccgtnttttagnttccg

SEQ ID NO: 46221 - DNA, 692 bp, Homo sapiens
  misc_feature: GYAE6OF02IU5TU.27.57.F02.1.454.CMB.1.raw
  modified_base (310)..(310): a, c, t, g, unknown or other
  misc_feature (310)..(310): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaacgtggtggattctgggaggaggtgtggtccagcctggagaactccctgagactctcctgtgcagcctctggtattctacctttagtagttattggatgagcgtggggtcccnccgacgacctccggaaggggacggggcgtagggtacggttcggtcggaccaaacaactaaaaccgaagacgtagggaaagggtaaaacgaaaactagtaggtaggtactcgtaggtaggaacgggtccgtagttaccaccgtatcctaccgaagacgaaccgaacgacccgtaaaaggaacgtccaacgttagtaacttccgacgtaacaaagtacgaaacacgacccgtaggaaacgcggaccggaagggaaccgtaacgggcccttaaggttaaccgttaccgttaacgttcgggtacgaccgggtaagtaacgttaaccgttcccgttaacggttccctacggttttaccccggtttcttttaccggtacgtttcccgg

SEQ ID NO: 46222 - DNA, 773 bp, Homo sapiens
  misc_feature: GYAE6OF02IPIFV.27.57.F02.1.454.CMB.1.raw
  modified_base (315)..(315): a, c, t, g, unknown or other
  misc_feature (315)..(315): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctaggagaactccctgacgactcctcctgtcgcagcctctggtattcctaccgtttagtagttattggatgagtcgtcgggtcccnccgacgacctaccggaggggaacggggtctagggtacgttcggtacggacccgaaacaaacgtaaaacccgaaaggtaacggtaggggaaaaggttaaaaacgtaaaaaccgttagtagggtacgggtaaccttacgttagggtaacgggaaaccggggtacccgtaatttacccgaacccgttacgtacccgtacccgaaagggtaacggaaacccgaaaccgtaacccgaaaacgggttaaaccgtaccaaccgtttagtaacttaccgtacgtaacctaaaagtaccggaaaccgtacggtaccctagggaaccgtaacgggacccggaagggtaacccgaaccggtaccgttaacgttaacgttacctaacggtcggtaacggacggaagtaacggtaccgttaacccgttaggtaccttaccgtttacccggttacttttccgaatttcccgg

SEQ ID NO: 46223 - DNA, 688 bp, Homo sapiens
  misc_feature: GYAE6OF02I0VLZ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaggtgtccagtgtgaggtgcaactggtggattctggaggaggtgtggtccagcctggagaactccctgacgactctcctgtgcagcctctggattcacctttagtagttatggatgagcgtgggtccgccagactaccgaggggaacggggctagggtagttcggtagggacccaaactaactaaaaccgaaggtaacgttaggggaaacggtaaaacgaaaaacgttagtaggtacggacttaccggtgttacggggaaacggacccggtacttaccgaaccctattacccctaccgaaggtaaccggaaccaaacccggaaccgaaaacggagtacctaacgttgtaacttactaggactaaaagtcgaaactacgtccgtaagaacgcggaccggtaagggaacctacggtactacgggttaataccgttaggtacggtcggaccggaaagtacggttactttcgttaagcccgtttagttcccggtttacgtttttgacctttacccgg

SEQ ID NO: 46224 - DNA, 660 bp, Homo sapiens
  misc_feature: GYAE6OF02G3FOU.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttggaaggtgtccagtgtgaggtgcaactggtggattctggaggaggtgtggtccagcctggagaatccctgagactctcctgtgcagcctctggattcacctttagtagttattggatgagctcggggtcccgccagacctccgaggggaacgggctgggtagttcggtcgggacccaaacaactaaaaccaaagaagtagggtaaaggtaaaagaaaaactagtaggtaggactcgtagtaggaacggggtacctattaccgaacctatcctaccaagacgaccaaacgacaaagaacgtacaacgttgtactctagaactaaaagtacgaaactacggtaccgtaaggaacgtacggacccggaacgggaaccgaaccggtacttagtaactaaccgttacgtggtaacgtaccggaagtaacgtaaccgttaaccgttaacggttcctaaccgttttcccggttacttttacggactttcccgg

SEQ ID NO: 46225 - DNA, 760 bp, Homo sapiens
  misc_feature: GYAE6OF02FGUVR.27.57.F02.1.454.CMB.1.raw
tcagagcgtcgtctcacgaccggtgctcgatttagctcgatatagttgggtttgaggtctcagtagaggagccttagccctggactccaaggcctttccacttggtgatcagcacggagcacagaggacccaccatggaactggggctgagctggtttccttgttgctattttagaaggtgtccagtgtgaggtgcaactggtggattctgggaggaggtgtgggtccagcctggagaactccctgagactctcctgtgcagcctcgtggattcctaccttttaggtagtttattgggattggagtcgttcggggtcccgcctaagacctccgaagggggaaggggcctgggagtttcgtggcccaaactataaaaccagtaagtgggtaaacggtaaaaacgtaaaactgttaggtggtaaccttcgttaggtaggaaacgggggtcccaatttaccgaacccgtactcccgttacccaagggaaccgaaccaaacccggtacccgaaaaggtaaaccggtcctaaccttaggtaacttttccgacggtaacctaaaaaggttccgaaaaccgtaaccggtacccgtaggaaacgggaacccggacccgggaaacggggaacccgaccggggtactttaaccgggtaacctttaaccgttacccggtgggttacggaccggtaaggaaccgttacgttaacccgttacgttaccttaacggtttccccgttttacgtttttacggtactttaccccggg

SEQ ID NO: 46226 - DNA, 715 bp, Homo sapiens
  misc_feature: GYAE6OF02HBBFM.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccaggcctggagaactcccgtgagactctcctgtcgcagcctcgtggacttctacctttagtagttattggatgagcgtggtccgcagactccgaggggaagggcgtagggtacgttcggtcgggtacccaaaacgtaacgtaaaaccgaaggaagtacgggtaaaagggtaaaacgtaaaaacgtagttacggtacggtaaccttcggttaggttacgggaaacggggtcccgtaatttaccgaactacgtacttaccgaaaggaacgaaccgaaaccggaccaaaggtaacgtactaaaccttggtaacttccgtagaactaaaacgtaggaaaccacgtaccgttaggaagaccggtaaccggaagggaacccgaacggtcgtaagttaacgtaccttacggtcggttaacggcggaaggtacgtaaccgttccggtaaacgttccttaacggttttacccgtccgttttttaggccctttacggg

SEQ ID NO: 46227 - DNA, 534 bp, Homo sapiens
  misc_feature: GYAE6OF02ILYLT.27.57.F02.1.454.CMB.1.raw
  modified_base (444)..(444): a, c, t, g, unknown or other
  misc_feature (444)..(444): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (523)..(523): a, c, t, g, unknown or other
  misc_feature (523)..(523): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgccagacctccgagggagggctggagttcgtggccaacaactaaaccaagagtggaaggtaaagaaaactagtgtgactctgtgaagggccgtatcaccatctcagagacaacgacaagaacgtacaactgttatcgtanactaaatgaaacagcctagagagaccgagacacggtcngttanactacngtgacgngagactccgtagtcagttccgtnttttgacttcg

SEQ ID NO: 46228 - DNA, 564 bp, Homo sapiens
  misc_feature: GYAE6OF02GZ1XI.27.57.F02.1.454.CMB.1.raw
  modified_base (294)..(294): a, c, t, g, unknown or other
  misc_feature (294)..(294): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattctacctttgtaaaaaaaaaagttnttggatgagctcgggtccgccagactccgaggggaggggcgtggagttcgtggccaacaactaaaccaagagtaggaaggtaaagaaaacgtatagtaggactctgtggagggccgatcaccatctccagacgacaacgaccaagaacgtacactgtatctagacaaatacgaacacgacctagagacggaccgaggaccgacggctacgtatactacgtgtcgacgagagactaccgtacgtctacgttcccgtcttttacgtattccg

SEQ ID NO: 46229 - DNA, 636 bp, Homo sapiens
  misc_feature: GYAE6OF02GVZ2K.27.57.F02.1.454.CMB.1.raw
  modified_base (631)..(631): a, c, t, g, unknown or other
  misc_feature (631)..(631): n is a, c, g, or t
tcagagcgtcgtctcacgaccggtgctcgatttagctcgatatagttgggtttgaggtctcagagaggagccttacgccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactcctcctgtgcacgcctcgtggtattcctaactttagtagtttattggatgagtcgtcgggtccgcacgtacctccgaagggggaagggctagggtacggttcggcggacccaaactaactaaaacccgaaaggtacgtagggaaaggtaaaagaaaacgttagtaggtacggtaacttcgtaggtaggaacgggtccgtaatttaccacctacgtccctacgaacgacgaaccgaacgaccgaaaggaacgtaccaacgttgtactcgtagaactaaatacgaacgacgccgtagacgacgacgacgacgacggtctacgtatactacgtggtacgacgaaggacgtagtaccgtagtcgtacgttccgtcgttttacgnttccg

SEQ ID NO: 46230 - DNA, 654 bp, Homo sapiens
  misc_feature: GYAE6OF02H80X3.27.57.F02.1.454.CMB.1.raw
  modified_base (345)..(345): a, c, t, g, unknown or other
  misc_feature (345)..(345): n is a, c, g, or t
  modified_base (377)..(377): a, c, t, g, unknown or other
  misc_feature (377)..(377): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctggttttcctgtgctattttagaaggtgtccagtgtgaggtgcaacgtggtggattctgggaggagatgtggtccagcctggagaactccctgacgactcctccgtgtgcagcctctggattcacctttagtagttatggatgagtcgtgggtcccgcaggtacctccgaagggaaggggtctgggacgtttcgnggaccaaacataaaccagatagggaagtaaanaaactagtgtaggaacttctaggtaggaaacgggtcccgtaagtttaccaacctacgtccgttaccgaaggaacgtaaccgaaaccgaccgaaacggtaaagtaccaacgttacgttaagtcctagaacctaaaagttacgaaaccgtagacccgtaggaacgaacggacccggaacggtacaacgggtcctaggttactacgttacgttggtacgacggaacgtacgagttaaccgttacggtacccttagtttcccgttacttttacggtaccgg

SEQ ID NO: 46231 - DNA, 540 bp, Homo sapiens
  misc_feature: GYAE6OF02FKDN7.27.57.F02.1.454.CMB.1.raw
  modified_base (459)..(459): a, c, t, g, unknown or other
  misc_feature (459)..(459): n is a, c, g, or t
  modified_base (527)..(527): a, c, t, g, unknown or other
  misc_feature (527)..(527): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagctccagggagggctggagttcgtggccaacataaaccaagatgggaaggtaaagaaaactagtggtaggaactcgtaggtggaaaggggccgattccaccatctccagacgacaacgaccaaagaacgtcactgtatctgacaaatgaaacngcctgagagccgaagacacggctagtatactactggtgacgagagtactccgtagtctagttcccgtnttttacgattccg

SEQ ID NO: 46232 - DNA, 707 bp, Homo sapiens
  misc_feature: GYAE6OF02JES0X.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggaaccaccatggaactggggctgagctgggttttccttgttgctattttagaaggtgtccagtgtgaggtgcaactggtggattctggaggaggtgtggtccagcctggagaatccctgagactctcctgtgcacgcctctggtacttctacctttagtacgttattggatggacgtcgtcgggtccgccagccgtccgaaggggaacggggtctagggtacggtttcggtcggaccaaacgtaaactaaaaccgaagtagtaacgggtaaaggtaaaaacgaaaactaggtaggtacggtacttcgtaggtagggaaacgggtccgtaattaccgaaccgtacgtcctaaccgaagggtaacgaacctaaaccggaaccgtaaaacggtaacgtcctaacgttggtaactcgtacgaactaaaagagaaaccgcgtcctaggaagtaccggaccgaagggaaccacgggtaccttaagtactaccgttacgtcgggtcggaacggtaaggtaagtccgttaaccggttaacgttacccttaaggtttccccgtttacgtttttacggacgttttacccggg

SEQ ID NO: 46233 - DNA, 529 bp, Homo sapiens
  misc_feature: GYAE6OF02FW8J5.27.57.F02.1.454.CMB.1.raw
  modified_base (303)..(303): a, c, t, g, unknown or other
  misc_feature (303)..(303): n is a, c, g, or t
  modified_base (413)..(413): a, c, t, g, unknown or other
  misc_feature (413)..(413): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccaggggaaggggctggagttcgtggccaacataaaaccaagatagggaaggtaaaagaaaactatagtaggaactcgtgtaggaagggccgattcaccatcncagagacaacgccaagaagtcaactgtatctgacaaatgaacagcctagagacgcgagacacggctgtatactactgtgacgagagatccgtagtctacttcgtcttttgattccg

SEQ ID NO: 46234 - DNA, 567 bp, Homo sapiens
  misc_feature: GYAE6OF02HE7O1.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgagggaaggggctggagttcgtggccaacataaaccaagagtagggaaggtaaagaaaactagtaggtgactcgtgtaggaagggcctaattcaaccatcctaccaaggacgaaccaacgaccaaaggaagtaccaacgttagtactcttacaaatgaaacacgcctaggagacgccggaggacgacggctagtaactacgtactgtgacgagagtactcctagtcaccgttccgtcttttggacttcgtaccggg

SEQ ID NO: 46235 - DNA, 559 bp, Homo sapiens
  misc_feature: GYAE6OF02GWIRX.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgagtgcaactggtggattctggaggaggtgtggtccaggccctggagaatcccctgagactctcctgtgcagcctctggattcacctttagtagttattggatgagctggtccgccagactccgaggggaacggggctgggagttcgtgggaccaacgataaaacccaagatagggaaggtaaaagaaaactatagtggaactcgtgtgaaaggggccaagtttccaccatcctaccagagaacaacgacccaaagaacgtacacgtgtatctgactaaatgaacagacctagacgaggaccgaaggacacggcttagtatactagtggtgacgagacgactctacgtctacttccgtcttttgattccg

SEQ ID NO: 46236 - DNA, 221 bp, Homo sapiens
  misc_feature: GYAE6OF02GVMT5.27.57.F02.1.454.CMB.1.raw
  modified_base (174)..(221): a, c, t, g, unknown or other
  misc_feature (174)..(221): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgggcgttggcaaggcgctatagnnnnnnnnnnnnnnnnnnnnnnnnnnnnnnnnnnnnnnnnnnnnnnnn

SEQ ID NO: 46237 - DNA, 602 bp, Homo sapiens
  misc_feature: GYAE6OF02FW4DQ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggaaccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccgagggaagggctggagttcgtggccaacataaaccaagatggaagtaaagaaaactagtagtggactctgtaggaaaggccgtattcacgtatctccagagacaacgccaaagaacgtcaacgtgtactcttagactaaatacgaaacacgaccgtagacggtaacgcccggaacgggaaccaccgggactacggttaactaccgttaactgggttacgacggtaacggagtacgttacccgttagttacctaacgttttacccggtaccgttttttagactttacccggg

SEQ ID NO: 46238 - DNA, 837 bp, Homo sapiens
  misc_feature: GYAE6OF02ISFFQ.27.57.F02.1.454.CMB.1.raw
  modified_base (258)..(258): a, c, t, g, unknown or other
  misc_feature (258)..(258): n is a, c, g, or t
  modified_base (300)..(300): a, c, t, g, unknown or other
  misc_feature (300)..(300): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaactccctgagctctcctgtncagcctcgtggattccactttagtagttacttggatggtacncgttacgggtcccgcaaggtaccttccggaagggggaacggggtccttaggggtaacgtttcggtacgggacccctaaacgaaacgttaaaaacccgaaaggttagtacgggggtaaaacgggttaaaaaacgaaaaaccggtttatcggggtaacggtaaccttggttacgggttacgggaaacgggggaccctttacgtttaccaaacccgtgttaacccgtaccctaaagggaacggtaacccgaaaacccgggtaccaaaaacgggtaaccggttaccctaacggtttacggtaaaccgtttcggtaacaaaccggttaaaaataccgggttaaaacgaccggttaccccgttaagggaacccggtacgggttaaccccgggaagggtaaccccgtaaacgggtcccgtttaagttaacccgttaaccgtttaaccggtggttacggggaaccgtacggtaaaacggtaccgtttccgtaacggttaccgtaaccggtttttcccgtacggttttttagaccgtttacccggg

SEQ ID NO: 46239 - DNA, 835 bp, Homo sapiens
  misc_feature: GYAE6OF02I28X8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcactggtgattctggaggaggtgtggtccagcctggagaatccctgacgacctctcctgtgcacgcctctggtattcctaccttttagtagtttaattgggaattggagtcgttcgggggtcccgacccgtaaggacctccggaagggggaacggggcgttaggggtagtttccgggtacgggaccccaaaactaaacgtaaaaaacccgaaaggtaacgtaagggggtaaaacgggttaaaaacgaaaaacgttagttaggttacggtaaccttcgttacggtaagggaaacggggtacccggtaacttacccgaaccgtaacgttacccgtaccgtaaacgggaaccggtaacccgaaaacccggaacccgtaaacgggtaaacgttaaccgttaacgttacggttaactttacgtaacggaaccgttaaaaacgtaagaaacccgtaacggtacccgttaacgggacggaaaccgggtaccggaaaccgggaacccggtaacccgggtacgttaacggttaaacgttaccttaacgttcggtaacgggccggtaaaggtaacggttaccttacccgggttaacttaccgttaaccgttttccccgtttacggttttttaccgcgttttaaccccggg

SEQ ID NO: 46240 - DNA, 741 bp, Homo sapiens
  misc_feature: GYAE6OF02IBL4V.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaactggtggattctgggaggaggtgtggtccagcctggagaatccctgagactctcctgtgcagcctctggattcactttagtacgttattggatgagcgtgggtccnccgagcctacgaggggacggggctagggtagttcggtcggaccaacgaataaaaccgaagacgtaggggaaaaggtaaaacgaaaactttaagtggtagggtaaccttcgttaggtacgggaaagggggtccctaagtttaccgaaccctaagttccctacccgaaggaaacggtaaaccgtaaaccggaacccaaaagggtaaacgttacccaaacgttcggttaacttacgtacgtaactaaaacgtacgaaacaacggtacccgttaaggaacggtaacgggacccgaaaggggtaacccgaacgggtacttacgttaaaccttacgttaaccgttagggtaccggaacggaagggtaacgttaaccgttacccggtttaggttacccttaacggtttttaccccggttcgttttttacggacttttacccggg

SEQ ID NO: 46241 - DNA, 513 bp, Homo sapiens
  misc_feature: GYAE6OF02GL9X2.27.57.F02.1.454.CMB.1.raw
  modified_base (303)..(303): a, c, t, g, unknown or other
  misc_feature (303)..(303): n is a, c, g, or t
  modified_base (398)..(398): a, c, t, g, unknown or other
  misc_feature (398)..(398): n is a, c, g, or t
  modified_base (467)..(467): a, c, t, g, unknown or other
  misc_feature (467)..(467): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccagggaagggctggagttcgtggccaacataaaccaagataggagtaaagaaaactatgtaggactctgtagaagggccgattcacntctccagagacaacgccaaagaagtcactgtatctgcaaatgaacagcctgacgagccgaggacacggntgtaatactactgtgcgagagatctagtcattccgcttttgatccg

SEQ ID NO: 46242 - DNA, 616 bp, Homo sapiens
  misc_feature: GYAE6OF02HM4KS.27.57.F02.1.454.CMB.1.raw
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (494)..(494): a, c, t, g, unknown or other
  misc_feature (494)..(494): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtattattggatgagctgggtccnccagactccgaggggaagggctgggagttcggnggccaanaactaaaccgaagagtagggaaaggtaaaagaaaacgtataggtacggactcgtggtaggaacggggccgtattccgacctacgttcctaccgaagacgaaccaaaccgaccaaaggaacgtacacttagtactctagacaaagtcgaaacncgactaggacgacggaccggagaccgacggacttagtaacttacgtacgttggtacgacggaaggtaacgacttaccgttacggtcctaacgtttccccggttatttttacggactttccgg

SEQ ID NO: 46243 - DNA, 609 bp, Homo sapiens
  misc_feature: GYAE6OF02F9O6X.27.57.F02.1.454.CMB.1.raw
  modified_base (593)..(593): a, c, t, g, unknown or other
  misc_feature (593)..(593): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagccctgtggattctacctttagtagtttattggatgagtcgtcgggtccgccagacctccggaggggaagggctgggcgttcggtcgaccaaacactaaaccagatagggaaggtaaagaaaactatgtaggactgtggtacggaagggcctagttcaccgtatctaccgagacgaacgaaccaccgaaagaacgtaccacgttacgattaccgtgaacgtaaactaggaaactacggccgtaggaacggacggacgaacgggacacggtctaacgtactacgtactgggtcgacggaagtactacgttccgtaacgtcttaacgttcccgttnttttacgcttacccgg

SEQ ID NO: 46244 - DNA, 630 bp, Homo sapiens
  misc_feature: GYAE6OF02IPF72.27.57.F02.1.454.CMB.1.raw
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgaggggagggctggagttcgtggccaactaataaaccaagataggaaggtaaaagaaaactatagtaggactacgtgtaggtaacgggcctagttccaaccacttacctacccgaagtaacgaaccaaacggacccaaaaggaacgtacaacgttagtaactactagaacaaaatagaaacacgacctaggaagacggaccggaaggaaccgacgggactacggttaactaccgttaacgtcggtcggaccggtaaggaacgtaacgttacccgtaaggttcctaccgtttcccgttctttttaggactttacccggg

SEQ ID NO: 46245 - DNA, 542 bp, Homo sapiens
  misc_feature: GYAE6OF02GNM1C.27.57.F02.1.454.CMB.1.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctggattcacctttagtagttattggatgagcgtgggtccnccagacctccgagggaaggggctgggagttcgtggccaanactaaacaagatggaggtaaagaaaactatgtggactgtgtgaagggcctattcacatctcagagacacgcaagactcactgtatctgacaaagtgaacagcctagagacgccgaggacacggcctgtactacgtactggtcgacggaagagtacgttaccttagtcctaacgtttccgttcttttaggactttcccgg

SEQ ID NO: 46246 - DNA, 715 bp, Homo sapiens
  misc_feature: GYAE6OF02I81WE.27.57.F02.1.454.CMB.1.raw
  modified_base (634)..(634): a, c, t, g, unknown or other
  misc_feature (634)..(634): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgcttattttagaaggtgtccagtgtgaggtgcaacgtggtggattctggaggaggtgtggtccagcctggagaactcccgtgagacctcctccgtggtgcacgtcctcgtggtattcctacctttagtagtttaattgggatggagtcgtcgggtcccgacgtacgaccgtccggaagggggaacggggcgttaggggtacggttccggtcgggaacccaaacgtaactaaaaccgaaaggtagtaagggtaaaagggtaaaaagtaaaaacttagtaggtaggtaactcgttgggtaggaaacggggtccgtaaagtttcccaaccgtaacttcccgtaacccgtaacggacggaaaccgtaaaccggaccgaaaaggtaacgtacctaacgttagttaactcgtacgaaccgtaaactacggaaactacggtacctaaggaacggcgtaaccggaggaccgacggtntagtactacgttacgtcggacggacggacgtaacgtacttaccgttagtaccttacggttctttacgttttagacttccgg

SEQ ID NO: 46247 - DNA, 723 bp, Homo sapiens
  misc_feature: GYAE6OF02JW1BD.27.57.F02.1.454.CMB.1.raw
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (714)..(714): a, c, t, g, unknown or other
  misc_feature (714)..(714): n is a, c, g, or t
tcagagcgtcgtctcacgaccggtgctcgatttagctcgatatagttgggtttgtaggtctcagagaggagccttagccctggactccaaggcctttccacttggtgatcagcacggagcacagaggacccaccatggaactggggctgagctgggttttcctgttgctattttggaaggtgtccagtgtgaggtgcaactggtggattctgggaggaggtgtgggtccagtccctgganaactcccgtgacggactntcctggtgcagcctctggatctaccttagtagttattaggatgtagcgtggggtaccgtccgaagacctccggaggggaacggggtacgtggtaaggttcggtaggaccccaacgtaacgtaaaacccaaaggtacgtaaggggtaaggtaaaaaggtaaaaacctaggtacggtaggtaaccgttaccgtagggtacgggtaaacgggggccgttaacgtttaaccgtaacccaacgttccccttaacgaacggaaacgaacccgtaaacgaaccgaaaagtaaccggtactacgttacgtactacgttagaactaaacggtagaaaccgtaggcctaaggaacgacgggaacccgtaaggaacccgacggtacgttagtaactacgtaaccttgggtacgcggtaaggaccggttaacgtccgtaggttacctaacgttcccgttaggtttacngttacccgg

SEQ ID NO: 46248 - DNA, 563 bp, Homo sapiens
  misc_feature: GYAE6OF02HEOQQ.27.57.F02.1.454.CMB.1.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
  modified_base (549)..(549): a, c, t, g, unknown or other
  misc_feature (549)..(549): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccnccagactccgaggggaaggggctgggagttcgtggccaanataaaccaagagtaggaaggtaaaagaaaactagtagtacggtaacttcgtagtagaagggccgtattcaccatctaccagacgaacaacgccaaagaacgtcaactagtactctagacaaatcgaaacagacctagagagccgaagacacgactgtatactacgtgtcgacgaagacgtactaccgtagtcctaagtttcccgtnttttacgattccgg

SEQ ID NO: 46249 - DNA, 610 bp, Homo sapiens
  misc_feature: GYAE6OF02HKG90.27.57.F02.1.454.CMB.1.raw
  modified_base (306)..(306): a, c, t, g, unknown or other
  misc_feature (306)..(306): n is a, c, g, or t
  modified_base (335)..(335): a, c, t, g, unknown or other
  misc_feature (335)..(335): n is a, c, g, or t
  modified_base (597)..(597): a, c, t, g, unknown or other
  misc_feature (597)..(597): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggtacttcacctttagtagttattggatgagcgtgggtccncagactccgaggggagggctggagttcgngaccaacataaaccgaagagtagggaagtaaaagaaactagtaggtagtactcgtaggtaggaacgggccgtattaccaccattcctaccaaggacgaaccaacgaccaaagaacgtccaacttagttactcgtacgaactaaacgtagaaaccacgaccgtagggaacgaccggaccggtaagggaccgtacggacttagtaacttaccgtagtggtacggacgtaagacgtactccgttagtcctaccgtttcccggttntttagacttccgg

SEQ ID NO: 46250 - DNA, 635 bp, Homo sapiens
  misc_feature: GYAE6OF02F8N1B.27.57.F02.1.454.CMB.1.raw
  modified_base (335)..(335): a, c, t, g, unknown or other
  misc_feature (335)..(335): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcgtgggtccgcgagactccgagggaaggggctggagttcgnggccaacataaaccaagatagggaagtaaagaaaactagtgtaggacttcgtgtacggaagggcccgtaattccgacctatcctccaaggtacgaccaacgaccaaagaacgtcaacttgtaatctagacaaatacgaaacgacgtacctaggaacgaacgggacccggtaaggtaaccgaaccggtacttacgggttaacttaccgttaacgtggttacggaccggtaacggtaggaacctttaccgtaacggttccttaccgttttccccgggttacttttttaggactttacccggg

SEQ ID NO: 46251 - DNA, 611 bp, Homo sapiens
  misc_feature: GYAE6OF02GVSPQ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttttagaaggtgtccagtgtgaggtgcaactggtggattctggaggaggtgtggtccagcctggagaatccctgagactctcctgtgcagcctctggattctacctttagtagtttattggatgagtcgtgggtccgccacggacctaccgaggggaagggcgtagggagttcggtggaccaaacgaactaaaccgaagagtagggaaaggttaaaagaaaacgtagtagtaggactcgtaggtaggaacgggaccgtagttccaaccactactaccagacgaacaacgaccaaagaacgtactactagtactactacgtacaaagtagaacgacgaccgtagagacgacggacgacgacggactacgtactacgtacgtgtcgacgagagtactccgtacgtacaccgtttttttttccgacgttttacgtagttaccg

SEQ ID NO: 46252 - DNA, 770 bp, Homo sapiens
  misc_feature: GYAE6OF02JM2GQ.27.57.F02.1.454.CMB.1.raw
  modified_base (747)..(747): a, c, t, g, unknown or other
  misc_feature (747)..(747): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttattggatgagtcgtcggggtccaccgagacctccggaggggaacggggtctagggtacggtttcggtacggaccaaacgaacgttaaaaccgaaggtaacgtaggggtaaagggtaaaaacgaaaaacttagtaggtacggtaaccttcgttaggttaacgggaaacggggtacccgtaatttacccgaaccctacgttacctacccggaaaggtaaaccggaaaccgaaaacccggtaccgaaaaacggtaaacgttacccgtaaacgttacggttaaacttccgtaacggaaaccttaaagtaaacggaaaacctacggtaacccgttaaggaaacgggaaccgacccgggtaaaggaacccgaacgggtaccgttaagttaacgttaccgtaccgtttagggacgtaccggtaaaggtaacgtcgttacccgttagtacccgttacctttaccgggttntttttaccgggactttacccggg

SEQ ID NO: 46253 - DNA, 612 bp, Homo sapiens
  misc_feature: GYAE6OF02HXYOL.27.57.F02.1.454.CMB.1.raw
  modified_base (307)..(307): a, c, t, g, unknown or other
  misc_feature (307)..(307): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgtgctattttagaaggtgtccagtgtgaggtgcaactggtggattcgtggaggaggtgtggtccagcctggagaactccctgagacctctcctgtgcagcctctggacttctacctttagtagttattggatggagctgggtccncagactccgaggggagggctggagttcgtggaccaaacaataaaaccaagtagtagggaaaggtaaaagaaactagtgtaggtactcgtggaggaacgggacctattccaacgtatcctcaggacacaaacgacaagagtacagttgtactcgtaagactaaaagtcgaaacgacgacctaggaacgaccggaaccggaagggtaaccgacgggtcttaagtaaccgttactacggttaggtcggaacggtagaaacgttacctcggtacgtactacctttccgggttacttttaggactttcgg

SEQ ID NO: 46254 - DNA, 618 bp, Homo sapiens
  misc_feature: GYAE6OF02JFJZ4.27.57.F02.1.454.CMB.1.raw
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttccttgttgctatttagaagtgtccagtgtgaggtgcaactggtggattctggaggaggtgtggtccagcctgganaatccctgagacctctcctgtgcagcctgtggacttccacctttagtagttattggatcggagtcgtgggtccncgacgactccgaaggggagggctgggacttcggcgaccaanactaaaccagagtaggaagtaaagtaaactagtgtaggactcgtaggtaggaacgggccgtattacaaccgtatcctaccgaagtacgaacgtaaaccgaccgtaaagtacgtcaaccgttgtaactcgtcgaactaaatcggaaacgcgtacctagggacgaccggacgtaacgccgacggtcttagtaactacgtgtaggtacggacgtaaggtactaccggtttacccgaagttccctaaccggtttccctagttttcgtactccggg

SEQ ID NO: 46255 - DNA, 628 bp, Homo sapiens
  misc_feature: GYAE6OF02HLONI.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaatccctgagactctcctgtgcagcctctggtattcacctttagtagttattggatgagctgggtccgcagctccaggggacgggctggagttcgcggccaacaactaaaaccaagatgggaaaggtaaaacgaaaacgttagtaggtggaactcgttagtagggtaaaggggcccgtaattcccaacctacgtcctacccgagaacgaaccgaacgcctaaaagaacgtcaattcggtactcgtacgacaaaatggaaacacggacccttagaaccggacgtacccgggaaggaccgacgggtctacggttataccgttacgtggtcggtacgagaagtactaccgttacgttaccgtacgttttaccccggtcttttagacctttccgg

SEQ ID NO: 46256 - DNA, 601 bp, Homo sapiens
  misc_feature: GYAE6OF02FFNJU.27.57.F02.1.454.CMB.1.raw
  modified_base (347)..(347): a, c, t, g, unknown or other
  misc_feature (347)..(347): n is a, c, g, or t
  modified_base (491)..(491): a, c, t, g, unknown or other
  misc_feature (491)..(491): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctggtttcctgttgctattttagaaggtgtccagtgtgaggtgcaacgtggtggattctggaggaggtgtgggtccagcctggagaactccctgagactctcctgtgcagcctctggtattcctaccgtttagtagttattgggatgagtcgtgggtccgcagacctccgagggagggcgtggagttcgtggaccaanaataaaccagatagggaaggtaaaagaaaactgtggtaggactcgtagtaggaacgggctactccgaacctagtcctaccgaaggaacgaacctaaaccgaccaaaggtaacgtacacttgaactttcagaccaaatcgaaacngaccgtagacgacggaccgaggacctacggcttagtacttacgtacgtggtacgcgaagacgttactaccggtagtccctaactttcccggtcttttacgagttacccgg

SEQ ID NO: 46257 - DNA, 692 bp, Homo sapiens
  misc_feature: GYAE6OF02I6ZOP.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagccgtggagaatccctgagactctcctgtgcagcctctggactttcaacctttagtagttattggatgagcgtgggtccgcagactccgaggggaagggctgggtagttcgtcggacctaacaactaaaccaagagtagggaaggtaaaagaaaacttagtaggtaggtactacgtaggtaggaacgggaccgtagttaccgacccgtaatacccgtaccgaaggaacgaaacgaaaccggaccaaaaggaacgttaccgaacttggtaaacttcgttacgaactaaaagtccgaaacacgtacctaggaacgacggaccgaaaggaaccgtacggtaccgttaacgttaagtaccttaccggtaggttccggaacggttaaacggtacggtaaacttacccgttaaggttcccttaaccggtttaccccgggttttactttttaccggtaactttacccggg

SEQ ID NO: 46258 - DNA, 680 bp, Homo sapiens
  misc_feature: GYAE6OF02GUO7J.27.57.F02.1.454.CMB.1.raw
tcagagcgtcgtctcacgaccggtgctcgatttagctcgatatagttggggtttgaggtctcagagaggagccttagccctggactccaaggcctttccacttggtgatcagcacggagcacagaggaccccaccatggaactggggctgagcgtggtttcctgtagctatttagaggtgtccagtgtgaggtgcaactggtggattcgtggaggaggtcgtggtccaggcccgtggagaactcccgtgacgactctcctagtgcagcctgtggtacttccgtacctttagtagttattggactgacgcgtacgggtccgacctaggacctccggaggggtaacgggctaggacgttcggtcggaccaacaataaaccgagagtggaaaggtaaacgaaactagtggtaggaacttcgtaggtaggaaacggggccgtaattccgaaccgtactccgtaccgaagtaacgaaccgaaaccgtaccgaaacggtaacgtaccgaacgttacgttacttacgtacgaactaaagttacgaaaccgtacgtacccgtaggaacggtacggaccgggaacgggaccggaacggtcgtagtactaccgtagtcggtacggtaacgacggtaacgtacgttaccgtacgttcctaccgtttccgtacctttttaggaccttaccgg

SEQ ID NO: 46259 - DNA, 720 bp, Homo sapiens
  misc_feature: GYAE6OF02GYUEV.27.57.F02.1.454.CMB.1.raw
  modified_base (347)..(347): a, c, t, g, unknown or other
  misc_feature (347)..(347): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattctacctttagtagtttaagttggatggagcgttcgggtccgccagacctccgaggggaacgggctgggagtttcggnggaccaaactactaaaaccgaagtagtaggaaggtaaaagaaaaccttagtacggtggaacttcgtaggttaggaaacggggcctaagttccgaactactctacccgagaacgaccaacgaccgaaggtaagtccaacgttgtaacttcctagaactaagttacgaaaacgtcgtaacccgttagaacggaccgggtaacccggaacggggaaccgtaaccgggtaccgttaacgttaaaccttaccgtttaaccggtagggttaaccgggaaccggtaaagggtaacgttaaccctttaccggttaaaccgtttccgttaaaccggtttttccccggttttaacgttttttaccgggaaattttccccgggg

SEQ ID NO: 46260 - DNA, 619 bp, Homo sapiens
  misc_feature: GYAE6OF02G1ES3.27.57.F02.1.454.CMB.1.raw
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaaatggtggattctggaggaggtgtggtccagcctggagaatccctgagactctcctgtgcagcctntggattcacctttagtagttattggatgagcgtgggtccncagactccgagggagggctggagttcgtggaccaacataaaccaagatgggaagtaaagaaactagtgtaggactcgtgtaggaacgggcctattcacctactctaccagtacgacaacgaccaaagaacgtacaacgttagtactcgtagacaaagtagaactacgacctaggaacgacggacccggaaggaacccgacggtaccgtacgttaacttaccgttacgtacggtacggaccggtaaggaacggttaacgttacccgttaaggttcccttaacgtttcccggttacttttttcggacgtttacccgg

SEQ ID NO: 46261 - DNA, 909 bp, Homo sapiens
  misc_feature: GYAE6OF02HZM8Q.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaactggtggattcgtgggaggaggtgtggtccagccgtggagaatccctgagactctcctgtgcagccttcgtggtactttcctaccttttagtagtttaagttggattggagtcgttcggggtcccgaccgacgacctaccggaaggggaacggggtcgttagggtacggtttccggtacgggacccaaaacgtaaacgttaaaaaccgaaaggtaacggtaggggtaaaacgggttaaaaaacgtaaaaaaccgtttaaggttacggttaacgggtaaccgtttacgtttacggggttaaacggggaaaccgggggtacccgtttaaacgttttacccgaaacccgttaaccgtttaccccggtaacccgtaaaagggaaacccggtaaaacccgaaaacccggaacccggtaaaaacggtaaacggttaacccgtaaacgttacggtttaaacttcccggttaaaccgaactaaaaagtaccggtaaaacgaccgttacccgtaaggaacgggtaaccgacccgggaaacgggtaacccggaaccggggtaaccgtttaaggttaaacccgttaaccgtttaaccggttcgggtaaccgggtaccgggtaaacggtaaaccggttaccgttacccggttttaaccggtaaccgtttaacccggtttttaccccggttttaccggttttttcgaacccgtttcccggg

SEQ ID NO: 46262 - DNA, 778 bp, Homo sapiens
  misc_feature: GYAE6OF02JW8Q5.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatccggaactggggctgagctgggttttccttgttgctattttggaaggtgtccagtgtgaggtgcaactggtggattcgtggaggaggtgtggtccagcctggagaatccctgagactctcctgtgcagcctctggtacttcctaccgtttagttagttattggtatgagtcgtcgggtccgccgagaccgtccggaaggggaacggggcgtagggtagttcggtcgggaccaaacaacgtaaaacccaaggtaacgtaggggtaaaggtaaaaagtaaaaacctagttaggtaggtaactacgtggtaacgggaaacggggtcccgtaagtttaccgaacccgtacttacccgtaaccgaacgggaacgtaaacccgaaaacccggacccgtaaaaaggtaaaccgtacccgtaaacgttacggttaacgttaccgttaaaccggaacctaaaaagttaaccggaaaccgtaacgtaccccggttaagggaaaccggtaaccggacccgggaaccggtaaccgaccgggtacgtaacgttaacgttactaccggtttagtacggggtaacgaaggtaacggtaaccgttaccgttaacggttaccgtaccgtttcccggttcgtttttacggacgtttcccgg

SEQ ID NO: 46263 - DNA, 686 bp, Homo sapiens
  misc_feature: GYAE6OF02I2I5Q.27.57.F02.1.454.CMB.1.raw
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctgganaatccctgagactctcctgtgcagcctntggtattcacctttagtagttattggatcgagcgttcgggtccnccgagtacctccgaaggggaacgggctagggagttcggtggaccgaaactataaaaccgaagatagggaagtaaaagaaaactagtagtaggtaactcgtaggttaggaaagggtcccgtaagttaccaaccctacgtaccttaccgaaaggtacgaaccgtaaaccgaacccgtaaaaggaaacgtcctaaacgttagttaacgttccgttagaaacctaaaacgtacgaaaccgtaaggtccccgtaaggtaaacggaggacccggaaagggaccaaccgggtctaagtacttacgtacgtaggttcgaacggaggaacgtacgttaccgagttaacccttacgttacccggtttacgtttttacgacgtttaccgg

SEQ ID NO: 46264 - DNA, 528 bp, Homo sapiens
  misc_feature: GYAE6OF02GOOKC.27.57.F02.1.454.CMB.1.raw
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (454)..(454): a, c, t, g, unknown or other
  misc_feature (454)..(454): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccgccagactccaggggaagggctggagttcgtggccaacataaaccaagataggagtaaagaaactatgtgactntgngaaggccatcaccatctacagagaccaacgaccaaagaacgacacttagtatcgtgacaatgaacagcctgagngaccgaggacacggactgtatactacgtgtcgcgaggacgattccgtatcgatttcccggtcttttgacttccg

SEQ ID NO: 46265 - DNA, 657 bp, Homo sapiens
  misc_feature: GYAE6OF02G8TUB.27.57.F02.1.454.CMB.1.raw
  modified_base (420)..(420): a, c, t, g, unknown or other
  misc_feature (420)..(420): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagacctccgaggggaacggggctggagttcgtggaccaacaataaaccaagagtagggaaggtaaaagaaaactatggtaggactcgttagtaggaacgggccgtattccaaccnctacctaccgagacgaccaacgaccgaaagaacgtccaacgttgtactcgtagaccaaagtcgaaacacgtacccgtagaacgaacggaccggaaggaacccgaacggaccgttagttaacgttaccgttagttcgggttaacggacgggtaaacggtaacgtaccttttaacccggtacggtttaactaaccggtttttccccgtttacgttttttaccggtaccgtttacccggg

SEQ ID NO: 46266 - DNA, 661 bp, Homo sapiens
  misc_feature: GYAE6OF02GNR7Q.27.57.F02.1.454.CMB.1.raw
  modified_base (354)..(354): a, c, t, g, unknown or other
  misc_feature (354)..(354): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctcgtggattctacctttagtagttattggatggagcgttcgggtccgcagacctccgaaggggaagggctagggagttcgtcggacccaaanactaaaaccgagagtagggaaggtaaaagaaaacgttgtacggtaggacttcgtaggtaggaacggggccgtaattaccgacctattcctacccaaggacgaaccaaaccgacgaaaagaacgtaccaacgttacggtacttaccgtagtaacaaagttacgaaaccacgtaccgtaggaacgtacggaccggaacggaacgaccggtctagttaccttacgtacgttggacgaccgtaaggtaccgtacgtttaccgtacggttaccttaaccgtttcccgggttactttttcgacgtttacccgg

SEQ ID NO: 46267 - DNA, 624 bp, Homo sapiens
  misc_feature: GYAE6OF02IBBG4.27.57.F02.1.454.CMB.1.raw
  modified_base (311)..(311): a, c, t, g, unknown or other
  misc_feature (311)..(311): n is a, c, g, or t
  modified_base (612)..(612): a, c, t, g, unknown or other
  misc_feature (612)..(612): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtcgcacgcctcgtggacttcctacctttagtagttattggatgagctgggtcccncagactccggagggagggctggagttcgtcggaccaacaataaaaccaagagtaggaaagtaaaagaaaactagtagtaggacttgtacggtaggaacgggccgtattccaactctcctaccgagtacaacgaaaccgaccaaagtaacgtactaacgtagttactactagaacctaaaagtcgaaacgtaacgaccgtagaacggtaccggaccggtaacggaccgtacgggcttaagacttacgttacgtggtaacggacggagaaccgttactccgtacgtccgtatttccccggttntttagcttccgg

SEQ ID NO: 46268 - DNA, 632 bp, Homo sapiens
  misc_feature: GYAE6OF02IDOH5.27.57.F02.1.454.CMB.1.raw
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
tcagagcgtcgtctcacgaccggtgctcgatttagctcgatatagttgggtttgaggtctcagagaggagccttagccctggactccaaggcctttccacttgggtgatcagcacggagcacagaggacccaccatggaactggggctgagctgggttttcctgtgctattttagaagtgtccagtgtgaggtgcaactggtggattctgggaggaggtgtggtccagccgtggagaatccctgagactctcctgtgcagcctntggattcacctttagtagttattggatgagtctgggtccnccgagacctcgaggggagggtctggtagttcggtggaccaanaactaaaccagagtggaaagtaaaagaaactgtaggtacgactacgtaggtagggaacggtcctaagttccaacctagtcctacccgaagaacgaacgaaccgacgaaaggtaactaccaacgttgtaactcgtaacgaacaaatacgaaactcggtaccaggaacgaacgaccggaaagtaaccgcgggtacttaacggtactaccgttacgtggtacggaacggaggtaactaaccgtccgttaacgtactaccgttttcccggttattttcgaacctttcggg

SEQ ID NO: 46269 - DNA, 677 bp, Homo sapiens
  misc_feature: GYAE6OF02HFPL2.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtattagttggatgagcgtgggtccgcagactccgaggggacgggctgggacgttcggcggaccaaacgaataaaccaagagtagggaaaggtaaaagaaaactatggtaggactacgtggtaggaaacgggtccgtattaccgaacctattcctaaccgaagtaacgaaccaaaccgaccgaaagaacgtacaacgttggtaacttccgtagaacctaaaagtcgaaaccgacggtacccgtaggaacggaccggaacccgggtaacggaacccggtaacggtcgttaagttaacttacccgttaacggttcgggtacggacggtaacggtagtaaccgttaccgttaacgttcccttaaccgttttccccggttacttttttacggactttcccggg

SEQ ID NO: 46270 - DNA, 761 bp, Homo sapiens
  misc_feature: GYAE6OF02F94S2.27.57.F02.1.454.CMB.1.raw
  modified_base (749)..(749): a, c, t, g, unknown or other
  misc_feature (749)..(749): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaatccctgacgacctcctcgtgtcgcgcgtcctgtagtacttacctttaacgttaggttagtttagtaggtagtaggacgtcgggtccgggtcccgacgtaaccgtaccgtacggggaagggggtacgggtcggtagggttacggttcgggtaccggaaaccaaacgtaaaaccgtaaaaccgaaggtaagggtaacggggtaaaaaggtaaaaacgtaaacttaggtaggtaacggtacttacggtaggtaacggggtaccggtaccgtttacttacccgaacttaccgttaccccaacggaagtaaccgaaaccgaccgtaaaccggaaaggtaccctaccgttagttaacgttccttaggtaaacgaactaaacggtacgaaccgtacgtaccggtaagacgggacccgaacgggaccgaaccggcggtacttagtacttacgtcgtggaacggaggtaacgtaacttaccgttacggtaactccgttttaccgtccgttttacgttanaccgtttccggg

SEQ ID NO: 46271 - DNA, 699 bp, Homo sapiens
  misc_feature: GYAE6OF02IPYW5.27.57.F02.1.454.CMB.1.raw
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
  modified_base (346)..(346): a, c, t, g, unknown or other
  misc_feature (346)..(346): n is a, c, g, or t
  modified_base (371)..(371): a, c, t, g, unknown or other
  misc_feature (371)..(371): n is a, c, g, or t
  modified_base (529)..(529): a, c, t, g, unknown or other
  misc_feature (529)..(529): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaactggtggattctgggaggaggtgtggtccagccgtggagaatccctgacgactctcctgtgcagtcctcnggtattcacctttagtagttattggatgagcgtggtccncagcctaccgaggggaggctgagttcgtgaccaatanaaaccgagagtaggaaacggtaaanaaaacttagtcggtggaacttcgtaggtaggacgggaccgtaatccaaccgaacttccgtacgaagtaacgaacccgtaaagacccaaaaggtaactacggaccgttaacgttacgttaccgtagaacgtaaaactacggaaacgtaccgggtaaccnggtaaacggaccggaacgggtaaccgaacggtaacccggtcgttaagttacgtaacccgttagtccggggtagtaccggggaaaacttcggaaaacccgttccgttaaacggtttacccttaacggttttaccccggggtttactttttttacgggccgtttaacccggg

SEQ ID NO: 46272 - DNA, 639 bp, Homo sapiens
  misc_feature: GYAE6OF02GVYAD.27.57.F02.1.454.CMB.1.raw
  modified_base (266)..(266): a, c, t, g, unknown or other
  misc_feature (266)..(266): n is a, c, g, or t
  modified_base (308)..(308): a, c, t, g, unknown or other
  misc_feature (308)..(308): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctgggaggaggtgtggtccagcctggagaatccctgagactctcctgtgcagcctntggattctacctttagtagttattggatggagcgtgggtccnccagacctaccggaaggggaaggggctagggtacgttcggtcggacccaaacaactaaaaccaaggagtaggggaaagtaaaaagaaaactagtggtagacttcgtggtaggaaacgggcctaattccacctatcctaccaagacgaacaaacgacgaaagtaacgtctaagttcgtatcgtagaactaaagtacgaaaccagtacccgtaggaacgtacgggacccgaacggaaccgacggtacgtacgttaactaccgttacgtggtacggacggaagtaacgtacgtaccgttaggtcctaacgtttcccgtacttttagcgttaccg

SEQ ID NO: 46273 - DNA, 790 bp, Homo sapiens
  misc_feature: GYAE6OF02G91J5.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctggaggaggtgtggtccagcctggagaactccctgagactctcctgtgcagcctcgtggattcacctttagtagttattggatgagtcgtgggtccgccagacgtccggaaggggaacggggcgtagggacgtttcgggacgggacccctaaaacgaaacgttaaaaacccgaaaggtaacgtaggggtaaaagggtaaaaacgtaaaaacgtttaagtaggtaggtaaccttacgtagggttaacgggaaacgggggtccctaaagttacccgtaacccgtacgtacccgttaaccgtaaacggaaacggtaaacccgaaaacccggaacccgtaaaaccggtaaacgtaacccgtaaaccgttacgttaacgttaccgttacgtaaactaaaacgtaacgaaacgaacgtacccgttaacgaacggtaacggaacccgggtaacgggaaaccggtaccggtacgttaacgttaaacgttaccgttaacgttaggttacggacggtaaacggtacgtaacgttaccgttaacgttcgtaaccgtttacccggtttccgttttacgtaacctttcccgg

SEQ ID NO: 46274 - DNA, 607 bp, Homo sapiens
  misc_feature: GYAE6OF02HXYFQ.27.57.F02.1.454.CMB.1.raw
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (587)..(587): a, c, t, g, unknown or other
  misc_feature (587)..(587): n is a, c, g, or t
tcagagcgtcgtctcacgaccggtgctcgatttagctcgatatagttgggtttgtaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcagcctctggattcactttagtagttatggatgagtcgtgggtcccgccagctccgagggaaggggctgggagttcgtggccaaanataaaccaagcgtagggaagtaaaanaaactntggagactactggaggaacgggaccgtattccactactctacaagacgaacgaaccgacaaagaagtacacttacggtatcgtagacaaatacgaaacacgtaccagtaacgacggtaccgaaggaccgacggtacgtagttaacgtaccgtacgtcggtacggaccgaaggaacgtaccgtaccgttacgtactaacgttttaccccggtntttttaccgacgtttaccgg

SEQ ID NO: 46275 - DNA, 594 bp, Homo sapiens
  misc_feature: GYAE6OF02GJAW3.27.57.F02.1.454.CMB.1.raw
  modified_base (340)..(340): a, c, t, g, unknown or other
  misc_feature (340)..(340): n is a, c, g, or t
  modified_base (474)..(474): a, c, t, g, unknown or other
  misc_feature (474)..(474): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaagtgtccagtgtgaggtgcaactggtggattctggaggaggtgtggtccagcctggagaatccctgagactctcctgtgcagcctctggattctacctttagtagttattggatgagcgtgggtccgcagactccgagggaagggctggagttcgtggccaanataaaaccgaagactaggaaggtaaaagaaaacgtagtagtggactacgtggtaggaaggggccagttcaacctatcctccaagacgaacaaacgaccaaagatacaattagtatctagaacaaagtcgaaacncgaccgtagagaacggacccgagggaaccaacgggcttagtacttacgtacgtaggtggacgaaggacgtaacttaccgtacgtaccttacgtttcccggttacttttcggatttcccgg

SEQ ID NO: 46276 - DNA, 571 bp, Homo sapiens
  misc_feature: GYAE6OF02GASVZ.27.57.F02.1.454.CMB.1.raw
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
  modified_base (453)..(453): a, c, t, g, unknown or other
  misc_feature (453)..(453): n is a, c, g, or t
  modified_base (475)..(475): a, c, t, g, unknown or other
  misc_feature (475)..(475): n is a, c, g, or t
  modified_base (495)..(495): a, c, t, g, unknown or other
  misc_feature (495)..(495): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctatttagaaggtgtccagtgtgaggtgcaacgtggtggattctgggaggaggtgtggtccagcctggagaatccctgagactctcctgtgcagcctcgtggattctacctttagtagttattggattggagtcgtcgggtccgcagactccgaggggaacgggctgggtagttcgtaggaccaacactaaaccaagagtagggaaggtaaagaaactgtggtaggactntggtagaagggccattccactatccncgaagacgacaacgacaaagacgtcacgttntactctagactaaagtcgaacngcctagagacgacgagaacncggacttagagttacctcgtgtacgacggtaagacgctacgtatcgttaacgtttcccgtattttcgacttaccgg

SEQ ID NO: 46277 - DNA, 825 bp, Homo sapiens
  misc_feature: GYAE6OF02I30K1.27.57.F02.1.454.CMB.1.raw
  modified_base (267)..(267): a, c, t, g, unknown or other
  misc_feature (267)..(267): n is a, c, g, or t
  modified_base (329)..(329): a, c, t, g, unknown or other
  misc_feature (329)..(329): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttcctgtgctatttagagtgtccagtgtgaggtgcacgtggtggattcgtgggaggaggttgtcggtccaggtccgtggagaactcccgtgacgacctcctccgtgtcgacngccttcgtggtaacttcctaaccgtttagtacgtttagtggtattggagtcggtcgggcccnccgagtaccgtccgaggggacgggtctgggtacgttcggtcggaccaacgtaactaaaccgaaggacgttagggtaaaggtaaaacgtaaaacgttggtacggtacgggtaaccttcggtttacggaaggggtaaaccggggttaccctaagtttaccccggaaccgtacgttaccccgtaaccggaaacggtaacgtaaaccccgtaaccgtaaacccggaaaacggttaccggtaactaccggttaagttaccttcgtaaagtaaccgaaaagttccggtaaaccgtacggtaccccgttaagggaaaccggtaacgggtacccggggaaaccgggtaaccgtacccgggttaacgttaacggtttaacgtaacccggtttaggtacgggttaccggaaccgttaacgggtaacccttaacggttacccgtttaacgggttacccctttaaccggtttcccctttacggtttttaaccggcttttaaccccggg

SEQ ID NO: 46278 - DNA, 773 bp, Homo sapiens
  misc_feature: GYAE6OF02H7I7D.27.57.F02.1.454.CMB.1.raw
  modified_base (176)..(176): a, c, t, g, unknown or other
  misc_feature (176)..(176): n is a, c, g, or t
  modified_base (188)..(188): a, c, t, g, unknown or other
  misc_feature (188)..(188): n is a, c, g, or t
  modified_base (198)..(198): a, c, t, g, unknown or other
  misc_feature (198)..(198): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (439)..(439): a, c, t, g, unknown or other
  misc_feature (439)..(439): n is a, c, g, or t
tcagagcgtcgtctcacgaccggtgctcgatttagctcgatatagttgggtttgagtctcagagaggagccttagccctggactccaaggcctttccacttggtgatcagcacggagcacagaggacccacatggaactggggctgagcgtggtttcgtgtagctatttagaggtncagtgtgaggtncatggtgctntggaggtaggtgtggaccagccgtggagaatcctgagacctntcctggacgcacgcctntaggtaattctaaccgtttgtagttagtggtaactgggaatcgtttaggccggtacctaagccgtaccggagggggaaccgggtctgggtaacggttacgtcgggaacccaataaacgtaaaaccaaaggcgttaaaggggaaacggttaaaacgaaaaactacgttgggttaaggaacctnttagggttaaggtaaccgggaccgtttaattacccggaacttactttaccgtaaccgtaagtaaaccgggaaaccaccgggttaaacaaaccgggtaagtttacccaaggttaaggttaaccctttggtaaaccgtaaaacgtaaacgtaaccgtaacggtaacggtaaccggtaacggtaacggaaccggaaccgggaaaccgggtaaccggtaacggtaacggttaacggttaaccgttaaccgttaaccggttacggtaacggtaacggtaacggtaacgtacgtacgtacgttacgttaccgttaccgtttacgtttacgttacgtacgg

SEQ ID NO: 46279 - DNA, 604 bp, Homo sapiens
  misc_feature: GYAE6OF02GHWPD.27.57.F02.1.454.CMB.1.raw
  modified_base (374)..(374): a, c, t, g, unknown or other
  misc_feature (374)..(374): n is a, c, g, or t
  modified_base (392)..(392): a, c, t, g, unknown or other
  misc_feature (392)..(392): n is a, c, g, or t
  modified_base (454)..(454): a, c, t, g, unknown or other
  misc_feature (454)..(454): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagagtgtccagtgtgaggtgcaactggtggattctggaggtaggtgtggtccagccgtggagaactccctgagactcctcctgtcgcagcctgtggtattctacctttagtagttattggatgagcgtcgggtccgcacgactccgaagggacgggcgtggtagttcgtggaccaacataaaccaagataggaagtaaanaaactagtaggagtactntaggtggaacggccgtaatccacatctaccgagacgaacaacgaccaagaacgtacacgttntatcgtagaactaagtacaacgacgactagagacggaccgacgggacacggtacgtagtaacttactacgtggttacggacgtaaggtacgtacgttacgtacgttaccgtaccgttttacccggtacgtttttagtaccgtttaccggg

SEQ ID NO: 46280 - DNA, 553 bp, Homo sapiens
  misc_feature: GYAE6OF02GBMSG.27.57.F02.1.454.CMB.1.raw
  modified_base (299)..(299): a, c, t, g, unknown or other
  misc_feature (299)..(299): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggtttcctgttgctatttagaggtgtccagtgtgaggtgcaactggtggattctggagaggtgtgggtccagcctggagaactccctgagactctcctgtgcagcctctggattcacctttagtagttattggatgagctgggtccncagactccgagggagggctgggagttcgnggccaanataaaccagagtggaaggtaaanaaaactgtagtagactcgtgtagaacgggtccaattcgaccatctaccagacgacgaacgacccgaagacgtcaacgttgtaactctagacaaatcgaaacagcctagagtacgccgaaggcacggtctagtactactactggtgacgtagtaccgtatccgtacgtcctaagttccgtacttttagacttacgg

SEQ ID NO: 46281 - DNA, 691 bp, Homo sapiens
  misc_feature: GYAE6OF02IU1SN.27.57.F02.1.454.CMB.1.raw
  modified_base (321)..(321): a, c, t, g, unknown or other
  misc_feature (321)..(321): n is a, c, g, or t
tcagagcgtcgtctcacgaccggtgctcgatttagctcgatatagttgggtttggggtctcagagaggagccttagccctggactccaaggcctttccacttggtgatcagcacggagcacagacggacccaccatggaacgtgggctgagcgtggtttcctgtgctatttagaggtgtcagtgtgaggtgacaacgtggtggtattcgtgggaggaggttgtggtccagccgtggagaactccgtgagccttctcctgtcgcagccctgtaggtattcctacgtttagttagttattggaatgtagccgtcggggtaccnccgtagtaccgtcggaggggagggtcgtgggtagttcggacggacccaaataacgtaaaaccgaagaggtaagggtaaagtaaaaagaaacgttagtggtaacggccttagtaggtaacggaacgggtcctaacgtttccgaaccgtatttaccgaacgaacggacgaaaccgtaacgaccgaaaaggtaaccttcgtaacgttagtacttcgaaggaacctaaagtacgaaaccgcgtaccgaggaaccgtcgaaccggtaaggtaacccgacggtctaagtacgttaaccaggttgacggtacgaacggtacgactttaccgtaggtcttaaccgtttcccggttattttacgcgtttcccggacggg

SEQ ID NO: 46282 - DNA, 605 bp, Homo sapiens
  misc_feature: GYAE6OF02GPWO0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtgcagcctctggattcctacctttagtagttattggatgagcgtggggtccgccagacctccggaaggggaacgggctgggagttcggtggaccaacaataaaaccaagagtagggaaagtaaaagaaaactagtaggtggactctggtaggaagggaccgattccaccatcctaccagacgaacaacgacgaaagaactccaagttgtactacgtagaactaaatagaaaccagacctagagacggaccggaagaccgacggtacgtacgtatactacgtggtggacggaaggtacgtacttaccggtagttccgtaacgtttccccgttgtttttacgacgttccgg

SEQ ID NO: 46283 - DNA, 945 bp, Homo sapiens
  misc_feature: GYAE6OF02IGHXE.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaacgtggtggatttcgtgggagggaggttggtggtccaggtccgtggaagaactcccctgacgtactctcctgtgcacggtcctctggtacttcctaccgttttaggttagtttagttggatggagtcggttcgggtcccgaccgtaggtacctacccggaagggggtacggggtcgtggggtaacgtttccgggtacggacccctaaaacgtaacgtaaaaaacccgaggtaacggttaaggggaaaacggttaaaaaacggtaaaaaccgtttaggtaacgggttacggtaaccgtttaccggttaggggttaacgggaaaccgggggtcccgttaacgtttaacccgaaaccccgttacgttaccccgttaaccccgaaaagggtaacccgaaacccgtaaaaacccggaaccccggtaaaaaagggttacccgttaacctaaccggttacggtttaaaccgttacgtaacgggtaaaacctaaaacggtttccggaaaaacctaaccgggttacccggttaaagggaaaccggggtaacccgggtaacccgggaaaacgggtaccccgggaaagggttttcccttaaacggttttaaccgtaaccccgtttaaacggtttcggggtaaccgaaccgggggttaaacgtaaacggtttacccgttaccggtttaaccggtttaaccctacccgggttttttaaccccggttttcgtttttacggaaccccttttcccggggggg

SEQ ID NO: 46284 - DNA, 743 bp, Homo sapiens
  misc_feature: GYAE6OF02IK3E8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtcagtgtgaggtgcaactggtggattcgtggaggaggtgtggtccagcctggagaatccctgagctctccgtgtcgcacgtcctcgtaggtactttcgtaccttttagtagtttagttggatggacgtcgtcggggtcccaccgagaccgtccggaagggggaggggctagggacgttcggtcggacccaaacgtaactaaaaccgaaggtaacgtaggggtaaaaggtaaaaacgtaaaaacttagtaggtacggtacttacgtaggtaggaacggggtcccgtaagtttccaacctacgttaccctaccggaagaacggaaccaaaacccggaccgtaaaaggaaccgttactaaccgttagtacttcgtaagaactaaagtacggaaaccgagtaccgtaggaacgaccgggaccggaacggtaacccgaacgggttaccgttaagttaacctttaacgtaccgtttagggtacggaaccggtaacgtaacgggtacctttaacccggttagtccctttaacgggtttcccgtttactttttacggacgtttacccgg

SEQ ID NO: 46285 - DNA, 581 bp, Homo sapiens
  misc_feature: GYAE6OF02GU26V.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtcgcagcctctggattcacctttagtagttattggatgagctggggtccgccagacctccgaggggaggggctgggagttcgtggccaacataaaaccaagagtagggaaggtaaaagaaaactataggtaggacgtctaggtaggaagggccgaattccaccatctaccgaagacaacgaacgaccgaaagaacgtcacttagacttctagacaaatgaaacagcctagagaacgaccgaggaaccacggactgtaactacgtacgttcggtgacgaaggagactacgtacgtctacgttccgtacgtttttagactttaccgg

SEQ ID NO: 46286 - DNA, 787 bp, Homo sapiens
  misc_feature: GYAE6OF02J1EBX.27.57.F02.1.454.CMB.1.raw
  modified_base (265)..(265): a, c, t, g, unknown or other
  misc_feature (265)..(265): n is a, c, g, or t
tcagagcgtcgtctcacgaccggtgctcgatttagctcgatatagttggggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctntggattcacctttagtagttattggatgagcgtagggtccgcctagtaccgtacgaggggaaggggtcctagggacgtttcgggtacggaccctaaacaacgttaaaaccgaaggacgttacgggaaaggtaaaaacgaaaacttaggtacggtacggaacttacgtagggttaagggaaaccggggtaccgtaacgtttaccgaaacccttaacgtcccttaaacccggaaaggaacgtaaacgaaaccccggaaaccaaacgggtaaacggttaccctaacgttaacggtaactttaccggtaaccgaaacgtaaaaactaccggtaaaaccaacggtaaccccgtaaggaaccgggtacgtaaccccgggaaaggtaacccgaaccgggtcttaacgtttaaccgtacgttaaccgttcgggtaacggtaacgggtaacgtaagttaaccccgtttaccgttaaccggttaccttaaccggttttacccggtttaactttttacggaccctttaccggg

SEQ ID NO: 46287 - DNA, 594 bp, Homo sapiens
  misc_feature: GYAE6OF02H75EW.27.57.F02.1.454.CMB.1.raw
  modified_base (588)..(588): a, c, t, g, unknown or other
  misc_feature (588)..(588): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgttgctattttagaaggtgtccagtgtgaggtgcaactggtggattctggaggaggtgtggtccagcctggagaatccctgagacctctcctgtcgcagcctctggattcacctttagtagttattggatgagtctgggtccgccagacctccgagggaagggctggagttcgaggccaaagactaaaaccgaagagtaggaaaggtaaaagaaaactagtacgaggacttcgtaggtcggaaacggggcctaagttaccgaaccacgtcctaccgagacgaacgaacgaccaaagaagtacgtacgtagttactctagacaaatagaacgacgtactagacgacgaccggacgacgacgacgtagtacgtactacgtagtcggacgtagagtacgtacgtacgtactacgtttccgtcttttacgngttccg

SEQ ID NO: 46288 - DNA, 700 bp, Homo sapiens
  misc_feature: GYAE6OF02JALNG.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttccttgttgctattttagaaggtgtccagtgtgaggtgcaactggtggattctggaggaggtgtggtccagccgtggagaatccctgagactctcctgtgcagtcctctggacttctacctttagtagttagttggatgagcgttggtccgtccagaccgtccgaaggggaacggggctagggtaggttcggtcggaccgtaaactaactaaaacccgaagtacggtaggaaagggtaaaaacgaaaaattacgtggtacggactacgtagtaggaaacggtccgtaattaccgaaccagttctaccgaagtaacgaacaaaccgtaccgaaaagtaaacgtcaacgttacgtatccgtaagtaactaaagtacgaaacgacgtaccgtaggaagtaacggacccggtaagaacccgtacgggacttacggtaactaacccttaacggtacggtcggtaaccggtaaggaacgtaaccttaccggttaacggacccgtttaaccgttacccgggtttacgtttttacggaacctttccggg

SEQ ID NO: 46289 - DNA, 529 bp, Homo sapiens
  misc_feature: GYAE6OF02FVTPZ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaaggggctgggagttcgtggccaacataaaaccaagatggaaggtaaaagaaaactatgtggactctgtggaaggccattcaccatctcagagacaacgccaaagaactcactgtatctgacaaatgaaacagcctagagagccgaagacacggctagtactactactggtgcgagagactccgtagtctacgttccgtcttttgattccg

SEQ ID NO: 46290 - DNA, 690 bp, Homo sapiens
  misc_feature: GYAE6OF02JS8FL.27.57.F02.1.454.CMB.1.raw
  modified_base (280)..(280): a, c, t, g, unknown or other
  misc_feature (280)..(280): n is a, c, g, or t
  modified_base (487)..(487): a, c, t, g, unknown or other
  misc_feature (487)..(487): n is a, c, g, or t
tcagagcgtcgtctcacgaccggtgctcgatttagctcgatatagttgggtttgtaggtctcagagaggagccttagccctggactccaaggcctttccacttggtgatcagcacggagcacagaggacccaccatggaactggggctgagcgtgggttttccttgttgctattttagaggtgtccagtgtgaggtgcaacgtggtggatttcgtgggagggaggtcggtggtcccaggcctgggagaaatccctgagctctcctggtgcagcctctggnttctacctttagtagttattggtatggagtcgtcgggtccgccagtacctaccgagggggtaacgggctcgggtagtttccggcgacccaaacacgtaaaaccgaaagtagtacggggtaaagtaaaaacggtaaaactaggtcgtagggtaacttcgtgtacggaaacggggtcctacttacgaacctactctaaccgacggtaanaccgaaacgtaccgaaacggtaacgtaccaacgttagtacgttactacgaactaaacgtaacggtaaccgacgaccgttacggaagtacggaccggtacgggaacgacggtaccgtagtagttaccgtaacgtcggtaacggacggacgtaacgtacgtaccttaggttctaaaccgtttccgtccgtttttagactttccgg

SEQ ID NO: 46291 - DNA, 644 bp, Homo sapiens
  misc_feature: GYAE6OF02F5Y18.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctatttagaggtgtccagtgtgaggtgcaactggtggattctggaggaggtgtggtccagcctggagaactccctgagactctcctgtgcagcctctggattcacctttagtagttattggatgagcgtgggtccgcgacgacctccgaggggaacggggctgggtagtttcggtggacccaaacaactaaaccaagactagggaaaggtaaagaaaactgtgtaggactgtagtaggaacgggtccgattccgacctacgtcctccgaagtacgaaccgaaccgaaccgaagaacgtctaacgttagtacttaccgtagaactaaacgtacgtaaacgacgtacccgtaggaacggaacggacccggaaagggaccgaacggtaccttagtaacttacgtacggtggtacggacgaagggtaacgtcgttaacccgtagttcgttaacctttccggttaccgtttttgaccgtttccg

SEQ ID NO: 46292 - DNA, 693 bp, Homo sapiens
  misc_feature: GYAE6OF02GCTE8.27.57.F02.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattcgtggaggaggtgtggtccagcctgganaactccctgagactctcctgtgcagcctcgtggtattcctaactttagtagttagttggatgagctcggggtccnccaggtacctccgagggggaacgggctagggtacgtttcggaggacccaaacaactaaaacccgaaggtagtaggggaaaaggtaaaaacgtaaaaacttagtaggtacggaacttcgtaggtacgggaaacggggtcccgtaattcccgaaccgtattacccgtaccgaaagggtaccgaaaccgtaaaccgacctaaaaggacgtacctaacgttggtaactcgtagacctaaatcgaaactcgaccgtagaacgacggacccggtaggaaccgacggtacttaacgggttacttaaccgtcgtacggtacggacgaaaggtacgtacctaccgttacgtcttaaccggtttcccttcgttttacgaccgtttaccgg

SEQ ID NO: 46293 - DNA, 661 bp, Homo sapiens
  misc_feature: GYAE6OF02HJ8R3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtgggaggaggtgtgggtccagccgtggagaactccctgacgactctcctgtcgcacgcctcgtggtacttcctacctttaagtagtttagttggatggagcgtcgggtcccgcacgaccgtccgaggggaacggggcgtgggtaggttcggtcggacccaaacgtaactaaaaccgaaggtagtagggtaaaggtaaaacgtaaaagtagtagtacggacttcgtagtaggaacgggaccgtacttaccaaccgtactccgtaccgaaaggtacgaaccaaacgaccgaaaaggaccgttacaacgttagtaactctagaactaaagtcgaaacgaacgtcccgtaagggacgaccggaccggaaagaccgtacggtctagtaactacgtacgtggcgacgagtaacgtcgttacctagttccacgtttccggttactttagaccttcgg

SEQ ID NO: 46294 - DNA, 609 bp, Homo sapiens
  misc_feature: GYAE6OF02HT770.27.57.F02.1.454.CMB.1.raw
  modified_base (338)..(338): a, c, t, g, unknown or other
  misc_feature (338)..(338): n is a, c, g, or t
tcagagcgtcgtctcacgaccggtgctcgatttagctcgatatagttgggtttgaggtatcagagaggagccttagccctggactccaaggcctttccacttggtgatcagcacggagcacagaggacccaccatggaactggggctgagctgggttttccttgttgctatttttagaaggtgtccagtgtgaggtgcaactggtggattctggaggaggtgtggtccagcctggagaatccctgagactctcctgtgcagcctctggattcacctttagtagttattggatgagtctcgggtccgccagacctccgagggacgggctgggagttcgnggaccaacgaataaaccgaagagtagggaaaggtaaaaagaaaacttagtaggtaggactacgtggaggtaacgggccgtattaccaccactccgtaccagacgaccaacgaccaaagaacgtcacttgtatcgtacgacaaagtagaaactacgaccgtaggacgacggcccgaaggaccgacggtacgtagtactacttacgtggtcggacgaaggacgtacttacccgtagtaccgtacgtttcccggtttcttttacggatttccgg

SEQ ID NO: 46295 - DNA, 551 bp, Homo sapiens
  misc_feature: GYAE6OF02GVPSR.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagacctccgagggaaggggctgggagttcgtggccaacaataaaccaagatagggaaggtaaaagaaaactagtagtaggactcgtagtaggaacggggccgtaattccacctactcctaccaagacgaacaacgaccaaagaacgtcactgtatctgacaaatgaacagacctagagacgcgagacgacggctagtatacgtacgtgtgcgagagactcgtatctacttccgtcttttgattccg

SEQ ID NO: 46296 - DNA, 816 bp, Homo sapiens
  misc_feature: GYAE6OF02JVBQV.27.57.F02.1.454.CMB.1.raw
  modified_base (329)..(329): a, c, t, g, unknown or other
  misc_feature (329)..(329): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagctgggttttccttgttgcttattttagaggtgtccagtgtgaggtgcaacgtggtggattcgtggaggtaggtgtggtccagccgtggagaactccctgagactctcctgtcgacacgcctcgtaggtattcctacctttaggttattagttggaattggacgtcgttcggggtcccnccgacgtaccgtccggaagggggaacgggtcgttaggggtacggtttcggtacgggtaccccgaaaacgtaaacgtaaaacccgaaaggtaacgttaaggggtaaaagggttaaaaaacgaaaaaccgtttaggtaggttacgggtaaacgttacgtaggttaacggggtaaacgggtacccgttaacgtttaccgaaccgtacgttacccgtaccgtaaaggaaccgtaaacccgtaaacggaaccccgtaaaaggtaaaccgttaacgtaccggtttaacgttaacgttcctaacggtaaacctaaaagtaccggtaaaacctaacgggtaccgtacggtaacggaaccgggaacccggggaaacgaaccggttaaacgggcctttaaagggttacctaaccgttaaggttcggtacggtacgaaggttacgtaacgtaccgttagttacgtccttttacccggtattttaccgacgtttaccgg

SEQ ID NO: 46297 - DNA, 653 bp, Homo sapiens
  misc_feature: GYAE6OF02I43QT.27.57.F02.1.454.CMB.1.raw
  modified_base (383)..(383): a, c, t, g, unknown or other
  misc_feature (383)..(383): n is a, c, g, or t
  modified_base (440)..(440): a, c, t, g, unknown or other
  misc_feature (440)..(440): n is a, c, g, or t
  modified_base (503)..(503): a, c, t, g, unknown or other
  misc_feature (503)..(503): n is a, c, g, or t
  modified_base (515)..(515): a, c, t, g, unknown or other
  misc_feature (515)..(515): n is a, c, g, or t
  modified_base (529)..(529): a, c, t, g, unknown or other
  misc_feature (529)..(529): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgtgcctattttagaaggtgtccagtgtgaggtgcaacgtggtggattcgtgggaggaggtgtggtcccagcccgtaggagaaactcccctagacgaactcctccgtgtgcagtcctcgtaggtattactaccgtttagtagttattggatgacgtcgtagggtcccgccgaacgaccgtccggaaggggacgggcgtggaagttccggtcgaccgtaaanaacgtaaaaccaggtagtagggaaggtaaaacgaaacgtgtaggtagtactgtaggnggaaacgggccgtattaccgacctattccaccgagtacgacaacgacgaaaggtcactagttnactcgtaacganaaactgaaacgacnccgtagaaccggacgtacccggacgaaccgcggtacttagtaacgtaccgtagtcggtggaccgtaggtaacgtcgttaccgtacggttacttcccggtttacttaccggtttagccgttacgg

SEQ ID NO: 46298 - DNA, 960 bp, Homo sapiens
  misc_feature: GYAE6OF02I5ANH.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattcgtggaggaggtgtggtccagcctggagaatccctgacgactctcctgtgcagcctcgtggattccacctttaggtagtttattgggattggacgtcgtcggggttcccgccgtaggaacctcccggaaggggggaacggggtctaggggacggtttcggtcgggacccctaaaccgtaaacttaaaaacccgaaaggtagttaagggggtaaaaagggttaaaaaaacggaaaaaacgtttaagttaggggtttaacgggtaacccttaccgggttagggttaaggggtaaaaacccgggggtcccggtaaagttttaccccgaacccctaaacgtttacccgttaaccccgaaagggtaaaccggaaaacccgtaaaaccgggacccccaaaaaaggggtaaaacccgggttaccctaaacccggtttaaggttaaacccttcccgttaaacgggtaaaaccctttaaaaacggttaaaccgggaaaaacccgttaaacgggtaccccggttaagggtaaaaccgggtaaccgggtaacccgggggaaacccggggtaaaccggtaaaccccgggtccgggttttaaacgttaaacccgtttaacccggtttaaccggttacggggtttaaccgggaaccgggtaaaacggggtaaccgttacccggtttaaccccggtttaaacggttaccccggttaaccgtttttaccccgggtttcctttttttaacgggacccgtttaacccggg

SEQ ID NO: 46299 - DNA, 769 bp, Homo sapiens
  misc_feature: GYAE6OF02G2N2B.27.57.F02.1.454.CMB.1.raw
  modified_base (755)..(755): a, c, t, g, unknown or other
  misc_feature (755)..(755): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctgggaggaggtggtggtccagccgtggagaactccctaggacgacctcctccgtggtcgacacgcccttcgtcggtattcctaaccttttaagttagtttagttggagtggtacgtcggtcggggtcccgaccgtacggtaacccgttccgggaaacggggggtaacgggggtccgtaggggtacgggtttccgggtacgggaccccgaaaaacgtaaactaaaacccgaaaaggtacgtaaggggaaaagggttaaaaaacgaaaaacgttagttacgggtaaggtaaccgttacggttaggtaacgggaacggggtacccgtaacgttaccgaacctactcccgttaaccgaacggaacgaaacccgaaacccggaacgaaacggtaacgtaccgtaacgttaggtacttactcggaaactaaagtacgaacgtaccgactagggaacgaacggaccggaacggaaccgtacggacgttacgtaactacgtagtacggtggaacgacggataaccttcgttacgtaccgttacttcccgttnttttacggcttcgg

SEQ ID NO: 46300 - DNA, 649 bp, Homo sapiens
  misc_feature: GYAE6OF02G17P5.27.57.F02.1.454.CMB.1.raw
  modified_base (258)..(258): a, c, t, g, unknown or other
  misc_feature (258)..(258): n is a, c, g, or t
  modified_base (311)..(311): a, c, t, g, unknown or other
  misc_feature (311)..(311): n is a, c, g, or t
  modified_base (521)..(521): a, c, t, g, unknown or other
  misc_feature (521)..(521): n is a, c, g, or t
  modified_base (640)..(640): a, c, t, g, unknown or other
  misc_feature (640)..(640): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggtttccgttgtgctatttagaggtgtccagtgtgaggtgcaactggtggattcgtggaggaggtgtggtccaggcctggagactccctgagtactctcctgtncagcctcgtggattccacctttagtagttattggattgagtcgtcggggtccnccagtacctccggaaggggaggggcctgggacgtttcgtggaccaacaactaaaccgaagacgtagggaagggtaaaacgaaaacttagtaggtgggaacttccgttggacggtaaaggggcccaagttccaccgacgttcctacaaggacgaaccgaaccgtacccgaaagggtaactccgaacgttagtacttcgttagaacctaaanaggaacacgcctagggataccggccgtaacggacaaccgggtcttaggtactacttacggtagtacggacggaatggtacctaccgttaacgttctaccgtttaccgttcgttttacgntttacccgg

SEQ ID NO: 46301 - DNA, 598 bp, Homo sapiens
  misc_feature: GYAE6OF02ILN5V.27.57.F02.1.454.CMB.1.raw
  modified_base (257)..(257): a, c, t, g, unknown or other
  misc_feature (257)..(257): n is a, c, g, or t
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
  modified_base (454)..(454): a, c, t, g, unknown or other
  misc_feature (454)..(454): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtncagcctctggattcacctttagtagttattggatgagctgggtcccncagactccaggggagggctggagttcgtgccaanataaaccgaagagtaggaaggtaaaanaaactataggagactctaggtagaacgggccgtattccactatctacaagacgacaaaccgaccaaagaacgtcaacttgtactcgtanacaaaagtcgaaacacgtacccgtgaaacggacgcccggaaagggtacccacgggcttaggtacttaccgtattcggaggtccgaaggtacgaactttcccgtaggtacctacgtttttccccggactttttcggaattcccgg

SEQ ID NO: 46302 - DNA, 532 bp, Homo sapiens
  misc_feature: GYAE6OF02GTF37.27.57.F02.1.454.CMB.1.raw
  modified_base (334)..(334): a, c, t, g, unknown or other
  misc_feature (334)..(334): n is a, c, g, or t
  modified_base (400)..(400): a, c, t, g, unknown or other
  misc_feature (400)..(400): n is a, c, g, or t
  modified_base (428)..(428): a, c, t, g, unknown or other
  misc_feature (428)..(428): n is a, c, g, or t
  modified_base (454)..(454): a, c, t, g, unknown or other
  misc_feature (454)..(454): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgaggggaagggctggagttcgnggccaacataaaccagatggaaggtaaagaaaactatagtcgactctgtgaagggcattcacatcnccagagacaacgccaaagaagtcaactntatctagacaaatagaacagcctganaggaccgagaacgacggctagtatacgtactggtgcggagagacgtcctagtctacttcccgtcttttacgattccgg

SEQ ID NO: 46303 - DNA, 764 bp, Homo sapiens
  misc_feature: GYAE6OF02FJZRE.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttcctgttgctattttagaaggtgtccagtgtgaggtgcaactggtggattctggaggagtgtgggtccagcctgggagaactccctgagacctctacctgtgcagcctctggattctaccttagtagttattggatcgagctggtcnctagactccagggtagggctaggagttcgtggaccaacataaacccagactaggggaagtaaacgaaaccttagtacggtaggtaacctcgtaggtacggaaacgggcccgtaattccgaaccctacttacccgtacccgaaggtaaccgaacccgaaacccggtacccaaaacggtaaacggttacccaaacgttcggttaaacttcccgttaacgggacctaaaaacggtttccggaaaaaccctaggtaccccgttacgggaaacggaacggaacccgggtaaacggggaacccgtaaacccggggtaccgttacgggttaaccttaacccggttaaccggttaccggtttaaggggacccggaaaccgggtaacggttaaccgttaccccgtttaaacgggttaccctaaaccggtttttcccccggtacgtttttttacggaccttttacccggg

SEQ ID NO: 46304 - DNA, 574 bp, Homo sapiens
  misc_feature: GYAE6OF02IUXIH.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaagtgtccagtgtgaggtgcaactggtggattctggaggaggtgtggtccagcctggagaatccctgagactctcctgtgcagcctctggattccacctttagtagttattggatggagcgtgggtccgccgagacgtccgaaggggaaggggctggagttcgtggaccaacataaaccgaagatgggaaaggtaaagaaaactataggtaggtactctaggtacggaagggccgtaattccgaaccactcctaccaagacgaacaaacgaccgaaagaacgtacagtgtatcgtagacaaatagaacagaccgtagagacgaccggaagaccacggctagtaatactacgtgtcgagagacgactacgtacgtcgtacgttccgtacttttcgattcg

SEQ ID NO: 46305 - DNA, 812 bp, Homo sapiens
  misc_feature: GYAE6OF02JROHW.27.57.F02.1.454.CMB.1.raw
  modified_base (329)..(329): a, c, t, g, unknown or other
  misc_feature (329)..(329): n is a, c, g, or t
tcagagcgtcgtctcacgaccggtgctcgatttagctcgatatagttgggtttgaggtctcagagaggagccttagccctggactccaaggcctttccacttggttgatcagcacggagcacagaggacccaccatggaactggggctgagctgggttttccttgttgctattttagaggtgtccagtgtgaggtgcaacgtggtggattcgtggaggaggtgtggtccagcctaggagaactcccgtgagaccttctcctgtgcagtccctgtggtacttctaccgtttagtagtttagttggatggtaggtcgttcgggggtacccnccgtaacggtaccgttacccggaaaggggggtaacggggtccgttaggggtaacggtttccgggttaccgggaacccctaaaacgtaaaacttaaaacccgaaaggtaggttaacggggtaaaaggggtaaaaaactaaaaacgttcggttaggttaccgggaaccttacggttaggtaaacgggaaccggggtaccgttaatttacccgaaccgtacttaccgtacgaaacggactaaaccgaaaccgaccgaaaacggtaacgtcctaacgttacgttacttaccgtagaaccgtaaaacgtagaaaccgtaccggaccggttaacggaagggtaacccgggacccggtaaaacgggccgaacggttaccgttagttaaacgtacgttaaccggttggaccggttacggaaaggtacgttacgtaacccgtttaggtaccctaacgggtttttccccagggttttttacgacgttaccggg

SEQ ID NO: 46306 - DNA, 577 bp, Homo sapiens
  misc_feature: GYAE6OF02GF889.27.57.F02.1.454.CMB.1.raw
  modified_base (563)..(563): a, c, t, g, unknown or other
  misc_feature (563)..(563): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattcgtggaggaggtgtggtccagcctggagaatccctgagactctcctgtgcagcctctggattctacctttagtagttattggatgagtcgtggggtccgccagacctccgaggggagggctggagttcgtggaccaacaactaaaccaagagtagggaaagtaaaagaaaactagtagtaggactgtaggtaggaacgggtccaattccaactatcctaccgagtacgaacaacgaccaaaggaactcacttagtactcgtagactaaatgaacacgaccgtagagcgaccggaggaccacggctagtactactcgtaggtgacggagagtactcgtacgtctacgtttcccgtnttttacgacttcgg

SEQ ID NO: 46307 - DNA, 742 bp, Homo sapiens
  misc_feature: GYAE6OF02F2NT6.27.57.F02.1.454.CMB.1.raw
  modified_base (345)..(345): a, c, t, g, unknown or other
  misc_feature (345)..(345): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcctacctttagtagtttattggatgagtcgtggggtccgccgagacctccgaaggggaagggctggtagttcgnggcccaacactaaaaccaaggaatagggaaagggtaaaacgaaaaacttagtaggtagggtaaccttcgtaggtaggaaacggggccgtaattaccgaccctaacttcctaccgaaggacgaaaccgaaaccgacccaaaaggtaacgtaccgaacgttacgtaacttcgttaacgaactaaaattacggaaaccgtaacggtacccttagggaaacggtaccgggacccgggaaacgggtaaacccgaaccgggttaccgttaacggttaacttaacccgtttaacggttaacgggttcgggaaccgggtaaaggtaaccggtaaaccgtttcccgttaaaggttcccttaaacggtttttccccgtacggtttttttaccggacttttacccggg

SEQ ID NO: 46308 - DNA, 663 bp, Homo sapiens
  misc_feature: GYAE6OF02I0KJV.27.57.F02.1.454.CMB.1.raw
  modified_base (177)..(177): a, c, t, g, unknown or other
  misc_feature (177)..(177): n is a, c, g, or t
  modified_base (191)..(191): a, c, t, g, unknown or other
  misc_feature (191)..(191): n is a, c, g, or t
  modified_base (234)..(234): a, c, t, g, unknown or other
  misc_feature (234)..(234): n is a, c, g, or t
  modified_base (644)..(644): a, c, t, g, unknown or other
  misc_feature (644)..(644): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctatttagagtntccagtgtgaggtncaactggtgattcgtgggaggaggtgtggtccagcctaggganaactcccagacgacctcctccgtgtcgccacgtccttcgtaggtaccttacctaaccgtttagtagttagtagatgacgtcgtacgggtccacacgaccgtacggaaggggaggtcgtaggacgttcgtacgaaccaaacgaactaaacgagtaaggtaggtaaaagtaaacaacgtgtacgtagtactacgtacggaacggtaccggtcctactacccgaccgtacacccgtacgaagtaacgaaacccgactaaacggaactacggttacctagtacgtacctagaacgaactaacacgtacgactacgtacggaacgtacggacgtaagacgtacgtacgtattaccgtagttcggagtaaccggtaagacgttctacttaacgttccgttcgttaccttacggttntacccggtagtaaccgggg

SEQ ID NO: 46309 - DNA, 599 bp, Homo sapiens
  misc_feature: GYAE6OF02HDZY6.27.57.F02.1.454.CMB.1.raw
  modified_base (473)..(473): a, c, t, g, unknown or other
  misc_feature (473)..(473): n is a, c, g, or t
tcagagcgtcgtctcacgaccggtgctcgatttagctcgatatagttgggtttgaggtctcagagaggagccttagccctggactccaagggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagacctctcctgtgcagtcccttcgtggacttccacctttagtagttattggatgagcgtgggtcccgccgagacctccgaggggacgggctgggagttcgtggacccaacactaaaaccagagtaggaaaggtaaacgaaaactagtagtaggactgtggaggaacgggtccattccaccactctaccagacgaacaacgaccaaagaacgtcaagttgaatccgngactaaagtacgaacacgacctaggacgacgaccgaaggaccgacggcgtagtactacgtactaggtcgaccgaagtacgtaccgtacgtacggtactacgtttcccgtcgttttagaccgttcgg

SEQ ID NO: 46310 - DNA, 697 bp, Homo sapiens
  misc_feature: GYAE6OF02GQWY8.27.57.F02.1.454.CMB.1.raw
  modified_base (262)..(262): a, c, t, g, unknown or other
  misc_feature (262)..(262): n is a, c, g, or t
  modified_base (332)..(332): a, c, t, g, unknown or other
  misc_feature (332)..(332): n is a, c, g, or t
  modified_base (369)..(369): a, c, t, g, unknown or other
  misc_feature (369)..(369): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctattttagaggtgtccagtgtgaggtgcaactggtggattctgggaggaggtgtggtccagcctggagaatccctgagactctcctgtgcagcctntggattcacctttagtagttattggatgagctgggtccgcaggactcgaagggagggctagggcgttcgnggccaacataaaccagagtaggaaggtaaagaaactntaggtacggtactcgtagtaggaacgggcctattaccgacctagttcctaccgaaggtaacgaacccgaaacgtaccccgaaaggtaaaccgtcctaaccgttaggttaacttaccgttaagggaaccctaaaagttaccggaaaaccgaacgggtaccccgttagggaaacgggaaccggtacccgggaaagggaacccgtaccggggtaccgttagttaaccgttaacccgttaccgtaggtacggtaccggtaaggaaccgttacgttaccccttagggtaccctttaacggtttccccgtttagttttttacggatttcccggg

SEQ ID NO: 46311 - DNA, 537 bp, Homo sapiens
  misc_feature: GYAE6OF02I28CX.27.57.F02.1.454.CMB.1.raw
  modified_base (459)..(459): a, c, t, g, unknown or other
  misc_feature (459)..(459): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaaggggctgggagttcgtggccaacgataaaccaagataggaaggtaaagaaaactagtagtagactctggtagaagggcctaattcaccatctaccagacgacaacgccaaagaacgtcaactgtatctgacaaatcgaanagcctagagagaccgaggacacggctagtatactacgtgtcgacgagagactctagtcagttccgtacttttgattcg

SEQ ID NO: 46312 - DNA, 567 bp, Homo sapiens
  misc_feature: GYAE6OF02F1N0K.27.57.F02.1.454.CMB.1.raw
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (448)..(448): a, c, t, g, unknown or other
  misc_feature (448)..(448): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctattttagaaggtgtccagtgtgaggtgcaactggtggattctggaggaggtgtggtccagcctggagaatccctgagactctcctgtgcagccctgtggattcacctttagtagttattggatgagcgtgggtccgccagcctccgaggggaagggctgggagttcggnggccaanataaaccgaagataggaaggtaaagaaaactagtgtaggactgtgtagaacgggcctattccacatcctcagagaccaacgaccaagatcaactggtactcgtanactaaatcgaacacgactggaagcgaccggagaccgacggactagtattacgtacttggtacggacgaagtacgtacttacgtacgttcctacgtttccgtctttttaggactttccgg

SEQ ID NO: 46313 - DNA, 604 bp, Homo sapiens
  misc_feature: GYAE6OF02ICDKS.27.57.F02.1.454.CMB.1.raw
  modified_base (308)..(308): a, c, t, g, unknown or other
  misc_feature (308)..(308): n is a, c, g, or t
  modified_base (496)..(496): a, c, t, g, unknown or other
  misc_feature (496)..(496): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaactggtggattcgtgggaggaggtgtggtccaggcctggagaatccctgagactctcctgtcgcacgcctctggattctacctttagtagttattggatgagctgggtccnccagactccgagggaagggctgggagttcgtcggaccaacactaaaaccagacgtagggaaagtaaaaggaaaactagtagtacggacttcgtaggtagggaacgggccgtatttccgaaccagttcccgtacccaagacgaacaaaccgcaaagactacaacttgtactctagactaaatcgaaacncgtaccgtagaacgacggaccggaagacgacggtcttaagtactacttagtgacgacgagacgttactaccgtagtccttacgtttcccgttgtttacgacttcccgg

SEQ ID NO: 46314 - DNA, 768 bp, Homo sapiens
  misc_feature: GYAE6OF02I10H5.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgacgactctcctgtcgcagcctcgtggattcacctttagtagtttattggatgagcgtgggtccgcagacctccgaggggagggctggagttcgcggaccaacgataaaccaagatagggaaaggtaaaagaaaaacttagtaggtaggtaaccttcgtaggtacgggaaaacgggtccgtaagtttacccgaacctaacttcccgtaacccgaaacggaaacggaaacccgaaaacccggacccgaaaaaggtaaccgtacctaaaccgtttaggttaacctttcccgtaaggaaaccctaaaaaggttaccgaaaaccgtaacgggtaccccgtagggaaacgggtaacggaaccccggggaaaaggggaaccccggaacgggtaccgttaagtttaaccgttaacccgttaacgttcgggtacggaccggtaaacgggtaaacggaacccttttacccggttaagtttaccgttaaccgttttacccccgggttagtttttttaccggaactttacccggg

SEQ ID NO: 46315 - DNA, 584 bp, Homo sapiens
  misc_feature: GYAE6OF02GOYOZ.27.57.F02.1.454.CMB.1.raw
  modified_base (335)..(335): a, c, t, g, unknown or other
  misc_feature (335)..(335): n is a, c, g, or t
  modified_base (389)..(389): a, c, t, g, unknown or other
  misc_feature (389)..(389): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattctacctttagtagttattggatgagctgggtccgccagcctccgagggaagggctgggagttcgnggaccaacaactaaaaccaagataggaaggtaaaagaaaactagtagtagactntagtaggaagggccaattcaccatcctacgagacgacaacgacaaagaacgtcaacttagtactctagaacaaagtacgaaaccgtacgaccgtagaggaacggacccggaaggaacccgacggactagtaacttactacgtgtcggacgagagactaccgtagtactacgtttcccgtattttcggattcccgg

SEQ ID NO: 46316 - DNA, 702 bp, Homo sapiens
  misc_feature: GYAE6OF02I788J.27.57.F02.1.454.CMB.1.raw
  modified_base (235)..(235): a, c, t, g, unknown or other
  misc_feature (235)..(235): n is a, c, g, or t
  modified_base (348)..(348): a, c, t, g, unknown or other
  misc_feature (348)..(348): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctgganaatccctgagactctcctgtgcagcctctggattccacctttagtagttatggatgagcgtcgggtccgccagacctccgaaggggaaggggctgggaggttcgtggaccaanactaaaccgaagatagggaaggtaaagaaaactagtaggtaggaactcgtaggtaggaacgggtccgtaagttaccaccgtagtccctacgaaggaacgaaccaaaccgacccgtaaaagaacgtaccgtaacgtgttaactcgtaggaacctaaaagtccgaaacgtacgcccgttaggaacggaaccggtacccggaagggaaccgtacccgggtaactttcgggtaaaccttaaccgtttaacccgtcggttaagggaccggttaaacggaacggttaacccgtttcccgtaacgggttacccttaacggttttcccccggttacggttttttagacccgttttacccggg

SEQ ID NO: 46317 - DNA, 843 bp, Homo sapiens
  misc_feature: GYAE6OF02ITLTR.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgacaacgtggtggattcgtggaggtaggtgtggtccagccgtggagtaactcccgagacgacctcctccgtggtcgcacgtccttcgtacggtactttacctaacctttaggttaagtttagttagggatcgggtacgtccggtcggggtccccgaccgtaacggtaccgttaccgggaaggggggtaacgggggtccgttaggggttacggttttcgggtaccgggaacccctaaacgtaaaactaaaaacccggaaaggtaaggtaaggggtaaaacgggtaaaaacggtaaaaacgttagttagggttaacggtaaccttacggtaggtacggggtaaaccggggtacccgtaacgtttaacccgaacccgtaactttaccccgttaaccgaaacggaacggtaaacccgaaaacccgggaaccgtaaaacgggtaaccgtaccgttaaccgttagtttaaccgtccgtaagaaacctaaaggtaacgaaacaccggtacctaggaacggacccggtacgggaacggaccgtaccggtactagttaacctacttaccgggtagtaccggtacggaaggtaacgtaaccgtttaccgtaagttacctttaacccgttcccggtttaattttcgacccgtttccggg

SEQ ID NO: 46318 - DNA, 555 bp, Homo sapiens
  misc_feature: GYAE6OF02GH377.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctgggagaatccctgagactctcctgtgcagcctctggattcacctttagtagttattggatgagctggggtccgccagacctccgaggggaaggggctgggagttcggtggccaacataaaacccgaagagtagggaaggtaaaagaaaactagtaggtaggactcgtagtggaaggggccattcacctatctccagacgacaaccgcaaagaagtcactgtatctgacaaatagaacagcctagagacgaccgaggaccacggactgtaactactacgtgtcgacgagagactaccgtagtctacttccgtcttttgattcg

SEQ ID NO: 46319 - DNA, 542 bp, Homo sapiens
  misc_feature: GYAE6OF02HW6XI.27.57.F02.1.454.CMB.1.raw
  modified_base (340)..(340): a, c, t, g, unknown or other
  misc_feature (340)..(340): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccaggggaagggctggagttcgtggccaanactaaaccaagatagggaaggtaaagaaaactatagtaggactctgtagaagggccattcacatctccagacgacaacgaccaaagaacgcactagtatcgtagacaaatagaaacacgacctagaacgagaccggagacgacggactgtatactactggtgcgagagactccgtagtctacgttccgtacttttgattccg

SEQ ID NO: 46320 - DNA, 660 bp, Homo sapiens
  misc_feature: GYAE6OF02ITN64.27.57.F02.1.454.CMB.1.raw
  modified_base (238)..(238): a, c, t, g, unknown or other
  misc_feature (238)..(238): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgctattttagaaggtgtccagtgtgaggtgacactggtggattcgtggaggaggtgtggtccagccgtgganaatccctgacgtactctcctgtcgcacgtcctcgtggtactttacctacctttagttagttagttggtatggtacgtcgtcgggtaccgccgaggtacctaccggaggggacgggtcgtgggtacgttcggcggaccaacaacgtaaacgaagtagtagggaaacgtaaaagaaacgtagtaggtaggtactgtaggtacggacgggtaccgtattaccgaacctactacctaacgaacgacgaaaccaaaccgaacgaaaggtaactaccgtaacgttacgtaactcgtactaaagaaactaacgacacgtacgtacgaaggccgaaccggaggaccgtacggactagtacgtactaggtcgtacgacggaaggtactcgttaccgtacgtacttaccgttcgttcgtttacgcgttacgg

SEQ ID NO: 46321 - DNA, 665 bp, Homo sapiens
  misc_feature: GYAE6OF02G029N.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgacgactctcctgtgcagcctcgtggacttctaacctttagtagttagttggatgagcgttcggggtcccgccaggacctccgaagggggaacggggcgtagggtacggttcggtcggacccaaacgtaactaaaaccaagtagtaggggaaaggtaaaacgtaaaacgtagtacggtaggtaccttcgtaggtaggaaacgggtccgtaattccgaacctacgtccctacctaaggaacgaaccaacgaccaaagaacgtcaacttcgtactcgtagaacaaagtacgaacacgtccgtagacgacggaccggaaggaccgacggtacttacgttaactaccgttacgtagggtcggtacggagtaacgtacgttacccggttaacgttcctacgtttccccgttcgttttagaccttccgg

SEQ ID NO: 46322 - DNA, 1158 bp, Homo sapiens
  misc_feature: GYAE6OF02GVI8I.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggaaccaccatggaactggggctgagcgttgggtttttccttgttgcttattttagaaggtgtccagtgtgaggtgcaactggtggattctggaggaggtgtggtccaggtcccgtaggaacgtaactccccgtagaacgtaccttccgtcctggtagcctacggtccctcgtgggtaacttccgtaaccgttttaaggtagttttaagttggaatggacgtcggtcggggtacccacgacgaccgttccggaaagggggtaaggggtccgtagggtacggtttcggtacgggaacccctaaaacgtaaacgttaaaaacccgaaaggtaacggttaaacggggaaaagggtttaaaaaaacgaaaaacgtttaacggtttagggtttaacgggtaaacccgtttaccggttaacggggtttaaaacgggggaaacccggggggttaccccgttaaaacggtttttaaccccgaaccccccggtttaaaacgttttacccccggttaaaccccggtaaacggggtaaaaccgggtaaaaccccccggaaaaaaccccgggtaaaccccggtaaaaaaacggggtaaaacccgttttaacccccggtttaaaaccggtttaaccgggtttaaaaacccttttaccggggttaaaaaccgttaaaccccggttaaaaaaaaggttaacccgggttaaaaaaaccccgggacccgggtttaacccccggtttaaacggggtaaaccggaaaccgggggttaaaccccccgggaaaacggggtaaacccccggggttaaacgggtttaaaccctttaaccggggtttaaaacccgttttaacccgggtttaaacccggtttaggggtttaaacccggggaaccccggggtaaaaaacggggttaacccgggggttaaaacccgtttttaccccccggttaaaaggggttccccccttttaaaaccccgggggtttttttacccccccggtttaaagggttttttttccccgggtaaaaacccggttttcccccggggg

SEQ ID NO: 46323 - DNA, 598 bp, Homo sapiens
  misc_feature: GYAE6OF02INTQO.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattcgtggaggaggtgtggtccagcctggagaatccctgagactctcctgtgcagcctcgtaggtacttcctacctttagtagtttattggatgagcgtgggtccgcacgactccgaaggggaagggcgtggtaggttcgtggaccaacgaactaaaccgaaagagtaggaaggtaaaagtaaaactagtagtcggtactctaggtaggaacgggccgtatacactatctacgagagaacaaccgacaaagacgtcacgttagtatctagacaaagtagaacagaccgtaggaagaccggacggagaaccgacggtcttagtactacgtacgtaggtgacggagaacgtacgtaccgttacgtactacgttccgttacttttacgacttccgg

SEQ ID NO: 46324 - DNA, 910 bp, Homo sapiens
  misc_feature: GYAE6OF02JXCMR.27.57.F02.1.454.CMB.1.raw
tcagagcgtcgtctcacgaccggtgctcgatttagctcgatatagttgggtttgtaggtctcagagaggagccttagccctggactccaaggcctttccacttggttgatcagcacggagcacagaggacccaccatggaactgggctgagctgggttttccttgttgctattttagaggtgtccgagtgtgaggtgcaactggtggattctggaggaggtgtggtccagccgtggagaatccctgagtacgtctccgtgtcgcgacgcctcgtggattcgtaacctttagttagtttacgtttggtagtagaagtcgttggggttcccgccgtaacgaccgttccgaaggggtaacgggggtcgtcggggtaaggtttcccggttacgggacccgaaaaccgtaagttaaaaaaccccgtaaaacggtaaacggtaacgggtaaaaggggttaaaaaacggtaaaaaaaccgttaaagtttaagggttaacgggtaacttaccggtttaggttacgggtaaaacgggggtcccggttaaacgtttaccgtaacccgtaacgttacccgttacccggaacggtacggaaccgaaaaccgggaaccctaaaacggaaaacggttacccgtaaaccgttacggtaaacgtttacgtaccggtaaaccgtaaaacgtaaaccggtaaaccgtaacgggtacccgttaacgggaacgggttaaaccggacccgggtaaacgggaaacccggtaaacccgggtaccgggttattaaaccgttaccccttaaggttaaccgtaccgggttaaccggaaacgggttaacggtaacccgtttaacccggttagtttaaccccggttaaccgttttacccggtttacccggtttttacggttaaccgttttacccgggg

SEQ ID NO: 46325 - DNA, 833 bp, Homo sapiens
  misc_feature: GYAE6OF02JXRRG.27.57.F02.1.454.CMB.1.raw
  modified_base (211)..(211): a, c, t, g, unknown or other
  misc_feature (211)..(211): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgctatttagaggtgtccagtgtgaggtgcaacgtggtggattcgnggaggaggtgtggtccagccgtggagactcctgagactcgtcctgtgcacgcctcgtggtacttctaccgtttagtagttagttggatggtacggtcgtacggggttcccgaccgacggtaccgttccggaagggggacggggtccgttagggtacggtttccggtaccgggaccctaaacgtaaacgtaaaacccggaaaggtacgttaacggggtaaacggttaaaaaacgtaaaacgttacgttaacgggttacggtaaccgttcggttaaggtacggggtaaacgggtacccgttagtttacccggaacctacgtaccgtacccgtaacggaaccgaaccgtaaacccggtaaccgtaaaacgggtaccggttaaccgttaccggttaacgttaacgtaccgtcggtaaaccgtaaacgtacggtaaaccgaccggttaccgtaacggaacggtacgggacccgggtaacgggtaacccggtacggtaaccgttacggttaacttaccggttaccgttacgggtaacggtacggaacgggttaacccgtaactttaacccggttaacggttcccgtttaacgttaccggttttcccgttttaggccgttttacccggg

SEQ ID NO: 46326 - DNA, 591 bp, Homo sapiens
  misc_feature: GYAE6OF02JZEKJ.27.57.F02.1.454.CMB.1.raw
  modified_base (194)..(194): a, c, t, g, unknown or other
  misc_feature (194)..(194): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (390)..(390): a, c, t, g, unknown or other
  misc_feature (390)..(390): n is a, c, g, or t
  modified_base (474)..(474): a, c, t, g, unknown or other
  misc_feature (474)..(474): n is a, c, g, or t
  modified_base (489)..(489): a, c, t, g, unknown or other
  misc_feature (489)..(489): n is a, c, g, or t
tcagagcgtcgtctcacgaccggtgctcgatttagctcgatatagttgggtttggtaggtctcagagaggagcctagccctggactcaaggcctttccacttggtgatcagcacggagcacagaggacccacatggaactggggctgagctgggttttccttgttgctattttgaaggtgtcagtgtgaggtgnactggtggattctggaggaggtgtggtcccagcctggagaactccctgagactntccngtgacagcctcnggacttcacctttgtagtttattggattcgagtcttcggggcccgtaccaggaacctccgaggggaagggggcttgggacgtcgttgggaccaaacattaaaaccgaagacttgggaaggttaaanaaaacctagtgtaggaactctggtacgaaagggccgattcaacctagtcctacagacgaacaacgaccaagaagtaccatacgntacgtgacaaactanaacatcctaggagacgacgacgacgacggcctagtacacgtacttaggcgacgtaaggcgtaactaccgtagtccgttattaccgttactttggaacttcgg

SEQ ID NO: 46327 - DNA, 662 bp, Homo sapiens
  misc_feature: GYAE6OF02H7OVS.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaggtgtccagtgtgaggtgcaactggtggattcgtggaggaggtgtggtccagcctggagaactccctgagactctctgtgcagcctctggacttcacctttagtagttattggatggagcgttcggggtccgccgacgacctaccggagggggaacgggggcgtagggtacggtttcggtcgggaccccaaacgtaaacgtaaaacccgaaaggtacgtaggggtaaacggttaaaaacgaaaacgttagtaggtacggtacttacgtaggtaggaacggggccgtagttaccgaacctacgtaccgtaccgaacggtacgaacgaaccgaccgaaaggaacgtaccacgttagtactcgtagactaacgtacgaacgacgtaccgtagaagacggaccgaacggacgacggtactacgtactacttacgtggtacgcgtaagacgtactacgtactcgtacgtttccgtacttttagacttccgg

SEQ ID NO: 46328 - DNA, 732 bp, Homo sapiens
  misc_feature: GYAE6OF02JBANP.27.57.F02.1.454.CMB.1.raw
  modified_base (177)..(177): a, c, t, g, unknown or other
  misc_feature (177)..(177): n is a, c, g, or t
  modified_base (457)..(457): a, c, t, g, unknown or other
  misc_feature (457)..(457): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttcctgtgctatttagaggtntccagtgtgaggtgcaactggtggtattcgtgggaggtcggtgtgggtccaggccgtaggacgaatccctgagtactctccgtagtcgcagtcctcgtggtattcaaccttttaggtaacgtttagttggaattacggacggtccgttgggggtccccaccgtacgaaccgttccggaacgggggtaagggggtccgtagggtaacgggtttccggtacgggaccctaaactacgtaaaacccgaagtacgtacggggaaaggttaaaacaaaacgtttntagggtagtacgagttacggtaggaaaccgggctaactccgacgtactcaccgtagaccggtaacaaaccggtactaaggaacgttccgaactagttactacgtacgactaaagttacggaaccgtaagtaccgtacgggtaacgacgggtaccggaaccgggtacaacgggttcacggttaacgttacctaacgggtcggtacgtacggtacgtaacgtaccgttacgttacggtaccttacgtttacccggtacgttttcgaactttcccggg

SEQ ID NO: 46329 - DNA, 887 bp, Homo sapiens
  misc_feature: GYAE6OF02HA6ZJ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattcgtgggaggaggtgtggtccagcctggagaactccctgacgacctcctcctgtgcacgtcctcgtggtattcctaccttttaagttagttagttggatgaggtcgtcggggtcccgccgagaccgtaccggaagggggaacgggggcttaggggtacggtttcggtacgggaacccaaaaccgaaacgtaaaaaccgaaaggtaaagtaagggggaaaagggtaaaaaacgtaaaaaaccgtttaggtaggttaacggggtaaccttacgttaggggtaacggggaaacgggggtcccgttaaagtttccccgaaaacccttactaccccgttaccgaaaagggtaaccggaaaacccgaaacccggaacccggtaaaaacgggtaaaccgttaacccgaaccgttttacgggttaaacccttccgttaacggaaaccttaaaagtaaccggaaaaccgaccggttacccgtaaggggaaaccggtaccgggaacccgggaacgggaaacccggacccgggttacgtttaacggttaaaccgttaaccgtttacggttacggggtaacggtaccggggtaaacggtaacggtaaaccggtttaccccgttaacggtttaccgttaaccggtttttccccggttttacgttttttaccgggtaccttttaccccgggg

SEQ ID NO: 46330 - DNA, 756 bp, Homo sapiens
  misc_feature: GYAE6OF02G9D2O.27.57.F02.1.454.CMB.1.raw
  modified_base (312)..(312): a, c, t, g, unknown or other
  misc_feature (312)..(312): n is a, c, g, or t
  modified_base (431)..(431): a, c, t, g, unknown or other
  misc_feature (431)..(431): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctatttagaaggtgtccagtgtgaggtgcaacgtggtggattcgtgggaggaggtgtggtccagcctggagaactcctagagactctcctgtgcagtcctcgtggattctacctttagtacgttattggatggagtcgtcgggccnccgtagacctccggaagggggaacgggctagggtacgttcggtcggacctaaacgaaagtaaaccgaaagtacgtaacgggaaggttaaaaacaaaacttagtaggtacggtaaccgtntaggtacgggaaagggtccgtaagtttaccaaccctacgtcctaccggaaacgtaacggaacaaaccggacccgaaaaggtaaacgttcccgaaagttacggtaactcgtaacgtaacgaaaacgttcggaaacgtacggttacccaagggtaaccgaacgggtaacccggtaagggaaacccgtacccggggaacgtttacggtaaaacctttacccggtaagtttaccggggtaaacggtcgggtaaaacgggacccgttaaagttacccccgttaagtacccttacggttccccggtttaatttttaccgactttacccggg

SEQ ID NO: 46331 - DNA, 759 bp, Homo sapiens
  misc_feature: GYAE6OF02J2MXV.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggttttccttgtgcttattttagaggtgtccagtgtgaggtgcaacgtggtggattcgtggagggaggtgtggtccagccgtggagaactcctgacgtctctcctgtcgcacgtcctctggacttctaccgtttaggttagtttagttggattgaggttcgtccgggggttacccgacccgtaacggtaccgtacccgggaagggggggtaacgggggtccgtaggggttaaccgggtttccgggtcgggtaaccccaaaacggtaaacttaaaaacccggaaaggtaggtaaggggtaaaaggttaaaaacgaaaaccgttaggttggttacggtaccttacgtaggtaacgggaaaccgggtccgtacgttaccacctagtccctaccgaacgaacgaaaccgaaacgtaaccaaaggtacgtacctaacgttgtaacttccgtagaacgtaaagtacgaacgtacaccggtaggaacgacgggaacccggaggaacccgtacggtcttaacggtaaccttacgtaccgttcgggaggtaccgaaggtcgtaacccttcgtaccgttacgttaccgttttcgtacgtttacggcgtttacccggg

SEQ ID NO: 46332 - DNA, 779 bp, Homo sapiens
  misc_feature: GYAE6OF02FTUKD.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcttgtgctatttagagtgtcagtgtgaggtgcaacgtggtggattcgtggaggaggtgtcggtccagcctggagaactccctgagactctcctgtcgcacgcctcgtcgattctacctttagtagttagttggatggagtccgtcggggtcccaccgaacgaccgtaccggaaggggggtaagggtccgttagggtacggtttcggtcggaacccaaaacgtaaacgtaaaaacccgaaggtaagttaacggggaaaacgggttaaaaaacgtaaaaaccgtttagtacgggtaacggtaaccgtttacgtagggtacgggtaaaccggggcccgtaatttacccgaacccgtaacttccccgtaaccgaaggtaaccgaaacccgaaacccggaacccgaaaaggtaaccggtaccaaccgtttagtaccttacgtacgaataaacgtagaaacgtacggtacccttaggaacggaccggaccgggaaacgaacccgtacggacttaacggttactaaccgtaggttacggtaacggaccgtaaggaacgttaccgttaacccggtttaacggttaccttaccgtttccccggtttatttttaccgggactttacccggg

SEQ ID NO: 46333 - DNA, 676 bp, Homo sapiens
  misc_feature: GYAE6OF02HVTWH.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggatttctgggaggaggtgtggtccagcctggagaatccctgagactctcctgtgcacgcctctggattccacctttagtagttattggattggagtcgtcgggtcccgccgagaccgtccgaaggggtaagggggctgggacgttcggtcggaccaacgaataaaacccaagagtagggaaaggtaaaagaaaactaagtagtacggtactctaggtaggaagggtccgacttaccaaccactccgtaccaagacgaacaaacgaccaaagaacgtacacgttagtactctacgaacaaatacggtaaacgacgtacctacgggaacgacggaccggtaacggaccgtaccggacgttagtacgttaacctttacgtacggtaacggaccgtaagggtacgtaacccgttaccttacggttaccttaccggttttaaccccggtttacgttttttaccgacgtttacccgg

SEQ ID NO: 46334 - DNA, 642 bp, Homo sapiens
  misc_feature: GYAE6OF02F71UE.27.57.F02.1.454.CMB.1.raw
  modified_base (535)..(535): a, c, t, g, unknown or other
  misc_feature (535)..(535): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggtttcctgttgctatttagaggtgtccagtgtgaggtgcaactggtggattctggaggaggtgtggtccagcctggacgaatccctgagactctacctgtcgcaggcctctggattcacctttagagttattggatgagtcgtgggtccgacagacctccgagggaagggctagggagttcgtggcccaaacacgtaaaacccgaagacgtagggaacggtaaaacgaaaacctgtacggtacggaccttgtggtacggtaaacgggggcctaagtttccgaaccgtacgtcccgtaaccctaaggaacgtaaaccgaaccgtaacccgaaaggtaacgtcctaacgttacgtactaccgttacgaactaaaacgtgaaaccngaccgttggaacgacgtccggaagacgagcgtagtactacgtacgtaggtgaccgtaagacgattacccgagttaccacgtttccgtacgttttagatttacccggg

SEQ ID NO: 46335 - DNA, 743 bp, Homo sapiens
  misc_feature: GYAE6OF02H56PC.27.57.F02.1.454.CMB.1.raw
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttttagaaggtgtccagtgtgaggtgcaacgtggtggattctgggaggaggtgtggtccagcctggagaatccctgagactctcctgtncagcctctggattcctacctttagtaagtttatggatgagctgggtccncagacctcgagggaagggctagggacgttcggtcggaccaaactaactaaaacccgaaagacgtaggggtaaagggtaaaaacggaaaaaccttataggttacgggaaccttcgttagggttaggggaaaaccggggtcccgtaacgtttcccgtaacccgtaaacgtttccctacccgaaggtaaaccgaaccaaaccggacccaaaaggaacgttacaacgttacgttataccgtagacaaaattacggaaactacggtacccgttaggaacgtaacggacccgggtaaacggaaccggaaccggtaccgttacgttaaccttaaccgttaaccgtagggtacggtaaccggtaggtaacggtaactttacccgttaacgttacccgttaacgtttaccccggtttaccgttttttacggattttaccccgg

SEQ ID NO: 46336 - DNA, 746 bp, Homo sapiens
  misc_feature: GYAE6OF02GCS8N.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactcccgtgagactctcctgtgcagcctcgtggattcacctttagtagttattggatgagcgtcgggtccgccgaagacctccggaaggggaaggggctggagttcggcgaccaacataaaaccgagagtagggaaaggtaaaacgaaaactagtaggtaggtaactcgttaggtaggaaacggggtaccctattaccgaaccctaagttaccctaccgaaggacgaaaccgtaaaccggacccgaaaaggtaacgtaccaaacgttacgttaacgtaccgttagaaccgtaaaagtacggaaaaccgtacgtacccgttagggaaacgtaccgggaacccggtaacgggggaaaccctaaccggggttaccgtttaacgttaaaacgttacccgtttaaacggttcgggtaacggtaccgggtaaaggtaaaccggttaacgtttcccggttaaacggttccctaaacgtttttcccccgggtaacttttttacggaacctttcccgg

SEQ ID NO: 46337 - DNA, 715 bp, Homo sapiens
  misc_feature: GYAE6OF02GE8HK.27.57.F02.1.454.CMB.1.raw
  modified_base (257)..(257): a, c, t, g, unknown or other
  misc_feature (257)..(257): n is a, c, g, or t
  modified_base (305)..(305): a, c, t, g, unknown or other
  misc_feature (305)..(305): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtncagcctctggattctacctttagtagttattggatgagcgtgggtccncagactccgagggagggctaggagttcgtggaccaacaataaaccgaagactagggaacggttaaaagaaaacttagtggtacggacttcgtaggtacggaaacggggtccgtaatttcccgaaccctattaccctaccgaaggaacgaaccgaaaccgacccgaaaaggtaacgtacctaaaccgttagttaacttaccgtacggtaaacctaaaagttacggaaaaccgtaacgtaccccgttaagggaaacggaaccgggtacccggaaacgggtaacccgaaccgggtacgttaacggttaacttaaccgttaacggtggttacggaacggtaaggtaacggtaacgttaccccgttaagtacccttaacggtttaccccggttactttttacggacgtttcccgg

SEQ ID NO: 46338 - DNA, 722 bp, Homo sapiens
  misc_feature: GYAE6OF02FQINH.27.57.F02.1.454.CMB.1.raw
  modified_base (707)..(707): a, c, t, g, unknown or other
  misc_feature (707)..(707): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctatttagaaggtgtcaagtgtgaggtgcaactggtggattctggaggaggtgtggtccagcctggagactccctgagactctcctgtgcagcctcgtggattcctacctttagtacgttattggattggagcgtcggggtcccgccgaggacctccggaggggggaacggggctggggtaggttcggtcgggacccaaacgtaacttaaaaccaaaggtacgtaggggaaaggtaaaacgtaaaaaccgttagtagggttacggtaacctttcggtaggtaagggaaacggggtcccgtaacgtttaccaacccgtattaccctaccccgaaggtaaccgaaccaaaacccgggacccaaaacgggaaacggttaccctaacggtttacggttacttaccggtagaaacccgtaaaaggtccaaaacgtcggtaacctagggtaacgacggaccgggacggaaaccgtcggcttagttaacctactcgtaggttcggaacggtaagaccgtacgtaccgttaggtcctaacgtttccggtntttacggattcccgg

SEQ ID NO: 46339 - DNA, 709 bp, Homo sapiens
  misc_feature: GYAE6OF02FYDIL.27.57.F02.1.454.CMB.1.raw
  modified_base (235)..(235): a, c, t, g, unknown or other
  misc_feature (235)..(235): n is a, c, g, or t
  modified_base (347)..(347): a, c, t, g, unknown or other
  misc_feature (347)..(347): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctggaggaggtgtggtccagcctgganaatccctgagactctcctgtgcagcctctggtattccaccttttagtacgttattggatggagtcgtggggtccgccgagacctccgaggggaaggggtctgggagttcggnggccaacataaaccaagactagggaaaggtaaaagaaaaacgtagtagtacgggtaaccttcgttaggtagggaaacggggtcccgtagtttacccgaacccgtatacccgtacccgaaaggtaacggaacgaaaccggacccaaaagggtaacgtaccgaacgttaggttaacttccgttaacgaacgtaaaaagttacggaaaacctacggtaccctagggaaacgtacgggacccggaaggggtaaccgaaccgggtcgttacgtaaccgttacctaccggtaggtacggacggtaaggaacggtacttaccgtacgttaccgtaacgtttcccgtacggtttttagacgtttacccgg

SEQ ID NO: 46340 - DNA, 679 bp, Homo sapiens
  misc_feature: GYAE6OF02ICIQ2.27.57.F02.1.454.CMB.1.raw
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctatttagagtgtcagtgtgaggtgcaactggtggattcgtggaggaggtgtggtccagcctggagaactccctgagactcctcctgtgcagcctntggattccactttagagttattggatgagtcgtgggtccncagacctccggaagggggaacgggtctgggtagttcggtcggaccaaagataaaaccgaagagtagggaaaggttaaaacgaaaacgtagtggtacggaacttcgaggttacggaaacggggtcctaagtttaccgacctaacgttcctacccgaaaggaaccgaaaccgaaaccggaccgtaaaagggtaaccgtaccaaccgttggtaacttccgtaggtaacctaaaagtcgaaacgacggtaccgtaggaacggacggacccggaaaggaccgaccgggcttacgtaacttacctaaggttcggtacggaccgtaggaacgtacttacccgtacgttacctacgtttcccggttcttttacggactttcccgg

SEQ ID NO: 46341 - DNA, 617 bp, Homo sapiens
  misc_feature: GYAE6OF02IK5XJ.27.57.F02.1.454.CMB.1.raw
  modified_base (192)..(192): a, c, t, g, unknown or other
  misc_feature (192)..(192): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
  modified_base (533)..(533): a, c, t, g, unknown or other
  misc_feature (533)..(533): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttttccttgttgctattttagaaggtgtcagtgtgngtgcaatggtgattctggaggaggtgtggtccagcctggagaatccctgagactctcctgtgcacgctcgtgacttctacctttagtagttagttggatgagcgtggtccgccagacctcgaggggagggctaggagttcgtacggaccaanaactaaaacaagagtaggtaaaggtaaaanaaaacgtaagtggtagactagtgtaggaacggaccgtattacacctatcctaacgaacgaacgaaccaaacgaccgaaagtacgtacctaactgttaatcgtagaactaaaagtgaaactacgtacgtaggaacgacggacccgaagaaccgaacggtnttagtaactaccgtacgtggtacggacgaaggtaacgtactacggttactaccttaacgtttcccgtattttacgagtttcccg

SEQ ID NO: 46342 - DNA, 786 bp, Homo sapiens
  misc_feature: GYAE6OF02F7Y8C.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttccttgttgcttattttagaaggtgtccagtgtgaggtgcaacgtggtggtattcgtgggaggaggttggttcggtccaggtccgttgggaagtaactccccgtaggaacgtaccttcctccgtgtcgacctacgtcccttcgttaggtacttttacccttaaccgttttaagttaagttttagttgggtaagttggtaacgtccggttcggggttccccgccgaacggtacccgtaccgggaaaggggggtaacggggtccgtaggggttacggttccggtacggaacccaaaacgtaaacgtaaaaaccgaaggtaaagtagggtaaaaggttaaaaacgtaaaaactttggtaggtacggtactacggttagggaacggaacgggtaccgtaagttacccgaccgtaactccgtaaccgaaggaacaaccgaacgaaccgaaaggaactaccgtacgttactagtccgtaagtaaaccaagtacgaactacggacctaggaacgacggtaccgggaagacccgtaacggtacttaagttaccgtacttacggtgtacggaacgtaagtaacgttaaccgttaccgtgttaccgtacgtttacccgttcgtttagcgtttaaccgg

SEQ ID NO: 46343 - DNA, 864 bp, Homo sapiens
  misc_feature: GYAE6OF02H8MA0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgtgctattttagaggtgtccagtgtgaggtgcaactggtggattcgtgggaggaggtgtggtccagccgtggagaactcccagagactctccgtgtcgcacgtcctcgtggtattccgtaccttttaaggtaacgtttattggggtattggaagtccgttacggggttccccgccgtaaaggtacccgttaccgggaacgggggtaaacggggggtcctttaggggggtaacggttttccggtacggggaacccctaaaacgtaaaccgttaaaaacccgaaaggtaccggttaaggggtaaacgggtaaaaaacgtaaaaacttaaggttacgggacgggttaacccttacggttgggtacgggaaaaccggggccggttaactttacccgtaacccgtaacgttaccgttaaccccgaacggtaaccggtaaaccgtaaacggtaaccccgtaaaacgggtaaacgtaaccgtaacccggttacggtttaacgttacccgttacgggtaaacctaaacggtaaccggtaaacgtaaccggtacccgttacggaaacggtaccggaaccggaaacgggaaccggtacgggtaccgttacgtaacgttaccgttaccgttacggtacgacggtaacgtaacggttaccgtaccgttacgtaccgttaccgtttcccggtacgtttttacggacgtttacccgg

SEQ ID NO: 46344 - DNA, 806 bp, Homo sapiens
  misc_feature: GYAE6OF02GZZY3.27.57.F02.1.454.CMB.1.raw
  modified_base (323)..(323): a, c, t, g, unknown or other
  misc_feature (323)..(323): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaacgtggtggattcgtgggaggtaggtgtggtccaggccgtggagaactcccgtgacgactctcctgtcgcacgcctgtggtacttctaccgtttagtagttagtggatgagtcgtcgggtcccncctagaccgtaccggaagggggtaacgggcgttagggtacggttcggtacgggaccaaacgtaactaaaaccgaagtagtaggggtaaaacggtaaaaacgtaaaaacttacgtaggtacgtaaccgtttcgttagggtaacgggtaaacggggtccccgtaaagtttcccgaacccgtaacttacccgtaaccggtaaggaaccgaaaccgaaacccgaaacggtaaaagggtaacccttacccgtaaacggttacggttaaccttacgtaacggtaacctaaaaagttccggaaacgtaaccggtacccggtaagggaaccggtaaaccgggaccggaaccgggtaaacggacccggttaccgttaagttaaccgtacccgttacggttacggtacggaacggtaacggtaagtacccgtttaaccgtaggttaccctttacggttcccggtttaacttttacggtaacctttacccgggg

SEQ ID NO: 46345 - DNA, 628 bp, Homo sapiens
  misc_feature: GYAE6OF02HT35L.27.57.F02.1.454.CMB.1.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
  modified_base (339)..(339): a, c, t, g, unknown or other
  misc_feature (339)..(339): n is a, c, g, or t
  modified_base (572)..(572): a, c, t, g, unknown or other
  misc_feature (572)..(572): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggactggggctgagctgggtttccttgttgctattttggaaggtgtccagtgtgaggtgcaactggtggatttcngggaggaggtgtggtccagcctggagaatccctgagactctcctgtgcagcctctggattcacctttagtagttattgggattggagtcgtggggtccncagactccgaggggagggctgggagttcgnggccaaacataaaaccgaagagtagggaaggtaaaagaaaacgtatggtacggaactctggtaggaggggaccgtacgttacaccactacgtacccagaacgaccaacgaaccaaagaacgtacaacgtcgtatctacgaacaaataagaacgtaacgacccgtaggtaacggacggtacccgaagggaaccgtaccgggaacgttgtaacgttaaccttaagtcgggtaacncggagtaacgacgttacccgtagttacgtaccttccgtacgtttttacgattccgg

SEQ ID NO: 46346 - DNA, 697 bp, Homo sapiens
  misc_feature: GYAE6OF02G40MC.27.57.F02.1.454.CMB.1.raw
  modified_base (414)..(414): a, c, t, g, unknown or other
  misc_feature (414)..(414): n is a, c, g, or t
tcagagcgtcgtctcacgaccggtgctcgatttagctcgatatagttgggtttgaggtctcagagaggagccttagcccctggactccaaggccctttccaccttgtgatcagtacggagcacagaggacccacccatggaacgtagggcgtgagcttggttttccgtttcgttgtctattttagtaaggtgtccagtgtgaggtagcaactaggtggattctggagggaggtgtggtccagcctggagaatccctcgagacctctcctgtgcagcctctggattctaccctttaagtagtttattggatgagtcgttcggggtcccgcccagaccgtcccgaaggggaaggggtccgtggtagttcggtcggaccaaacaaacgtaaaccaaaggataggggaaggtaaaaanaaaacttatggtgggaccttgtacggtgggtaaacgggcccgtattacaacccattcctcccaaggacaacgaaccgtaccgaaagaaagttccacgttagttactcgttacgaagaaacttaccggaaacaacggcccgttagaaaggacggacccggaacggaaccgtaacccggtcgttaaaggttaaccgtaactttaccggtcggtcggaacggaacgtaaggaacctttcccgtaagttacctcgttttccccgtattttacgtactcgttcccggg

SEQ ID NO: 46347 - DNA, 784 bp, Homo sapiens
  misc_feature: GYAE6OF02IEBOT.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacagaggacccaccatggaactggggctgagcttgggttttccttgttgctattttagaaggtgtccagtgtgaggtgcaactggtggattcgtgggaggagggtgtggtccagcctggaagaatccctgagactctccgtgtgcagcctcgtggtacttctacctttagtagttattggatgagtcgtcgggtccgcacgactccgaggggagggcgtgggtagtcgtcggaccaaacgaataaaaccgaagtacgtagggaaaggtaaaacgaaaactagttaggacggtacttacgtaggttacgggaacgggtaccgtaactttaccgaaaccgtactttacccgtacccgtaaggaaaccgtaaaccgtaaacccggaacccaaaaggtaaaccgttaccgaaacccggtttaggttaaaccttaaccgttaggaaacccttaaaagtacgaaaccgtacggaacccgttggaaacgggtaacccgggaccgggtaaacggggacccgtaaccggggtacctttaacgggtaaactttacccgttaaccggttagggtacgggtaaccggtaagggtaaccgttaacgttccccgttaaacggttcccgttaacccggttttacccggtttaccgttttttacgggaacttttcccggg

SEQ ID NO: 46348 - DNA, 696 bp, Homo sapiens
  misc_feature: GYAE6OF02H24WL.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatcccgtgagactctccgtgtgcacgcctcgtggattcacctttagtattagtgatgagcgtggtccgccagacctcgagggaagggcgtggtagtcgtcggaccaacaataaaaccgaagtacgtagggaaacggttaaaagaaaacttagagtacggtactactaggtaggaacgggaccgtaattaccaaccgtacgtaccctaccgaacgaaggaaaccgaaaccgtaaccgaaaacgaaacggtcctaaaccgttaggttaactacgttacgaaactaaagtacgaaacgtaaccgaccgttaagaacggtaaccgggacccgaaacggacccgaacggaccgttaagtaacttaccgttacggttaggccggtaacggaacggtaagttaacccgtacgttaacggttcctaaccgtttcccccggtttagtttttacggaacgtttcccggg

SEQ ID NO: 46349 - DNA, 753 bp, Homo sapiens
  misc_feature: GYAE6OF02HEBYS.27.57.F02.1.454.CMB.1.raw
  modified_base (726)..(726): a, c, t, g, unknown or other
  misc_feature (726)..(726): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgtgctatttagaggtgtccagtgtgaggtgcaactggtggattctggaggaggtgtggtccagcctggagaactccctgagactctcctgtgcagcctctggattcctacctttagtagttatggatgagcgtgggtccgccagactccgaggggagggcgtggagttcggtggaccaacgataaaccgaaagagtagggaaaggtaaaacgaaaactagtaggtacggtaacttacgtaggttaggaaacggggtcccgtaacgtttaccgaacccgtagtaccccttaacccgaaggtaaacggaaacccgtaaaccggaacccgaaaagggtaacgtaaccgaacgttacggttaacttaccgttcgggaaacctaaaagttacgaaaaccgtaacggtacccgttacgggaaacgtaccggacccgggtaaaggggaacccgaacgggaccgtttacgtaacgttaaaccgtacggtttacgggtacgggtaaccggtaaaggtaacgttaaccgtttaccccggttaagtttaacccgtaccgtttttaccccggtttntttttaccggggtacttttacccgggg

SEQ ID NO: 46350 - DNA, 566 bp, Homo sapiens
  misc_feature: GYAE6OF02GI8IZ.27.57.F02.1.454.CMB.1.raw
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctggaggaggtgtggtccagcctggagaatccctgagactctcctgtgcagcctctggattctacctttagtagttattggatgagctgggtccgcagactccgaggggaagggctgggagttcggtggacccaacaactaaaaccgaagagtagggaaggtaaaagaaaactatggtaggactcgtgtaggaagggcccgtaagttcaaccattcctaccagagaacaacgcaaagaagtcaactgtatcngacaatgaacngcctagagacgcggaagaccgacggacgtgtattaccgtactggtcggacgaaggagtattccgtaaggtctattcccgtcttttacgcttccgg

SEQ ID NO: 46351 - DNA, 891 bp, Homo sapiens
  misc_feature: GYAE6OF02HV6B0.27.57.F02.1.454.CMB.1.raw
  modified_base (868)..(868): a, c, t, g, unknown or other
  misc_feature (868)..(868): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttctgttgctattttagaggtgtccagtgtgaggtgacacgttggtggtattcgtaggggagggtagggttggtcgggttaccaacggtcccgttagggaacgtaaacttcccccgttaggaacgtaccttccttcccgttagttcggctacggcccttcgtggtaactttccgtaacctttttaggtacgttttagttagggattaggacggtcgttacggggttccccaccgaacggtaccgtaccgggaaaggggggaacgggggtcgttacggggtaacggtttccgggtacggaacccctaaaacgtaaaccgtaaaaaccggaaggtaacggttaagggaaaacgggttaaaaaagaaaaccgttaagtttacgggtaacgggtacctttacggttagggtaacgggaaacggggtcccgttaaactttacccgaacccgttaaagtttccccctaaaaccgggaacgggtaaaaccaaccccgggaaaaccgtaaccccgggaaaagtaacccgttcgaaacgtttcggttaacttaccgtacggaaactaaaggtaacgaaaccctggtaccctaggaacggacggaacccggaacgtaaccggacggtctttaaagtaccgttaaccgttgtaccgggtaagaccgggtaagtaacgttaaccgtttcccggtatttacccgttacggtttttacccgtttntttttaccgggacgtttacccgg

SEQ ID NO: 46352 - DNA, 655 bp, Homo sapiens
  misc_feature: GYAE6OF02ID4XV.27.57.F02.1.454.CMB.1.raw
  modified_base (171)..(171): a, c, t, g, unknown or other
  misc_feature (171)..(171): n is a, c, g, or t
  modified_base (177)..(177): a, c, t, g, unknown or other
  misc_feature (177)..(177): n is a, c, g, or t
  modified_base (184)..(184): a, c, t, g, unknown or other
  misc_feature (184)..(184): n is a, c, g, or t
  modified_base (187)..(188): a, c, t, g, unknown or other
  misc_feature (187)..(188): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgtttcgtgtagctattanaaggtntcatgtnagnnaatgtgatctggagngtnggtccagcctgagaatcctaganctcnctgcgatacnctcgtagacttctacgttagtagttattcgatagagtcgtcggaccgtacgacgacgaccgagggtacgggctaggtacggttcgacggactaaacgtaacgaaaacgaagtacgaaggtaaaggtaaaaacgtaaaacttagtcggtaacggtacttacgtaggtaacggaacgggtaccgtagttaccaacgactaccgtacgaacgaacgaaactaccgaaacaggtaactagaacttagttagtacgtacgtaacgtaaacgtaacgaacgtacgacgtacgaacggacggaaccggaacgaccgaacggtacgtacgtaacgttacttacgtacgtacgtacggtacggtaacgtaacgttaccgttacgttaacgttacgttacgtttacgtttacgttacgtacg

SEQ ID NO: 46353 - DNA, 528 bp, Homo sapiens
  misc_feature: GYAE6OF02GCFW3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgcagactccagggaaggggctgggagttcgtggccaacataaaccaagatggaaggtaaagaaaactatgtggactctgtgaagggccattcaccatctccagagacaaacgccaaagaagtcaactgtatctagacaaatgaacagcctagagagccgagacacggctgtatactactgtggaccgaggagactaccgtagtcctattcccgtcttttgattccg

SEQ ID NO: 46354 - DNA, 396 bp, Homo sapiens
  misc_feature: GYAE6OF02HQ9EX.27.57.F02.1.454.CMB.1.raw
  modified_base (180)..(180): a, c, t, g, unknown or other
  misc_feature (180)..(180): n is a, c, g, or t
  modified_base (364)..(364): a, c, t, g, unknown or other
  misc_feature (364)..(364): n is a, c, g, or t
  modified_base (382)..(382): a, c, t, g, unknown or other
  misc_feature (382)..(382): n is a, c, g, or t
  modified_base (385)..(396): a, c, t, g, unknown or other
  misc_feature (385)..(396): n is a, c, g, or t
tcagagcgtcgtctcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatacgccttctcccgtccccccttcgcagtaacaccaagtacaggaatattaacctgtttccatcgactacgtcctttcgcctcgcttagggtcactcaccctcgcccctattaacgttgacgaggaacccttggtcttccggngagcggctggcagcgcancgnnnnnnnnnnnn

SEQ ID NO: 46355 - DNA, 542 bp, Homo sapiens
  misc_feature: GYAE6OF02FWDB2.27.57.F02.1.454.CMB.1.raw
  modified_base (382)..(382): a, c, t, g, unknown or other
  misc_feature (382)..(382): n is a, c, g, or t
  modified_base (440)..(440): a, c, t, g, unknown or other
  misc_feature (440)..(440): n is a, c, g, or t
  modified_base (486)..(486): a, c, t, g, unknown or other
  misc_feature (486)..(486): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (527)..(527): a, c, t, g, unknown or other
  misc_feature (527)..(527): n is a, c, g, or t
tcagagcgtcgtctcacgaccggtgctcgatttagctcgatatagttgggtttgaggtctcagagaggagccttagccctggactccaaggccttttccacttgggtggtcagcacggaggcacagaggacccgacccatggaacgtggggcgtgagctgggttttccgtttgttggtctattttagtaaggtgtccacgtgtgaggtggcaactggtggattctggaggaggtgtggtccgagcctggagaatccctgagactctcctgtgcagcctctggattcacctttagtagttattggatgagctggggtccgccagactccaggggaagggggctggagttcgtggccaacataaaccaagatggagggtaaaanaaactatggtaggactctgtggaagggccgattcaccatctccagagacaacgccaanaagtcactgtatctgcaaatgacagcctgagagccgtaggacacgntgtatactacngtgngtacgagactcctagtccatttccgnttttcgatctacggg

SEQ ID NO: 46356 - DNA, 596 bp, Homo sapiens
  misc_feature: GYAE6OF02HPOBB.27.57.F02.1.454.CMB.1.raw
  modified_base (305)..(305): a, c, t, g, unknown or other
  misc_feature (305)..(305): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (372)..(372): a, c, t, g, unknown or other
  misc_feature (372)..(372): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatccctgagactctcctgtgcagcctctggattcacctttagtagttatggatgagtcgtgggtccnccagactccgaggggagggctgggngttcgnggaccaacaataaaccaagagtagggaaggtaaaanaaaacgttataggtagtacttgtaggtggaacgggacctattaccactactctaccgagacgtaaccaacgaccgaaagaacgtccaagttacgtatcttagaactaaactagaaactagccgtagagacgaccggaacggaccgacggtcttagtaactaccttgtaggtgacggagagtacttaccgtagttacctacgtttccgttctttagatttcccgg

SEQ ID NO: 46357 - DNA, 647 bp, Homo sapiens
  misc_feature: GYAE6OF02GH9L3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattcgtggaggaggtgtggtccagcctggagaactcctgagactctcctgtgcagcctctggacttcctacctttagtagtttattggatggagtcgtcggggtcccgccaggacctccggagggggaagggcgtgggtaggtttcgcgggaccaacaataaacccgaagagtagggaaaggtaaaagaaaactgtaggtaggacgtctaggtaggaacgggcctattcacctactccaccgagacgaacgaaccgacgaaacgaagtcacgttagtattcgtagaactaacgtacgaacacgaccgtagaggacggacggacggaaccgacggtacgttacgtaacgttaccgttacgtacgggtacgacggtacggtaacgtacgtaccgttacgttacttaaccgtttcccgtttacgtttttacggactttacccggg

SEQ ID NO: 46358 - DNA, 656 bp, Homo sapiens
  misc_feature: GYAE6OF02IDJUR.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttttagaaggtgtccagtgtgaggtgcaactggtggattctggaggaggtgtggtccagcctggagaatccctgagactctcctgtgcagcctctggattcacctttagtagttattggatgagctgggtccgcagacctccgaaggggagggctagggagttcggtggacctaacaataaaccaagacgtggaaaggtaaaagaaaactagtaggtaggtactacgtggtaggaacggggtccgtaattccgaaccattcctaccgaagacgtaacgaaaccgccaaaggaacgttcaacgttagtactactaggtaccaaaaagtgaaaacgtacggacccttagggaagggaccgtacccggaacggggaaaccacggggtcctaaggtattaaccgttaccgtaggtcggtaccggaaggaacgtaacttacccgttaggtacccttaacgtttcccgttgtttttaccggactttccggg

SEQ ID NO: 46359 - DNA, 615 bp, Homo sapiens
  misc_feature: GYAE6OF02F1JYG.27.57.F02.1.454.CMB.1.raw
  modified_base (546)..(546): a, c, t, g, unknown or other
  misc_feature (546)..(546): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaactccctgagactcctcctgtgcagcctctggtattcacctttagtagttattggatgagcgtggtccgcgagacctccgaggggacggggctggagttcgcgaccaacaactaaaaccaagagtaggtaaaggtaaaagaaaacgtgtagtaggtactcgtgtaggaacgggtccgtaatccgaaccgtatcccactaacggaacgtaaccgaacgtaccgaaaacgaacgtacacgttaacgtatacgttagaacctaaagtacgaaacgtacgacctaggacgaacgccggaagaacgaccgggnttacgtaatacgtactggtagacgtagactacttacgtagtcctacgttccttacgtttagacttccgg

SEQ ID NO: 46360 - DNA, 625 bp, Homo sapiens
  misc_feature: GYAE6OF02HTCIP.27.57.F02.1.454.CMB.1.raw
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagcttggggtccncgagactccgaggggaagggctgggagttcgnggccaanataaaccaagatagggaagtaaagaaactagtggtaggactgtaggtgaacgggccgtaattcacctatcctaccagacgacaaacgaccaaagtaacgtcacgttagtactacgtagaacctaaatacgaaacgacgtaccctaggaagacggtaccggaacgggaacccgacggtaccgtagttaactaaccgttacgttagggtcggacggtaacgaacgttaccgttaccgttacggtcctaacgtttcccggttacgtttttcggaactttaccgg

SEQ ID NO: 46361 - DNA, 642 bp, Homo sapiens
  misc_feature: GYAE6OF02GH4G6.27.57.F02.1.454.CMB.1.raw
  modified_base (211)..(211): a, c, t, g, unknown or other
  misc_feature (211)..(211): n is a, c, g, or t
  modified_base (528)..(528): a, c, t, g, unknown or other
  misc_feature (528)..(528): n is a, c, g, or t
  modified_base (602)..(602): a, c, t, g, unknown or other
  misc_feature (602)..(602): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttattttagaaggtgtccagtgtgaggtgcaactggtgattcngggaggaggtgtggtccagccgtggagaactcccgtgacgacctctctgtgcacgcctctggtattcctactttagtattagttggatgagtcgtcgggtccgccagtacctcggaaggggaacggggcgtggtacgttcggtcggaccaaacgaaactaaaaccaagagtagggaaaggtaaaagaaaacgtagttagtcgtacttacgtggtaggaacgggtccgtaacttaccgacctactcctaccgaaggaacgaaaccgaacgaaccaaagtaacgtccaagttgttacacgtacgaataaacacgaaacncgtacctaaggacgacgaccggaaggaccgacggtactaggttaacacgttaggtcggtaggaacggagtaacncgttacacgttctaaccgtttcgttcttttaggctaccgg

SEQ ID NO: 46362 - DNA, 553 bp, Homo sapiens
  misc_feature: GYAE6OF02F9V4O.27.57.F02.1.454.CMB.1.raw
  modified_base (304)..(304): a, c, t, g, unknown or other
  misc_feature (304)..(304): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctggggtccnccagactccaggggaaggggctgggagttcgtggccaacataaaccaagatggaaggtaaagaaaactagtagtaggactctggtaggaagggccgtattcaccatctccagagacaacgccaaagatacactgtatctagacaaatgaacagacctgagagccgaaggacacggctagtactactacgtgtcggacggtaagagtacttccgtaagttcctactttccggtctttttagactttccgg

SEQ ID NO: 46363 - DNA, 657 bp, Homo sapiens
  misc_feature: GYAE6OF02GLV4P.27.57.F02.1.454.CMB.1.raw
  modified_base (338)..(338): a, c, t, g, unknown or other
  misc_feature (338)..(338): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgagactctcctgtgcagcctctggattctacctttagtagttattggatgagctcggggtccgccagactccgaggggaaggggctggagttcggnggccaacactaaaccgagactaggaaggtaaagaaacgtagtagtaggactcgtgtagaagggccgattcgaaccatcctcgaagacgtacaacgaccaaaggtaacgtaccgagttacggttactacgttagaacgtaaaacgttacgaaacgtaacgccgtagggtaacggaacggtaccggaacgggaaccggaccgggtacgttacggttaaacttaccgttacgtaggttacggaacggaaggtaacgttaacgttacccgttaacggtccgtttaacgttcccgtttacgttttttacgtacgtttaccccgg

SEQ ID NO: 46364 - DNA, 967 bp, Homo sapiens
  misc_feature: GYAE6OF02IPNN9.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagagtgtccagtgtgaggtgcaactggtggattctggaggaggtgtggtccagcctggagactcccctgacgactctcctgtgcacgcctcgtggtacttccacctttagttagttagttggtatgagcgtcggggccgccgaacgaccgtaccggaagggggaacggggtccgttagggtacggtttcggtacgggaacccgaaaccgtaaacttaaaaacccgaaaggtaacggttaagggggtaaaacgggttaaaaaacggtaaaaaaccgtttaggttacggggttaacgggtaaccgtttacggttacggggttaacgggtaaaccggggggtccccggtttaacgttttaccccgaaacccttaaccggttttaacccccgaaaccccggtaaaacggggtaaaacccggtaaaaccccggtaaaaacccggtaaccccgtaaaaaaaaccggggtaaaccggtttaacccccgttaaacggttttaacgggtttaacctttaaccccggtaaggtaaaacccgttaaaaaacggtaccgggtaaaaccgtaaaccgggtccccggttaaagggggaaaaccgggtacccggaaccccggggtaaagggaaaccccgggtaaacccgggttacgtttaaccggtttaaacccgttaaccctttacgggttaaggtttacccggggaaccggtaacgtaacggttaccgtttaaccccggtttaaccgttccggtttaaacccgttttccccggttttaccgttttttaccggacgtttaccccgggg

SEQ ID NO: 46365 - DNA, 576 bp, Homo sapiens
  misc_feature: GYAE6OF02IMGRD.27.57.F02.1.454.CMB.1.raw
  modified_base (345)..(345): a, c, t, g, unknown or other
  misc_feature (345)..(345): n is a, c, g, or t
  modified_base (434)..(434): a, c, t, g, unknown or other
  misc_feature (434)..(434): n is a, c, g, or t
  modified_base (464)..(464): a, c, t, g, unknown or other
  misc_feature (464)..(464): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggtattcacctttagtagttattggatgagcgtgggtccgccagacctccaggggagggctggtaggttcgtggaccaanataaaaccaagagtaggaagtaaaagaaaactataggtgactacgtgtaggaagggccgattcgaaccatcctaccagaacgacaaacnccgaaagacgtacaatgtatctagacaaangtaaacagaccgtagaagacggaccgaggaccgacggtctagtactaccgttactggcggacgaagaagtaccttcgtagtcctacgtttccgttacttttagacttaccgg

SEQ ID NO: 46366 - DNA, 631 bp, Homo sapiens
  misc_feature: GYAE6OF02GNUSG.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctggaggaggtgtggtccagcctggagaatccctgagactctcctgtgcagcctcgtggacttcacctttagtagttattcggatgagtcgtgggtccgcagactccgaggggaagggctgggagttcgtcggccaagaactaaaccgagagtggaaggtaaagaaaactagtagtggactcgtagtagaagggccattccacctatctaccagacgacgaacgaccaaagtaacgtacaacgttgtaactctagaactaaagtacgaaacaacggtccgtaggaacgacggtaccgggaacgggaccgaacgggaccgttaggtaacctaacgttactagggttacggaccggtaaggaacggtacgttaccgttaagttaccgttacgtttacccgtctttttacggacgtttacccgg

SEQ ID NO: 46367 - DNA, 657 bp, Homo sapiens
  misc_feature: GYAE6OF02HRJ23.27.57.F02.1.454.CMB.1.raw
  modified_base (262)..(262): a, c, t, g, unknown or other
  misc_feature (262)..(262): n is a, c, g, or t
  modified_base (344)..(344): a, c, t, g, unknown or other
  misc_feature (344)..(344): n is a, c, g, or t
  modified_base (638)..(638): a, c, t, g, unknown or other
  misc_feature (638)..(638): n is a, c, g, or t
tcagagcgtcgtctcacgaccggtgctcgatttagctcgatatagttgggtttggaggtctcagagaggacgccttagccctggactccaaggcctttccacttggtgatcagcacggagcacagaggacccacatggaactggggctggagcgttgggttttccttgttgctattttagaaggtgtccagtgtgaggtgcaactggtggacttgtggaggaggtgtggtccagcctggagaatccctgagactctcctgtncacgcctctggattccactttaagtgttattggatgagcgtcgggtccaccgaagcctcgaagggtagggcgtggagttcgngaccaagtaactaaaccgaagtagtagggaaagtaaaacgtaaactgtagtacgtactgtaggaggacggacgtattacccgaacctaatccgtaccaaaggtaccgaaccgaaacgtccgaaagtaacggtcaaccgttgtaactcggtacaacgaaaacgtcaaacacgtaccgtacgaagtaccggaaccgaacggaccgaacggttgtaacgttaactaccgttaacgtgggtaacacgggtaagacttaaccgttaccgtacggttaccgaaccgtttttcccggtttnttttagaccgtttaccggg

SEQ ID NO: 46368 - DNA, 734 bp, Homo sapiens
  misc_feature: GYAE6OF02HKJ86.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctggagctgggttttccttgttgcttattttagaggtgtccagtgtgaggtgcaacgtggtggattctgggaggaggtgtggtccagcctaggagaatccctgagactctcctgtgcagcctctggtattctacctttagtagtttatggatgagcgtcgggtccgccagcctccggaggggaacggggcgtgggtacgttcggtcggaccaacgtaaactaaaaccgaaagagtagggaaaggttaaaaacgaaaacgttagtaggtagggtactcgtagggtacggaaacggggaccgtaagtttaccgaaccgtaattcccgtaccgaaggtaaccggaacctaaaccgaacccgtaaaagggaaacgtaccgaaccttaggtaacttcgtaacgaacgtaaaattcggaaactacggacccgttagggaacgggaacggacccggtaacggaaccggtaccgggtaccttaaggttaacttaccgttaaccgttgggttacggaccgaagggtaacgaacgtttacccgttaacggttccttaaaccgtttcccggtttacgtttttacggacctttacccgggg

SEQ ID NO: 46369 - DNA, 699 bp, Homo sapiens
  misc_feature: GYAE6OF02JEE3L.27.57.F02.1.454.CMB.1.raw
  modified_base (624)..(624): a, c, t, g, unknown or other
  misc_feature (624)..(624): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctggtttcctgttgctattttagaggtgtccagtgtgaggtgcaacgtggtggattctgggaggtaggtgtcggtccaggcctggagaatccctgagactctcctgtgcagtcctcgtggtacttcctaaccttttagtacggtttaattgggtaatcggacgtcggtcggggttcccgaccaggtacctcccggaagggggaacggggcttagggacgtttcggtggaccctaaacaactaaaaccaggaacgtaggggtaaaggtaaaacgaaaactttgtggtacggacttcgtaggtacggaaacggggtccgtaattccgaacctattccctaccgaagtaacgaaaccgaaaccgaccaaaggaacgtcctaacgttagtactcgtaggacctaaagtcgaaacgtcgaccgttagaacggaacggtaccggaaggaaccgtaccggtcttaagtaacctagttaccgnggttacggacgtaggtaagaccgtttacctacggtaccttaccgttacccgtttcgttttaacgcgtttacccgg

SEQ ID NO: 46370 - DNA, 831 bp, Homo sapiens
  misc_feature: GYAE6OF02H8IFS.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacagaggacccacatggaactggggctgagctgggttttccttgttgcttatttagaaggtgtcagtgtgaggtgcaacgtggtggtattcgtaggggagggagggttggtcggtccgacggccgtagggaacgtaaaccgtcccgttaggacggtaccttccgtccgttggtcggtcgtaacgtcccgttcgtagggttaacttccgttaaccgtttaaggttaagtttaagtttggagttaggaggtccggttacggggtccccgaccgtaacggtacccggtaccgggtaacggggggaaacgggggtcggtagggttacgggttccgggtaccgggtaacccaaacgtaaaaccttaaaaaccgaaggtaacggttaagggaaaaggtaaaaacgtaaaacgtagtaacggtacgtacgtacgtagggtacggagggaccgttataccgacctatacctacgagaacgtaaccgacgtaaccgaaacggatacctaacggttacgtattactagtaaacgaaacgtaacgtaaacgacggtaccgtacgacgggtacccgacgggtaacggaacccggtaggtacgttaacgttaactaacggttaccgttagggtcggaacgggtaacgtaaacgttacccgttaaccgggttacgttaaccgtttcccgtttaaccggttttccttttaccggtacgttcccggg

SEQ ID NO: 46371 - DNA, 673 bp, Homo sapiens
  misc_feature: GYAE6OF02JOQWM.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagccgtggagaatccctggacgactctcctgtgcagcctcgtgattcctacctttagtagttagttggatgagtcgtcgggtcccgccgagacctaccggaagggggaagggcgtagggtagttcggtcggacctaacaacctaaaccgaagacgtagggaaaggttaaaacgaaaaacgttgtaggtcggtaacttcgtacggtaggtaacggggaccgtacgttacaacccgtataccgtaccaggacgtaaccaacgtaacccaaaggtacgtaccaacgttcgttaatccgtatacgaaacttcggaacacggtactacggaacgacgaccgggtaacgaacggtacggccgttaggttaacctacgtacgttagcggtaccgaggtacgtacgttaccttacgtaccgttaccgttccgtttacgttttacgagttccgg

SEQ ID NO: 46372 - DNA, 683 bp, Homo sapiens
  misc_feature: GYAE6OF02HT2K5.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtgggaggaggtgtggtccagcctggagaatccctgagactctcctgtgcagcctcgtggattctacctttagtagttattgggatgagcgtcggggtccgcgtagaccgtaccgagggggaacggggcgtagggagtttcggtcggaccaaacgaacttaaaaccgaaggtagtaaggggaaaaggtaaaaacgaaaacttaggtacggtagggtaacttacgtagggtagggaaacgggtccgtaacgttacccgaacctcttaccgttacccgaaaggaacgaaaccgaaccgtaaccgaaaggtaaactcctaacgttagtaactacgtacgaactaaagacgaaactacgaccgttagggaacgaccgggaccggaaggaaccgtcgggtacttagtaacttaccgttactgggtacgtacgaaggacgtactccgttaagtcctaagttcccttagtttcacgttcg

SEQ ID NO: 46373 - DNA, 567 bp, Homo sapiens
  misc_feature: GYAE6OF02IC5IO.27.57.F02.1.454.CMB.1.raw
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttttccttgttgctatttttagaaggtgtccagtgtgaggtgcaactggtggattctggaggaggtgtggtcagcctggagaatccctgagactctcctgtgcagcctctggattcacctttagtagttattggatgagctggtccgccagactccagggaagggctggagttcgtggccaaacataaaaccaagatggaggtaaaagaaaaactatagtggactctgtgaagggccgattcaccatctccagaagacaaacgccaaagtagtacaactgtaatntacgnaaaactgaaaacagccctagagaagcccgtaagcctaacgggctaggttaactactaaccgttgcggtaccgagaacggtaatccctaggttacaactttcccggcttttttgattacccg

SEQ ID NO: 46374 - DNA, 842 bp, Homo sapiens
  misc_feature: GYAE6OF02G0PXP.27.57.F02.1.454.CMB.1.raw
  modified_base (805)..(805): a, c, t, g, unknown or other
  misc_feature (805)..(805): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggttttcctgttgctatttagaggtgtccagtgtgaggtgcaacgtggtggattcgtgggagggaggtgtggtcccagcccgtaggagaactcccgtagacgtacttcctccgtggtcgacacgtcccttacgtggttactttcctaacctttttaaggttacgttttaaggttagggtagttacggacgttccggtaccgggggttcccgaacccgtaacgtaccggttacccggaaagggggggtaacgggggtcgttaaggggtaccgggttttccggtaccgggtaacccctaaaacgtaaacgttaaaaacccgaaggtaggttaacggggaaaagggttaaaaacgaaaacgtttacgttacgggttaggaacctttggtagggtacgggtaacggggtaccctaaggtttaccccaaacccgttcttacccgttaccggaaagggaacccgtaaacgtaaacccgaaccgtaaaaccggtaacgtacccgttaacgtttaacggttaaccttcctaagggttaaaccaaaagtttaccggaaaccgtacccgtaccggtaaggacggaacccggtcggaacgaccggagttcttagtaactacgtcgttacgggctaaaccgggagacgttccgtaaccgtttancccgttaacgtttcccgttattttccgaagtcccggg

SEQ ID NO: 46375 - DNA, 666 bp, Homo sapiens
  misc_feature: GYAE6OF02IORKG.27.57.F02.1.454.CMB.1.raw
  modified_base (399)..(399): a, c, t, g, unknown or other
  misc_feature (399)..(399): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcggtcgtttcgtcgtaggctatttagaaggtgtcagtgtgagtgcaatggtggattctggaggaggtgtggtccagcctggagaactcccgtggacgactctccgtgtgcagcctcgtggattccactttagtagttattggaatggagtcgttcgggcccgcaggacctccggaaggggtaacgggctagggcggtttcgacgggaaccaataaacgtaaaaccgaagtaagtagggtaaaggtaaaanaaaaccttgtaggtacggaactcgtgtacgggaacgggccgtattaccgacctacttacctccgaagacgaacgaaccgaccaaacggactacgtaacttagtacgttacctagtaactaaacgtagaacgacgttaccaggacgaacggccggaacggtaaccgacggacgttacgtaactacgttaccgtaggtcggtaaccggaggtaccgtacgttaccgttacgtcccgttaacgtttccggttactttttcggactttcgg

SEQ ID NO: 46376 - DNA, 657 bp, Homo sapiens
  misc_feature: GYAE6OF02HBQ3Q.27.57.F02.1.454.CMB.1.raw
  modified_base (317)..(317): a, c, t, g, unknown or other
  misc_feature (317)..(317): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaaggtgtccagtgtgaggtgacaacgtggtggattctggaggaggtgtggtccagccgtggagaactcccgtgacgacctccccgtgtcgcagcctcgtggtattcgtacctttagtagttattggatgagtcgtgggtccncagtacctccggaggggaacgggctagggtagttcggtggaccaaacaactaaaaccgaagtagtagggaaagtaaaagaaaacttagtaggtacggtacttcgtaggtacggaacgggtccgtaattccgaacctagtccctaaccgaaggtaacgaccaaaccgaccaaaggtaactcgaacttagtaactcgtaagaactaaagtacgaaactacgccgtaaggacgacggaccggaagaccgacggtacttagaacttaccgtagtggtacgaccggtagaacggtcttaccggtattccgtaacgttccggttacttttcgacgttccgtacggg

SEQ ID NO: 46377 - DNA, 753 bp, Homo sapiens
  misc_feature: GYAE6OF02HVOKG.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgttgggtttttccttgttgcttagttttagaaggtgtccagtgtgaggtgcaacgtggtgattcgtggaggaggtgtggtccagccgtggaagaactccctgacgactcgtcctgtgcacgccttcgtggactttcctaccgtttagttagttattggatagacgtcgttggggtcccgaccgaagtacctaccggaaggggaacggggtcgttcgggaacggtttccggtacggaccctaaaacgtaaacttaaaacccgaaaggtagttaacgggggaaaaagggttaaaaaacgtaaaaacgttagttacgggtacggtaacgttccggttaggtagggaaacggggtccctaagttacccaaccgttaacgtttccgtaaaccaaggtaaacgaacccgtaaaaccggactaaaaggtaacccgttacaaccgttagttaactacgttacgaaactaaagtaacgactaacgtccgtagaacgaccgggacccgtaaggacccgaaaggtcttaagaaccttacgtaaggtcggtaacggagttaggaaccgttacgtccgttagtctaacgttcccggttttattcgaatttcccgg

SEQ ID NO: 46378 - DNA, 781 bp, Homo sapiens
  misc_feature: GYAE6OF02H1Y73.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgttgggttttccttgttgcttattttagaggtgtccagtgtgaggtgcaacgtggtggtacttcgtgggaggaggttggtggtccacggtcctagggacgaatcccgtgacgtacctctcctgtcgcacgtcctcgtggtacttactaccgttttaagttagttagttggattggacgtcgttcgggtccgaccgtacgaccgtcggaaggggtaacggggtcgtagggtacgttccggtacggacccaaacgtaaacgtaaaaccgtaaggtaacggtagggtaaaaggttaaaaacgtaaaacgttagttacgggtacggtacgttcgttacgggtaagggaaaccggggtcccgttaactttaccgaaccttaacgtcccgttaacccgaaggtaaaccggaaacccgtaaacccgaacccgtaaaaggtaaccggttaccgtaaccgttaggttaacttcgttacgaaactaaaagttaaccggaactaaccggtcccgtaagggaaccgacggacccggtaacgggtacgaccggtctacgttaactaccgttaggtcggtcgacggtaagtacgttaccttaccgtagttaccgtacgtttcccgttagttttacgcgtttccgg

SEQ ID NO: 46379 - DNA, 625 bp, Homo sapiens
  misc_feature: GYAE6OF02GUIJI.27.57.F02.1.454.CMB.1.raw
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggagaggtgtggtccagcctggagaatccctgagactctcctgtgcagcctntggattccacctttagtagttattggattgagtctgggtccnccagactccgaggggaagggctgggagttcggnggccaacgactaaaccaagagtaggaaggtaaagaaaacgtataggtaggtacttcgtaggtacggaacggggtcctaattccaaccactcctacccaaggtacgaaccaacgaccaaagaacgtccaacttgtactactgaacaaatcgaaacgagtaccctagtacgaacggaccggaacggacctaccgggacttacggttaacttacgttacgtaggtacggacggtaaggaacgtaccttccgtacgttccgtacgtttccggtacttttcgacgtttccgg

SEQ ID NO: 46380 - DNA, 547 bp, Homo sapiens
  misc_feature: GYAE6OF02FIFCB.27.57.F02.1.454.CMB.1.raw
  modified_base (306)..(306): a, c, t, g, unknown or other
  misc_feature (306)..(306): n is a, c, g, or t
  modified_base (444)..(444): a, c, t, g, unknown or other
  misc_feature (444)..(444): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggatttctggaggaggtgtggtccagcctggagaatccctgagactctcctgtgcagcctctggattctacctttagtagtttattggatgagctgggtccnccagactccgagggaaggggctgggagttcgtggccaacataaaccaagatggaggtaaagaaaactatgtaggactcgtgtagaagggccgattccaccatctccgagagacaacgaccaagaagtcacgtatatcngacaaatcgaacagctagagagaccgaagaccacggctagtaatacgtaactggttacggcgaaggagtacttaccgtagtcatttccgtcttttggattccg

SEQ ID NO: 46381 - DNA, 599 bp, Homo sapiens
  misc_feature: GYAE6OF02GERSD.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtgcagcctctggattcctactttagtagttattggatgagcgtgggtccgccagacctccgaggggagggctgggagttcgtggaccaacaactaaaccgaagagtagggaaggtaaaagaaaacgtagtaggtaggtacttcgtaggtaggaacgggaccgtattccgaacctatcctaccaaggacgaaccaaccgaccaaagacgtaccaacgttagtactcgtagaactaaatgaaccagtcctaggacgacggaccgaaggacacggtctagtactactacgtggcgacgaagagtactaccgttagtaccttacgttccgtacttttacgcttccgg

SEQ ID NO: 46382 - DNA, 597 bp, Homo sapiens
  misc_feature: GYAE6OF02GR6S8.27.57.F02.1.454.CMB.1.raw
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagcccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaactccctagagtacctctcctgtcgcacgcctctggattcctacctttagtagttattggatgagtcgtgggtccncagacctcggagggagggctagggtacgttcggtcggaccaaacgataaaacccgaagtagtagggaaaggtaaaagaaactagtggtagactgtgtaggaacgggtcctattaccactactccgtacagtaacgaaccaacgaccaagaacgtcaacttagtatcagaacaatagaacacgacgtagaagacgaccggagacacggtactagtactacgtacgtgcggacgaggacgtacttacgtacgtacttacgtttccgttacttttagccgtttacgg

SEQ ID NO: 46383 - DNA, 682 bp, Homo sapiens
  misc_feature: GYAE6OF02HNNWQ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctcgggtccgccaagacctccgaggggaacggggcttgggagttcgtgggacccaacgattaaaacccgaagatagggaaggtaaaagaaaacttagtaggtaggaacctcgtagttagaaacggggtccaatttccgaacctacgtcctaccgaaggacgaaccgaaacgacccgaaaggaaacgtaccaacgttacggttaactccgttagaactaaatacggaaaccaagtcccgttagaacggacggacccggaaagggaccgtacgggaccgttacggttaacgttaaccgttacgtaggttacggaccggtaaggtacggtaacttacccgttaggttaccgtaacgttttcccggttacgttttttacggactttacccggg

SEQ ID NO: 46384 - DNA, 670 bp, Homo sapiens
  misc_feature: GYAE6OF02IYXZU.27.57.F02.1.454.CMB.1.raw
  modified_base (525)..(525): a, c, t, g, unknown or other
  misc_feature (525)..(525): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaaggtgtccagtgtgaggtgcaactggtggattcgtggaggaggtgtggtccagcctggagaactccctgagactctcctgtgcagcctctggtattctacctttagttagttattggatgagtcgtcgggtccgccagtacctccgaaggggaggggctagggacggttcggtcggaccaacaactaaaaccaagagtagggaaaggtaaaagaaaacgtataggtggactagtaggtaggaacgggtaccgtacttaccaacctactaccgtaccaaggaagaacccaaaccgtaccgaaaaggtaacgtaccaacttacgtaactctacgaaactaaatagaaaccncgtaccgagaacggcggacccgggaacgggaaccggtacggtaccgtacgttaacttaaccgttccgtagggtacggcggtaagaacggtaacttacccggttacgtacttaacccgttccggtttactttacgtaccttccggg

SEQ ID NO: 46385 - DNA, 695 bp, Homo sapiens
  misc_feature: GYAE6OF02JQS4A.27.57.F02.1.454.CMB.1.raw
  modified_base (354)..(354): a, c, t, g, unknown or other
  misc_feature (354)..(354): n is a, c, g, or t
tcagagcgtcgtctcacgaccggtgctcgatttagctcgatatagttgggtttgaggtctcagagaggagccttagccctggactccaaggcctttccacttgtgatcagcacggagcacagaggacccaccatggaactggggctgagctgggttttccttgttgctattttagaaggtgtccagtgtgaggtgcaactggtggattctggaggaggtgtggtccagcctggagaactccctgagaccgtctccgtgtcgcacggtcctcgtaggacttcctacctttaggtacgttattggatggacgtcgttgggtcccgccgagtaccgtaccggaaggggaacggggtntggggtacgttcggtcggacccaacaaactaaaccgaaggacgttagggaaaggtaaaacgaaaacttgtacgtacggcttacgtaggtacgaacgggccgttactacgacccgtatccgtaccgaaggtacgaaccgacgtaaccgaaagtaacgtccgtacgttacgtaatcgtacggaactaaacgtgaaaaccggtccgtaacctaggggaacacggggtaccgaacggtaccgaacggtcgttagtaacgtaacccttgacggtcggaacctaacggaagtaccgtttcgaacgttcgtaaccgttttcccgtaggtttttacaccggtttaccgg

SEQ ID NO: 46386 - DNA, 735 bp, Homo sapiens
  misc_feature: GYAE6OF02HA1EC.27.57.F02.1.454.CMB.1.raw
  modified_base (602)..(602): a, c, t, g, unknown or other
  misc_feature (602)..(602): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaacgtgggtggattctggggaggaggtgtggtccagccgtaggagtaactccctgagactctccgtgtagcgacgtcctcgtggtacttctaccgtttagtacgtttattcgggatcggtagtcgtcgggtacccgcaaggtacctaccggagggggaacgggtcgtaggtacggtttcgacgggaccctaaaacaacgttaaaaacccgaaggttagaggggtaaaagggttaaaaaaacgtaaaaccgtttagtacggtacgggtaaccttaggtacggtagggaaaccggggtacctagtttacccgaacctagtcccgtaaccgaaaggaacgtaaaccgaaacgaccgtaaaacggaacgtctaaacgttggtaacttcgagtaacaaaagtacgtaaacncggtacctaggaagacgtacccgaagggtaaccgaggtaccttagtactaccgttaatcgggtaagccggtaagaacgtacgttacccgtagttaccctacggttacccggtttacttttaggaacctttcgg

SEQ ID NO: 46387 - DNA, 762 bp, Homo sapiens
  misc_feature: GYAE6OF02IPN27.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaagtgtcagtgtgagtgcaacgtggtggattcgtggaggaggtggtggtccagccgtggagaactcccgtgacgtacctctccgtgtcgcacgccctcgtggtactttcctaacctttagtacgtttagttggagtggacgtcggttcggggtccccgaccaacggtacccgttacccgggaagggggggtaacgggggtccgttaggggtacgggttttcccgggtacgggtaacccctaaaaacgtaaaaccgtaaaaacccgaaaaggtaggtaaacggggtaaaagggttaaaaaacgtaaaaacgtttagtaggttacggtaacttaccggtagggttaacggggaaacggggtacccgttaattccccgaaacctccgttaacccgtaccgaaggtaaaccgaaacccgaaaccggaaccgaaaaggaacgttacctaaccttgttaaacctcgtaagaaccgtaaaatcgaaactgaccgtaggaacgcgacggaggaccacggtactgtaacctacgttgtagggcacgtagacgtacttcgttagccttacgttccggttactttcggagttcccg

SEQ ID NO: 46388 - DNA, 651 bp, Homo sapiens
  misc_feature: GYAE6OF02F8E5M.27.57.F02.1.454.CMB.1.raw
  modified_base (605)..(605): a, c, t, g, unknown or other
  misc_feature (605)..(605): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattcgtggaggaggtgtggtccagcctggagaactccctgagactctcctgtgcacgcctgtcggacttcctaccgtttagtagtttagttcggattaggagtcgttcggggtcccgccacgaccgtacgaggggaacgggctagggtacgttcggtggacccaacaataaaaccaaggacgtaggggaaagtaaacgaaaacgtagtcgtaggactcgtggtacggaacgggtcctagttccaacgtactccgtaccgaagacgaaccaaaccgtaaccgaaacggtaacgtacctaacgttagtaacgtcgtagaactaaacgtgaaaccgtacgtccgtagaacggacggtacccgaagccaccgggtctaacgtatacgtctacgggtcgacgtanacggtactacgtacgttccaaccgtttcttacgttgtaccgttcgg

SEQ ID NO: 46389 - DNA, 725 bp, Homo sapiens
  misc_feature: GYAE6OF02IERD4.27.57.F02.1.454.CMB.1.raw
  modified_base (192)..(192): a, c, t, g, unknown or other
  misc_feature (192)..(192): n is a, c, g, or t
  modified_base (436)..(436): a, c, t, g, unknown or other
  misc_feature (436)..(436): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggttttcctgtgctatttagaggtgtccagtgtgaggtncaacgtggtggtattcgtggaggaggtgtggtccagccgttaggagaactcccctgagactctcctgtcgcacgtcctcgtggtacttcctaactttagtagtttaagttggataggagtcgttcggggtcccgaccgtaacggaccgtaccggaagggggaacggggtcgtagggtacggtccggtacggacccaaacgtaaacgtaaaaaccgaaggtaggtaagggtaaagggtaaaaaanaaaacgttagtaggtacggtacttcgtaggtaggaacgggacccgttataccgaactacttaccgtaccgaagaaccggtaaaccaaaccgacgtaaaggaacgtacctaacgttagtaactcgtacgaacaaatacgaactacggacgtagaacgacggaccggtaaacggaccgtacggtacttaacggtacttaaccgtaccggtagtacggaagaacggtacgtaaccgttacccgtagttaccttaaccggtttcccgttaacgtttttccggaatttcccggg

SEQ ID NO: 46390 - DNA, 614 bp, Homo sapiens
  misc_feature: GYAE6OF02HODAO.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaatcccctgagactctcctgtgcagcctctggattctacctttagtagttattggatgagctgggtccgcagactccgagggaggggctgggagttcgtgaccaacactaaaccaagatagggaaggtaaaagaaaactagtagtaggtaactcgtaggtaggaaggggtccgactttcaaccctatcctaaccgaaggtaacgaacaaaccgaccaaaggtaacgtcaccgttgtactactacgacaaacgtacgaacacgtccgtagaagacggaccggaacggaccgacggcgtagttactacttacgtaggtcgacggagtacggtacttaccgttagtaccttacgtttcccgttacgtttttgacttccgg

SEQ ID NO: 46391 - DNA, 614 bp, Homo sapiens
  misc_feature: GYAE6OF02FZ0JP.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactcctcctgtgcagcctctggattctacctttagtagttattggatgagcgtcgggtccgccgagacctccgaagggggaaggggctagggaggttcggtcggaccaacaataaaaccgaagagtagggaaggtaaaagaaaaactagtaggtaggaactcgtggtaggaacgggtaccgtaattccaacctatcctaccgaaggaacgaacaaaccgaacccaaaggtaaacgtccaacgttagtaacttcgtagtaacaaatagaaaccagaccgtgaagacgaccggaaggaccacggtctagtactactatggtcggacgaggacgtatccgtagtacctacgttccgtacttttgacttccg

SEQ ID NO: 46392 - DNA, 676 bp, Homo sapiens
  misc_feature: GYAE6OF02HY06L.27.57.F02.1.454.CMB.1.raw
  modified_base (660)..(660): a, c, t, g, unknown or other
  misc_feature (660)..(660): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggttttcctgttgctatttagaaggtgtccagtgtgaggtgcaactggtggattctggaggaggtgtggtccagcctggagaatccctgagactctcctgtcgcacgccttcgtggacttcctacctttagtagtttaattggattggagtcgtgggtcccgccagacctccggaggggaagggctgggtagttcggtcggacctaaacgaactaaaccgaaagacgttacgggaaaggtaaaacgaaaacttagtaggtacggtacctgtcggtaggaacgggccgtattaccgaacctatacctaccgaaaggtaccgaaaccgtaaaccggaccaaaaggtacgtacccaacgttacgtaacttccgtaggtaaactaaaacgtcgaaaaccgtacggtacccgtagggaacgaccggaccggaacgggaacctacgggacttagtaacttaccgtagtcggtacgcgtaagacgtactccgtagtacctacgtttacccggtnttttacggacttccgg

SEQ ID NO: 46393 - DNA, 740 bp, Homo sapiens
  misc_feature: GYAE6OF02HJ1PE.27.57.F02.1.454.CMB.1.raw
tcagagcgtcgtctcacgaccggtgctcgatttagctcgatatagttgggtttgaggtctcagagaggagccttagccctgggacctccaaggcctttccacttggtgatcagcacggagcacagaggacccaccatggaactggggctgagcgttgggttttccttgttgcttattttagaaggtgtccagtgtgaggtgcaacgtggtggtattcgtgggaggaggtgtggtccagccgtggagaactccctgagactctccgtgtgcacgtcctcgtggtactttcctaccgttttagtagtttagttggtatggagtcgtcgggtcccgaccgagacctccggaaggggacgggcgttagggtacgtttcggtacgggacccaaacgtaaactaaaacccgaaaggtagtagggaaaaggttaaaaacgaaaacttagtaggtacggtaaccttcgttaggtacgggaaaccggggtacccgttacgtttacccaaccgtacttacctacccgtaaagtacgaaacccgaaaccgtaacccaaaaggtaaccgtacctaacgttacgttacttaccgtagtaaccaaaagtacgaaaccgacgtacccgttagacggaaccggtaccggacggaaccgacggtactagttaactaccttagtcggtcggaaccggtagtaacgacttaccgttacggtaccttaccgtttaccgttcgtttttacgatttcccggg

SEQ ID NO: 46394 - DNA, 695 bp, Homo sapiens
  misc_feature: GYAE6OF02HJQHW.27.57.F02.1.454.CMB.1.raw
  modified_base (264)..(264): a, c, t, g, unknown or other
  misc_feature (264)..(264): n is a, c, g, or t
  modified_base (564)..(564): a, c, t, g, unknown or other
  misc_feature (564)..(564): n is a, c, g, or t
  modified_base (580)..(580): a, c, t, g, unknown or other
  misc_feature (580)..(580): n is a, c, g, or t
  modified_base (680)..(680): a, c, t, g, unknown or other
  misc_feature (680)..(680): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcttgggttttccttgttgctattttagaggtcgtccagtgtgaggtgcaacgtggtggattctgggaggaggtgtggtccagcctaggagaactcctggataccgtctccgtgtncgacgtcctcgtggatttacctaccgtttaaggttatttagttggagtaggacgtcgttcggggtcccgtacccgaagtaccctcggaagggggtaacggggccttggggtaaccggttcggttccgggaacaaaacgtacgtaaaaaccgaggtaagtagggaaaggggtaaaacaaaacgtagtggtaggacttacgaggttcgggaaaagggccgtaattcgaacccgtacttactaccgaaggaacgaaccaacggacccaaagtaacgtcacgttaacgtaattccgtacggaanaaccgtagtaaaccgnggttacctagacggtacgggacccagggaacgacgcgtagacttacgcgtagcgtaaccggagaacgttactaccgtacgtacttcgtttacccggtttntttacccgattcggg

SEQ ID NO: 46395 - DNA, 938 bp, Homo sapiens
  misc_feature: GYAE6OF02GMH0G.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttggttttcttgttgcttatttagaaggtgtccagtgtgaggtgcaacgtggtggattcgtgggaggaggtgtcggtccaggtccgtggagaactcccgtgacgtacctctcctgtcgcacgcctcgtggtacttcctaccgtttagtagtttagttggatggacgtcggtcgggtcccgccgaacgtacccgtaccggaagggggaacggggtcgtagggtacggtttcggtacggaccctaaaacgtaacgttaaaaacccgaaaggtaacgttaacggggaaaagggtttaaaaaacgtaaaaaccgtttaagttacgggttaacgggtaacctttcggtttaacgggtaagggggtaaacccggggttaccccggttaacgttttaccccgaaaccccgttaacgtttccccgtaaaccccgaaaggggtaaacccgtaaaacccgtaaaacccgggaaaccccgtaaaaagggtaaacccggttaccctaaacggtttcggtttaaaccgtttaccgttaacggaaacccttaaaaaggttaccggaaaaccggtaaccggttacccggtaagggaaaccgggtaacccgggtaaccccggggaacgggtaaaccccggaacccggggttaacgtttaaccgggtttaacctttaaacccggttaaccggttacgggtacgggtaaccgggaacgtaacggttaacccgtttacccgtttaacgttacccggtttaccgtttacccccgggttttagtttttaccggtaccgtttcccgggg

SEQ ID NO: 46396 - DNA, 662 bp, Homo sapiens
  misc_feature: GYAE6OF02H7HCK.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactgggtggattcgtggaggaggtgtggtccagcctggagaactccctgagactctcctgtgcagcctcgtggattccacctttagtagtttagtggattgagtccgttgggtcccgccgagacctcggaggggaaggggctagggtagttcggcggaccaacaagtaaaaccaagagtaggaaaggtaaaagaaaactagtggtagtactgtaggaggaacgggtccgtaattccgacatcctacgagacgaacaacgaccaaagtaacgtacctaacgttacgtacttacgtacgaaactaaagtacgaactaacggtaccgtaggaacgacggaccgaacgggaccacggtaccttaagtacctaacgttacgtaggtcggaaccggtaagtacgttaaccgttcccgttaagttacccgttaacgttttccccgtttagtttttacgaacgtttcccggg

SEQ ID NO: 46397 - DNA, 656 bp, Homo sapiens
  misc_feature: GYAE6OF02JJM3G.27.57.F02.1.454.CMB.1.raw
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
  modified_base (319)..(319): a, c, t, g, unknown or other
  misc_feature (319)..(319): n is a, c, g, or t
  modified_base (457)..(457): a, c, t, g, unknown or other
  misc_feature (457)..(457): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcgtgtagctatttagaaggtgtcagtgtgaggtgcaactggtggattcgtagggaggnggtgtggtccagccgtaggagaatccctgacgtctctccgtgngcagtcctcgtggtacttctaacctttagtagtttagttggatgtaggtcgtcgggtccncgtagacctccggaaggggaacggtctgggtagttccgggtaggacccaaagaactaaacgagagtaaggaaggtaaaacgtaactagttagacggtaacttcgtaggtagggaacggtcctattccgacctagtccnccgaagacgaaccacgccaaagtacgtacacgttgtaactcgagactaagctaacgcgtacgtagacgacggaccgaagaccgacggtcttaacgtacgtacgtaccgtaggttcccggaaaggtaccgaggttaccttaccgggttaacttcccgttaaacgtttccccggttttaagttttcggacccgtttccggg

SEQ ID NO: 46398 - DNA, 829 bp, Homo sapiens
  misc_feature: GYAE6OF02HAP5G.27.57.F02.1.454.CMB.1.raw
  modified_base (249)..(249): a, c, t, g, unknown or other
  misc_feature (249)..(249): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccagtggaactggggctgagtctgggttttcctgttgctattttagaaggtgtccagtgtgaggtgcaactggtgattcgtggaggaggtgtggtcagcctggagaactcccgtaganaccgttctcctgtcgtcgacgtccttcgtaggtactttaccgtaccgttttaagttacgtttaagttgggtacttaggacgtcggtcggggtcccgaccgtaacgaccgtcccggaagggggtaaggggtccttacgggtacggtttcggtcgggtaaccaaacgtaactaaaaccgaagtaacggtagggtaaacgggtaaaaacgtaaacgttagtaggtacggtaacgttacgtgggtaacggaaacggggtcctaacgttaccgaacctctacccgttaaccgacggtaacgaacccgaaaccgggtacccaaaagggaccgttacaaccggtttaagttaaccgttccgtacggtaaactaaaacggtcgaaaacccgttcgggaacccttagggaaccggtaccgggtaacccgggaaagggttaacccgtaaccgggtccgtttaaccgggttaacttacccggtttcgttacgggtaaccgtaaccgggtaaagttacccgttaaacgtttcccggttaaacggcccgtttaacgttttaccccggtttcgttttttaacgacggttaccgg

SEQ ID NO: 46399 - DNA, 814 bp, Homo sapiens
  misc_feature: GYAE6OF02FGHYH.27.57.F02.1.454.CMB.1.raw
tcagagcgtcgtctcacgaccggtgctcgatttagctcgatatagttgggtttgaggtctcagagaggagcccttagccctggactccaaggcctttccacttggtgatcagcacggagcacagaggacccaccatggaactggggctgagctgggtttccttgttgctatttagaaggtgtccagtgtgaggtgcaacgtggtggattcgtggaggaggtgtcggtccagcctggagaactcccgtgagactctccgtgtgcagcctgtggattctacctttagtagtttattggtatgaggtcgtcgggtccgcgaacgcctaccggaaggggtaaggggtctgggtaggtttcggtacgggacccaaacgtaacgtaaaacccgaaggtaacgtagggggtaaaggtaaaaaacgaaaaacgttacgttgggtaacggaaccgttaccggttaggtaacggtaaacgggggtaccctaacgttacctaaacccggtaacttaccctccgtaaggtaacccgaaacccggaaaccgaccccgtaaaaggaacgtacctaaacgttacggtaactttaccgacgtaaactaaacgttaacggaaacccgaaccgaccggttaaggaaccggttaacgggtaccccggaaaggggaacccctaacggggtccttaacggtaacgttttaccgaaccggttcggttaaccggaaccgggtaaaggtaccccggttaaattaccccgggttaacggtttaacccgtttacccgggttttaccgttttacgggttacttaccggtttaaccccgggg

SEQ ID NO: 46400 - DNA, 723 bp, Homo sapiens
  misc_feature: GYAE6OF02FJ9ZZ.27.57.F02.1.454.CMB.1.raw
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtgcagcctcgtggtattcctacctttagtagttattggatgagtcgtgggtccncgagctccgagggagggctgggattcggnggcctaaacataaaccgagagngggaagtaaaagtaaactgtaggtacggactgtaggtaggaacgggtcctaagttccaaccgtattcctacccgaaggaacgtaacccgaaaccgacccgaaaagggtaacctaccgtaacgttacggttaattcccgtaaggaactaaaagttcggaaaacctacggtaacccgttagggaaacgtaaccgggacccggtaaacgggaacccgtaaaccgggttccgttaacgttaacgtttaaccccgtacggttcgggttacggaaccgggtaacggtaacgttaacccgtttaccgttaacggttaccgttaacccggtttttcccgggttagttttttaccggacttttccccgggg

SEQ ID NO: 46401 - DNA, 748 bp, Homo sapiens
  misc_feature: GYAE6OF02G5V3V.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctatttagaagtgtccagtgtgaggtgcaactggtggattcgtgggaggaggtgtggtccagccgtggagaactccctgacgactctcctgtcgcagcctcgtggtacttctacctttagtagtttacttggattggacgtcgtcggggtacccgcgacgtactccggaaggggacgggctagggtacgttcggtcggacctaaagaactaaaaccaaggtaatacggggaaagtaaaaagaaaacttagttacggtacggtactcgttaggtaacgggaacggggtaccctaagttacccgaacctacgtccctaccggaagtaacggtaaaccaaaccgaccggaaaaagtaaccggtccgtaacgttaggtaaccttcgtaacggtaaactaaaaagtacggaaacgtaccggtaaccgtaaggaaacggtaccgggtaaccgggaaggtaaccgaaaccggtcgttaacgttaaactaccggttacgtacgggttacgacgggttaacgaacggttaccttaaccgttacgttacctttaccgtttaccccgggttttcttacggttacttccccggg

SEQ ID NO: 46402 - DNA, 671 bp, Homo sapiens
  misc_feature: GYAE6OF02FUFCZ.27.57.F02.1.454.CMB.1.raw
  modified_base (265)..(265): a, c, t, g, unknown or other
  misc_feature (265)..(265): n is a, c, g, or t
  modified_base (354)..(354): a, c, t, g, unknown or other
  misc_feature (354)..(354): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaactggtggattctggaggaggtgtggtccagcctggagaatccctgagactctcctgtgcagcctntggattctacctttagtagtttattggattgagcgtgggtccgccagacctccgaggggaacggggctgggacgttcggtggcccaaanaactaaaaccaagtaacgtagggaaacgggtaaaagaaaaacctagtaggtagggtactcgttggtaggaacggggtccgtaattccgaaccctatcccttaccgaaggtaacgaacaaaccgccaaaaggaacgtacaccgttagtacttctagactaaagtagaaaccagaccgtaggaagaccggacccggtaaggggaaccaccgggtaccgttaaggtaactaacgttaccgtaggttacggaccggtagaacgtaccgtttccgtaacgttcctaaaccgttttcccgtacttttttcggacttttcccgg

SEQ ID NO: 46403 - DNA, 565 bp, Homo sapiens
  misc_feature: GYAE6OF02IDTVI.27.57.F02.1.454.CMB.1.raw
  modified_base (263)..(263): a, c, t, g, unknown or other
  misc_feature (263)..(263): n is a, c, g, or t
  modified_base (372)..(372): a, c, t, g, unknown or other
  misc_feature (372)..(372): n is a, c, g, or t
  modified_base (399)..(399): a, c, t, g, unknown or other
  misc_feature (399)..(399): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaggtgtccagtgtgaggtgcaacgtggtggattctggaggaggtgtggtccagcctggagaatccctgagactctcctgtgcagcctntggattcaccttttagtagttattggatggagcgtgggtccgcagacctcgaggggaacgggctggagttcgtggaccaacataaaccagagtggaagtaaagaaactntgtagactcgtgtgaggtccgatcacnctctccagacgacaaccgcgaaagaacgtacacttagtatacgtagaccaaatacgaacagtaccgtagacgacggaccggaacgtaacgacggtacttgtaactacgtacgtggtcgacgtagatacgtacgtacgttactaccgttccgttacgtttgagttcg

SEQ ID NO: 46404 - DNA, 600 bp, Homo sapiens
  misc_feature: GYAE6OF02HLCQD.27.57.F02.1.454.CMB.1.raw
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (483)..(483): a, c, t, g, unknown or other
  misc_feature (483)..(483): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctggagcgttgggtttttccttgttgcttattttaggaaggtgtccagtgtgaggtgcaacgtgggtggtattcgtgggagggaggttggtcgggtccaggccgtggagaactcccgtgagtacctctcctgtcgcacgcctcgtggtacttcctaccgtttagtagtttagtggatgagtcgtcgggtccncagcctcggaggggaggctggngttcgngacaacaactaaacagtagaggaaagtaaaacaatagtggtgtactgtagaggacggctatcacatcacgaagacgacaacgacaagtacgcagttagtatctagaacaaatcgaacnggacctaggaacgcggacgaggaccgacggtcttagtaccttacgtacgtgggtcgacgaggtacgtaccgttacctaggttcccttaggtttcccgtttagttacgtacttccggg

SEQ ID NO: 46405 - DNA, 592 bp, Homo sapiens
  misc_feature: GYAE6OF02I9D22.27.57.F02.1.454.CMB.1.raw
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
  modified_base (466)..(466): a, c, t, g, unknown or other
  misc_feature (466)..(466): n is a, c, g, or t
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
  modified_base (515)..(515): a, c, t, g, unknown or other
  misc_feature (515)..(515): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaactggtggattctggaggaggtgtggtccagcctggagaactccctgacgactcctcctgtgcagcctctgattctacctttagtagttattggatgagtcgtgggtcccncgagacctccgaggggaacgggtctgggacgttcggtggacccaagaactaaaccaagagtaggaagtaaagaaaactgagtgactnttaggaggaacggggctattaccacctagtcctcgaagaacacaaccgacgaaagacgttaccacgttntacgtactgaactaaangaaaccngtaccgagacgacgaccgaggaacnccggtatacgtaactcgtactcggtagcggtagacacgttcctagtacctcgtttaccgtctttttagcttacccgg

SEQ ID NO: 46406 - DNA, 601 bp, Homo sapiens
  misc_feature: GYAE6OF02GV08Q.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgttgctattttagaaggtgtccagtgtgaggtgcaactggtggattcgtggaggaggtgtggtccagcctggagaactcctagagactcctcctgtcgcagcctctggattccacctttagtagttattggatgagtcgtgggtccgccagtactccgaagggaacggggctggaggttcgtggccaactataaaccaagatgggaagtaaagaaaacgtatcgtaggactcgtgtaggaacgggtccgaacttcgaccatacctccaaggtagacaacgaccaaagaacgtactaacgttagtacttcgacgaactaaagtacgaaacacgacctagaacgacgtaccggagaccgacggaccttagtactactagtggtacggacggaagtacggaacttcgtacgtccgttattcccgttgttttacgattacccgg

SEQ ID NO: 46407 - DNA, 739 bp, Homo sapiens
  misc_feature: GYAE6OF02ICZAY.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgtgctattttagaaggtgtccagtgtgaggtgcaactggtgtattcgtggaggaggtgtggtccagcctggagaactccctgagtactctcctgtagcacgccttcgtaggtactttccaccttttaggtagttagttagggatggagtcgttcggggtcccaccgtaagaccgttccggaagggggtaacgggtccgttaggggtacggttttcccggacgggtaacccctaaaaagtaaccgttaaaaaaccgaaggtaacggttaagggggaaaaacgggttaaaaaacggtaaaacctttaggttacggtacggtaaccgtttacgtagggttaaaccgggaaacgggtcccgtaactttaccgaacctcgtaccgtaccgtaagaacgaccgaaaccgaccgaaaggtacgtactaacttacggttaactcgtacgaactaaagacgaacgtacgtaccgtaggacgtagacccgagaccgacgtacgttagtaactacgttacgtgtacggacgaggtacctacgtaccgtacggtacttaccgtttccgtcgttttacgacgttacccgg

SEQ ID NO: 46408 - DNA, 605 bp, Homo sapiens
  misc_feature: GYAE6OF02FLZS5.27.57.F02.1.454.CMB.1.raw
  modified_base (368)..(368): a, c, t, g, unknown or other
  misc_feature (368)..(368): n is a, c, g, or t
  modified_base (595)..(595): a, c, t, g, unknown or other
  misc_feature (595)..(595): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaaggtgtccagtgtgaggtgcaactggtggattctggaggaggtgtggtccagcctgggagaatccctgacgactctccttgcgcacgcctctggattcctacctttagttagttattggatgagctgggtccgcagactccgagggagggctggagttcgtcggcaacataaaccgagatggaaggtaaaanaaactataggtagactcgtgtaggaacgggtccagttccacgatccacagacgaacaacgacaaagaatcacgttgacttactgaactaaagtcgaaactacgaccgttaggacggtagacccggtaagaacccgtagggtaccgtagttactaccttacggtacgggttggccgaaaggacgtacgttacccggtacgttcccgtaattcccggtttacgttttanactttaccgg

SEQ ID NO: 46409 - DNA, 606 bp, Homo sapiens
  misc_feature: GYAE6OF02GQOZM.27.57.F02.1.454.CMB.1.raw
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
  modified_base (382)..(382): a, c, t, g, unknown or other
  misc_feature (382)..(382): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactgggtggattctgggaggagggtgtggtccagcctggagaatccctgacgactctcctgtgcagcctntggattcacctttagtagttattggatggancgtggtccgcagctcgagggagggctggagttgtgaccaacataaaccaagagtggaaaggtaaanaaactagtaggtagactntgtaggaagggcctattcacatctacgagacgacaacgacaagaactcgaacgtgtatctacgaactaaagacgaaacgacgtaccgttagggaaccgtacggaccgggagaaccgacgggtacgttacgtaacttacgtaccgtaggtacggtacggaacgtaacgtaacgttaccgtacgttacgttaccgtttcccggttactttttacggactttccggg

SEQ ID NO: 46410 - DNA, 727 bp, Homo sapiens
  misc_feature: GYAE6OF02ITZOK.27.57.F02.1.454.CMB.1.raw
  modified_base (195)..(195): a, c, t, g, unknown or other
  misc_feature (195)..(195): n is a, c, g, or t
  modified_base (335)..(335): a, c, t, g, unknown or other
  misc_feature (335)..(335): n is a, c, g, or t
  modified_base (420)..(420): a, c, t, g, unknown or other
  misc_feature (420)..(420): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggttttctgttggctattttagaaggtgtccagtgtgaggtncaacgtgggtggattcgttgggaggtaggtgtggtccaggcctgggagaactccgtggagacctcttcctggtgcagtcctcgtaggtattttcctacctttaggttagtttattggtactggtaggtcgtcggggtccnccgtaacgaccgttccgaagggggtaacgggggcttagggagttaccggtcgggaccccaaaccgaacttaaaacccgtaaaggngtaacggggaaggttaaaacgtaaaacgtagtggtaggtacttaacgtggtacgggaacgggtcccgtaagttccaacccgtattaccgtacccgagacggtaaccacgtaacccgaaagtaacgttaccgacggtacttagttcgtaagtactaaagtcgaaaccgttacgaccgtaagacggtaacgaccgggaacgaccggtaccggttactaaggtttacctacggtaacgttcggtaggtaccgaaggttccgtacgttacttaacgcgttaccgttccgtttcgttttagacgggttcccg

SEQ ID NO: 46411 - DNA, 507 bp, Homo sapiens
  misc_feature: GYAE6OF02HWFRF.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtcagcctggagaatccctgagactctcctgtgcagcctctggattcacctttagtagttattggatgagctgggtccgccagactccagggaaggggctggagttcgtggcaacataaaccaagataggaaggtaaagaaactaatgtaggactctgtgaaggcattcacatctcagagacacgcaagagtcactgtatctgacaaatgaacagactgagagcgaggacacggctagtatactactgtgcagagactctagtcattccgtcttttcgattccg

SEQ ID NO: 46412 - DNA, 740 bp, Homo sapiens
  misc_feature: GYAE6OF02F4NZ3.27.57.F02.1.454.CMB.1.raw
  modified_base (723)..(723): a, c, t, g, unknown or other
  misc_feature (723)..(723): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaggtgtccagtgtgaggtgcaacgtggtggattcgtggaggaggtgtggtccagcctggagaactccctgagactctcctgtcgcagtcctcgtggattctaacctttagtagttattggatgagtcgtcggggtccgccgtagacctccggaaggggaacggggcgtagggtacgtttccggaggaccccaaacgtaagtaaaacccgaagaagtaggggaaaggtaaaaacgaaaacttagtaggtacggtaacctcgttaggtaagggaacggggtcccgtaagtttacccaaccctaagtttcccttaaccgaaacggtaacgaaaacccgtaaacccggaacccgaaaaggtaaaccgttcaaacgttcgttaacgtacctacggaaccttaaaaaggtcgaaaaccgtaccggtacccgttaggaaaccggaccgaccgggtaaacggtaccgaacggttcttacggttaactaccgttcgtacggtaggaacgtacggaacgtaccttaaccgtagttacctaacggtttcccgtttnttttacgactttcccgg

SEQ ID NO: 46413 - DNA, 616 bp, Homo sapiens
  misc_feature: GYAE6OF02JHKLL.27.57.F02.1.454.CMB.1.raw
  modified_base (506)..(506): a, c, t, g, unknown or other
  misc_feature (506)..(506): n is a, c, g, or t
  modified_base (568)..(568): a, c, t, g, unknown or other
  misc_feature (568)..(568): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagtcgtcgggtccgccagacctccgaaggggaacggggctgggagttcggtcgggacccaacaactaaaaccgaagacgtaggggaaaggtaaaagaaaacttagtaggtaggacttcgtaggtaggaacgggccgtaattccgaacctattcctaccgaagacgaacaaccggacaaagacgtccacgttagtactctgactaaatcgaaacncgacctaggacgacggaccgaggacctacggcttaggtacttactacgtggtacgcggaagngttacctacctagttcctaaccgtttccgttcttttacgatttcccgg

SEQ ID NO: 46414 - DNA, 850 bp, Homo sapiens
  misc_feature: GYAE6OF02FVNG1.27.57.F02.1.454.CMB.1.raw
tcagagcgtcgtctcacgaccggtgctcgattagctcgatatagttgggtttgaggtctcagagaggagccttagccctggactccaaggcctttccacttggtgatcagcacggagcacagaggacccacatggaactgggctgagctgggttttcctgttgctattttagaaggtgtccagtgtgaggtgcaactggtggattcgtggaggaggtgtggtccagcctggagaactccctagagactacgtcctggtgcgacgccgtctgggacttcctaaccgtttagttaagttagtttagggtacttaggaagtcgtaggggtcccgccctaaggaaccgttaccgaagggggaacgggggctagggacgtttcggtgggtcccgaaacgtaacgtaaaccctaagacgtaggaaggtaaaagaaaaacctgtacggtacggacttactggtaggaacgggaccggtaattccgaaccgtacgttcctaccccgaaggtacggtaaaccgaaaccgtacccgtaaaagggtaaacggtaaccgtaacggttacggttaaacgttacccgttaacggtaacccgtaaaagtttaacgggaaaaccctaaaccgggtacctttaacgggaccgggtaaagggtacccgggtaaaccggggaacccggttaaaccgggtacccgggtttaacgttaaccgtttaacccgttaaccgtttaacgggtttaccgggaacccgggttaaacgggttaaacgttaaccggtttaacccgttaacgggttaaaccgttaaccgttttaaccccggttaacggttttttacccgggtacggttttaacccccggg

SEQ ID NO: 46415 - DNA, 589 bp, Homo sapiens
  misc_feature: GYAE6OF02HQ6AJ.27.57.F02.1.454.CMB.1.raw
  modified_base (333)..(333): a, c, t, g, unknown or other
  misc_feature (333)..(333): n is a, c, g, or t
  modified_base (465)..(465): a, c, t, g, unknown or other
  misc_feature (465)..(465): n is a, c, g, or t
  modified_base (581)..(581): a, c, t, g, unknown or other
  misc_feature (581)..(581): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtcgcagcctctggattcacctttagtagttattggatgagcgtcgggtccgcagactccgaaggggaaggggctgggngttcgcggacaacaataaaaccaagagtaggaaagaaagaaatagtggtacgtactcgtagtacggaagggaccgtatacaaccgacttccgacaggacaacaaccgaccaaagaacgtcagtgtatcgtanacaaatcgaacacgtcagaagacgaccggaaggaaccgacggtaccgtagtaactacgttacgtaggtcgacgtagaacgtctaccttaaggtcctagtttcccgtagttttacgntttcccgg

SEQ ID NO: 46416 - DNA, 675 bp, Homo sapiens
  misc_feature: GYAE6OF02F9TSV.27.57.F02.1.454.CMB.1.raw
  modified_base (318)..(318): a, c, t, g, unknown or other
  misc_feature (318)..(318): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcacgtggtggattcgtggaggaggtgtggtccaggcctggagaactcccgtgacgactcctcctgtgcacgcctcgtggtacttctaacctttagtagtttattggatgagtcgtcgggtccnccgagacctccggaaggggaggggctagggacggttcggtcggaccaactaactaaaaaccaaggtagtacggggtaaaaggtaaaaacgaaaacttagtacgggtacggtacctcgttagggaggaaacggggtccgtaacttccaaccgtactaccgtacgtaacggtaacgaaaccaaccggaaccgaaaagacgtaccgacgttaacgttactctagtaacaaacttacgaacgtacggaccgtaggagacggaccggaagaaccgacggtcttagacgttacttcggtagtcggacgtaaggacgtacgttaccgtattaccgtacgttaccgtcttttacggctttaccgg

SEQ ID NO: 46417 - DNA, 668 bp, Homo sapiens
  misc_feature: GYAE6OF02H3ZW8.27.57.F02.1.454.CMB.1.raw
  modified_base (662)..(662): a, c, t, g, unknown or other
  misc_feature (662)..(662): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggtttccttgttgctattttagaggtgtccagtgtgaggtgcaacgtggtggattcgtggaggaggtgtggtccagcctggagaatccctgacgactctcctgtgcagcctgtaggtacttctacctttagtagtttattggactgacgtcgtcgggtcccgaccgacgtaccgtccggaagggggaacggggtcgttagggtacgttcggtcggaccaaacaacgtaaaaccgaaggtagtacgggaaaggtaaaacgtaaactagtaggtacggtacttacgtaggtacgggaacggggaccgtacgtttaccaccgtacttccctaccgaaggaccgaaacctaacgaccgaaaagtaccgtactaactgtttactcgaacgtaacgaaactacggaaaccgacgtacccgtagggaacgtaacgggcccgaaggaccgcggtactagtactacgtacgtggacgaggatacgtaccttacgtagttcctacttccgtttactttacncttcgg

SEQ ID NO: 46418 - DNA, 650 bp, Homo sapiens
  misc_feature: GYAE6OF02F56KL.27.57.F02.1.454.CMB.1.raw
  modified_base (257)..(257): a, c, t, g, unknown or other
  misc_feature (257)..(257): n is a, c, g, or t
  modified_base (631)..(631): a, c, t, g, unknown or other
  misc_feature (631)..(631): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtncagccctctggattctacctttagtagttattggatggagctggggtcccgccacgacctccgaaggggaagggcgtgggtaggttcggtcggaccaaacaactaaaacccaagaagtagggaaggtaaaagaaaactataggtacggactacgtgtaggaaacggggccgtattccacctactctaccaaggtacgaaccgaaccgaccaaaggaaccgtaccaacttgtactacttagactaaagtcaaacgacgacctaggacgacgaccggaacggtaaccgacggtcgttagttaaccttacgttacgtaggttcgaacggtaacggaacgtaacgttacccgttagttccgtaaccgtttcccggttnttttacgtcctttaccggg

SEQ ID NO: 46419 - DNA, 559 bp, Homo sapiens
  misc_feature: GYAE6OF02GLAKM.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtgcagcctctggattcacctttagtagttattggatgagcgtgggtccgccagacctccgaggggaaggggctgggagttcggtcggaccaacataaaccaagatagggaaggtaaaagaaaactagtggtaggacttcgtagtaggaacgggccgtaattccacctatcctaccgaagacgacaaccgaccaaaggaacgtcacgttagtatctgacaaatagaacacgctagagacgaccggagacacggctagtatactgtgtgacgagagactcgtagtctacttcgtcttttgattcg

SEQ ID NO: 46420 - DNA, 819 bp, Homo sapiens
  misc_feature: GYAE6OF02H3VBH.27.57.F02.1.454.CMB.1.raw
  modified_base (270)..(270): a, c, t, g, unknown or other
  misc_feature (270)..(270): n is a, c, g, or t
  modified_base (319)..(319): a, c, t, g, unknown or other
  misc_feature (319)..(319): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgtgggttttccttgttgcttattttagaaggtgtccagtgtgaggtgcgaacgtggtggtattcgtaggaggaggttgtggtccagccgtaggagaactcccgtagagacctctccgtgcncacgtccttcgagtcttacctacgtttagttagtttagttggactaggnccggttcgggtccacgtagccgtacgggagggtacgggcgtaggtcggttcggtacggaaccaacgtaaaacgtaaaccgaggtaagtaggggtaaaaacgtaaaagtaaactttaggtacggtacgtactcgtaggtaacgggcggtacctagtacccgtagtactcccgtaacgaagacgtaaacgaaccgaacgtaaacgtaacgttccgtaaagttccgttaactacgtaaacccgtaaagtaaacgttaaccggaaacgtacccggtacgttaaacgggaaaccgggacccggtaaacccggtaacgggaaaccggggtacctttaacggttacggttaaaacccttaccgttaacgggttcggggttaaaacgggcccgttaaaaaggggacccgttttaaaccggttcccccgtttaaacggttacccggtttttaaacccgtttcccgggttttttaaccttttaacgggttccccgttttaaacccggggg

SEQ ID NO: 46421 - DNA, 537 bp, Homo sapiens
  misc_feature: GYAE6OF02GU5P5.27.57.F02.1.454.CMB.1.raw
  modified_base (304)..(304): a, c, t, g, unknown or other
  misc_feature (304)..(304): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (448)..(448): a, c, t, g, unknown or other
  misc_feature (448)..(448): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtgcagcctctggattcacctttagtagttattggatgagctgggtccncagactccgagggaagggctggngtcgnggaccaanaataaacagataggagaaanaaatagngtgactcgngtagaaggccgatccactatctccgagacgacaacgccaaagacgtcaactgtatctagacaaatagaaacncgaccttagagacgaccgaaggaccaggcctagtatactcgtgtgacgagacgtataccgtagtccgatttcccgtagtttagacttcg

SEQ ID NO: 46422 - DNA, 822 bp, Homo sapiens
  misc_feature: GYAE6OF02JT7SO.27.57.F02.1.454.CMB.1.raw
tcagagcgtcgtctcacgaccggtgctcgatttagctcgatatagttgggtttggaggtctcagagaggagccttagccctggactccaaggcctttccacttggtgatcagcacggagcacagaggacccacatggaactggggctgagctgggttttccttgttgctatttagaggtgtccagtgtgaggtgctaacgtggtggattcgtgggaggaggtgtcggtccagtcctgggagtaactcccgtagagtacctctcctggtcgacgtacgccttacggtacggtacttttccgtaccgttttaagggttacgttttaagttggggtacttagggtaaggtcccggtttcggggtccccggacctaacggtacccggttaccggaaaggggggtaacgggggtcgttacggggtaacggtttccgggtacggtaccccaaaacgtaaacgttaaaaacccggaagtcggtaaggggtaaaacggttaaaaacgtaaaaaccgtttgtacggggtacggtaaccgttacgtagggtttaaggggaaaccgggtcccgtttaagttacccgaaccgtaacttcccgtaaccgaaggtaacaacccgaacgtaacgaaacgtactacgtaaccgttagttacctacgtacgtacgtaaaaggtccaaacggtaacgtcccgtaaggacgacgggtaccgaacgggtaaccacggtcgttaacgtaacgttaccacggtttcggaacggaccgaggtaacccgactttacccgtaggtttccgaacctttttccgggtacgttttcgaacggtttcccgg

SEQ ID NO: 46423 - DNA, 684 bp, Homo sapiens
  misc_feature: GYAE6OF02HL1VZ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaacgtggtggattctgggaggaggtgtggtcccagcctggagaactccctagagactctcctgtgcagtcctcgtaggacttactacctttagtagtttagttggattggacgtcgtcggggtcccgaccgaggtaccgtcccggaagggggtaacgggtccgttgggtacggttcggtcggacccaaacgaactaaaccgaagagtagggaaaggtaaaacgaaaacgttgtaggtacggacttcgtaggtagggaaccgggtccgtaactttaccgaacctacgttaccctaccgaacgaacggtaaccaaccgaaccgaaagtaacgtaccaacgttagtaactcctagaacaaagtaccgaaatacgccgtagacgacgacccggaagaaccgacggtctagtactacgttacgttggacggacgaagagtaccttaccgttagtcccgttaacgtttcccgttacgttttacgcttaccgg

SEQ ID NO: 46424 - DNA, 689 bp, Homo sapiens
  misc_feature: GYAE6OF02F1KTP.27.57.F02.1.454.CMB.1.raw
  modified_base (602)..(602): a, c, t, g, unknown or other
  misc_feature (602)..(602): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaaggtgtccagtgtgaggtgcaactggtggattctgggaggaggtgtggtccagccgtaggagactcccgtgacgaccttcctccgtgtcgcacgtccctcgtggtactttcctaccgttttagtagtttagttggtatggacgtcgttcggggtcccgaccgaacgtaccgtaccgggaagggggaacggggtcgtagggtaacggtttcggtacgggaaccccaaacgtaaacgtaaaaaccgaaggtaagtaggggtaaaaggtaaaaacgtaaaactttagtaggtaggtactgtagggtacggaacgggtccctagttccaactacgtacctacgaagtacgaaccaaccgacgaaagtaacgtacctatacgtactcgacgacgaaatcgaactacgctagagccgacggagaccgtacgngtacgtactacgtacgtggtacggacgaacgtacgttacgtaaccgttacgtacgttaccgttccgttacgtttagtaccgttccgg

SEQ ID NO: 46425 - DNA, 779 bp, Homo sapiens
  misc_feature: GYAE6OF02HSR95.27.57.F02.1.454.CMB.1.raw
  modified_base (305)..(305): a, c, t, g, unknown or other
  misc_feature (305)..(305): n is a, c, g, or t
  modified_base (433)..(433): a, c, t, g, unknown or other
  misc_feature (433)..(433): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacgatggaactgggctgagctggttttccttgtgctattttagaggtgtccagtgtgaggtgcaactgggtggattcgtggaggaggtgtggtccagcctggagaatccctgagactctcctgtcgcacgtcctactggtattcaccgttttagagtttagttgggaacttggancccgtagggtccgccagaacctccgaagggaacggggccttgggacgtttcggtcggtacccaaacgtaagttaaaaaacccgaagtaagttagggtaaagggtaaaaaaacaaaaacccgttttaanagggttaacggttacgtaaccgtttgggttaaacgggaaacgggggtacccgtaacgtttaacctaacccgtaaacgttacccgtttaacccgaaacgtaacggtaaacccgaaaaccgtacccgtaaaaggaaaacgggtaccctaaccgttacggttaacttacgtacgtaacctaaaagttacgaaacgtacgtacccgtagtaacgaacggaccggtaacggaaccgaacggtaccgtacgttaaccgttaacgtaacccgttaggtaccggagtaaccggaaggttaccgtacccgttacggttaccgacgtttacccgtcggtttttcgaacgtttcccg

SEQ ID NO: 46426 - DNA, 693 bp, Homo sapiens
  misc_feature: GYAE6OF02JV0QA.27.57.F02.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (585)..(585): a, c, t, g, unknown or other
  misc_feature (585)..(585): n is a, c, g, or t
  modified_base (649)..(649): a, c, t, g, unknown or other
  misc_feature (649)..(649): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggtttcctgttgctattttagaagtgtccagtgtgaggtgcaactggtggattctggaggaggtntggtcagcctgganatcctgagactctcctgtcgtcacgccttcgaggatttccaacctttagttagttacgttggaattcggaagtcgttgggggttcccgaccgtagaccgtccggaagggggtaacggggtcctaggggtaacggtttccggtagggaccctaaactaacgtaaaacctaacggtatagggggaaagttaaacgaaaaacgttgtaggtacggaccttagaggttaacgaacgggggtacctaactttcggaaccctagtccctacgaaacgtagaaccgaaacgacgaaacgtaacgtacaccgttagtattactaggaactaaagtagaactacgaccgttagaacgggaacncggaaacggtaccgacgggtaactagtaaccgtagttactacggtagaccggagtaaaccgttnaacccgtttagacctacgtttacccgttatttacgacgtttcgg

SEQ ID NO: 46427 - DNA, 791 bp, Homo sapiens
  misc_feature: GYAE6OF02G4LMW.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctggaggagtgtggtccagccgtggagaatccctgacgactctcctgtgcacgtcctcgtggacttcacctttagtagtttagttggatgtagtcgtacgggggtcccgccgaacgtaccgtacccgaagggggtaaacggggccgtggggtaacggtttcggtacgggtacccgaaaccgtaaacttaaaaacccgaaagtaacggtaaggggtaaaacggtaaaaaacggtaaaaacgtttagttaaggggtacgtaccgttacgtacggtacgggaaacgggggtacccgtaacgtttacccgaacccgtaacttcccgttaaccgaagggaacgaaacccgaaacccggaacccgtaaaaggtaaaccggttacccgaacgttacgtacgtttacgtacggttaaaccaaaagttagaaaccgtacggtaacccgtaggaagggtaccggacccggaacgggtaaacccgaacggtcgttaagttaccgttacccgttagtacggtcgaacggtaacggaacgttacgtaccgttaagttccgttaacgtttcccggttacttttgacttacccggg

SEQ ID NO: 46428 - DNA, 711 bp, Homo sapiens
  misc_feature: GYAE6OF02FRHDW.27.57.F02.1.454.CMB.1.raw
  modified_base (195)..(195): a, c, t, g, unknown or other
  misc_feature (195)..(195): n is a, c, g, or t
  modified_base (238)..(238): a, c, t, g, unknown or other
  misc_feature (238)..(238): n is a, c, g, or t
  modified_base (320)..(320): a, c, t, g, unknown or other
  misc_feature (320)..(320): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaggtgtccagtgtgaggtgnaactggtggatttctgggaggagggtgtggtccagcctggganaatccctgagactcctcctgtgcagcctctggtattcctaacctttagtagtttagttggagttgaggtcgtcggggtcccnccgaggacctccggagggggagggcgtgggagtttcgagggccaacgaataaaccgagagtagggaacggtaaaagaaaactgtggtaggacttcgtaggtggaacgggccgtactaccacctaactcctaccaacgagaaccgaaccgtaccgaaagtacgtacctaacgttagtaccgttcacgacctaaagtaccgaactaaccggaccgttggaaaccgaacgggtcccggaaagggttaacccgtaccgggtcttaacggtttaaccgttacccttaacggttacgggtccgggaacggttaaacgggtaacgttaccgtttacccgttaacgggttaccttaaccggtttttacccgtacgttttttacgaccgttttccccggg

SEQ ID NO: 46429 - DNA, 617 bp, Homo sapiens
  misc_feature: GYAE6OF02GX3WF.27.57.F02.1.454.CMB.1.raw
  modified_base (263)..(263): a, c, t, g, unknown or other
  misc_feature (263)..(263): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctatttagaaggtgtccagtgtgaggtgcaactggtggattctggaggaggtgtggtccagcctggagaactccctgagactctcctgtgcagcctntggattctacctttagtagttattggatgagtcgtgggtcccgacgagtacgtccgaaggggacgggctagggtagttcgtggaccaaacgtaataaaccgaagtagtaggggaagttaaaacgaaacttagtaggtaggacttacgtggtaggaacgggtcctattaccacctatccgtaccgaagacgaacaacgaccaagtaacgtcacgtagtacgtcgtagactaaatacgaacgacggtacctaggaacgacggtaccgaagggaaccgacgtacgtgtaacgtacttacgtgtacggacgtaaggagtacttaccgtagtcgtacttccgtacttttagattaccgg

SEQ ID NO: 46430 - DNA, 548 bp, Homo sapiens
  misc_feature: GYAE6OF02G74F4.27.57.F02.1.454.CMB.1.raw
  modified_base (303)..(303): a, c, t, g, unknown or other
  misc_feature (303)..(303): n is a, c, g, or t
  modified_base (456)..(456): a, c, t, g, unknown or other
  misc_feature (456)..(456): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccnccagactccgagggaacgggctgggagttcggtggccaaacataaaaccgaagatacgggaaggtaaaagaaaactataggtggaacttcgtagtaggaaaggggccgattccaccgatctccagagacaacgcaaagaagtcactgtatctnacaaatgaacagcctagagagccgagacacggctagtactactacgtgtagcgagagtactccgtaggttcacgttccgtacttttgattcg

SEQ ID NO: 46431 - DNA, 874 bp, Homo sapiens
  misc_feature: GYAE6OF02F1NIE.27.57.F02.1.454.CMB.1.raw
tcagagcgtcgtctcacgaccggtgctcgatttagctcgatatagttgggtttgaggtctcagagaggagccttagccctggactcccaaggcctttccacttggtgatcagcacggagcacagaggacccacatggaactggggctgagtctgggttttccttgttgctatttagagctgtccagtgtgaggtgcaactggtgacttcgtggaggaggtgtgtcagccgtggagaactccgtgagacctcgtcctgtcgacacgtcctcgtaggtactttcctacgttttaagtagtttacgttgggtagtcgtaaggtccggttcggggtccccgaccgtaaggtaccgttaccgggaagggggtaacgggtcgttacggtacgttcggtacggtaccaaaacgtaaacgttaaaacccgaaggtacgtaacgggtaaacggttaaaaagtaaaacgttagttggtaacgtaacccgtttcggtaggtaacgggtaaaccgggtctaacgtttacccgaaactacgttaccgtaacccgaagggtaacgaaacccgtaaaccggaaccgtaaaggtaaaacccgttccgtaaacgttacggtttaaaccgtaccgttaaacggtaaccgttaaaacgttaccgggaaaaccgtacgggtaaccccgttagggaaaacggcccggtaaaccgggtaaacccggtaaccggtacccgggtaaccgtttaaccgtttaacgtaacccggtttaccggttacggggtaacctaaacccgggggtaggttaaaccccgtaaccgttttaacccggttaacgggttaaccctttaaccgggtttacccccggttttaggttttaacccgttaaccggg

SEQ ID NO: 46432 - DNA, 689 bp, Homo sapiens
  misc_feature: GYAE6OF02IYNX5.27.57.F02.1.454.CMB.1.raw
  modified_base (118)..(118): a, c, t, g, unknown or other
  misc_feature (118)..(118): n is a, c, g, or t
  modified_base (469)..(469): a, c, t, g, unknown or other
  misc_feature (469)..(469): n is a, c, g, or t
tcagagcgtcgtctcacgaccggtgctcgatttagctcgatatagttgggtttgaggtctcagagaggagccttagccctggactccaaggcctttccacttggtgatcagcacggancacagaggacccacatggaactggggctgagctgggttttcctgttgctattttagaaggtgtccagtgtgaggtgcaactggtggattcgtgggaggaggtgtggtccagcctggagaactccctgacgactctcctgtcgcacgtcctcgtggacttcctaccgtttagtacgttattggattaggagtcgtcgggtcccgcacggtacctaccggaaggggaggggctgggtacgttcggcggaccaaacgtaacaaaccgagtaagtacgggaaagtaaaacgaaaacttagtacggtaggtacgttacgtgggtaggaaacgggacctagttccaacctagtaccncgaaaggtacgaccgtaacgaccgaaagtaccgctaagtacgtactcgtacacgtaaacgtcaaacgtacgacgtacgaaggaaccgaccgggaaacggaccgacggttacgtacggtaaactttaccggttacgtacgggtaacgtacggaagtacgttaccgttaaccggtagttacccggtttatttcccgggttacttttaggaccctttacgggg

SEQ ID NO: 46433 - DNA, 781 bp, Homo sapiens
  misc_feature: GYAE6OF02I0JFZ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccacatggaacgtggggctgagcttgggttttccttgttgtctattttagaaggtcgtccagtgtgaggtcgcaacgtggtgattcgtggaggaggtgtcggtccagtccgtaggagtaactccctgacgacctccgtcctgtcgctacgccttcgtgtacttcctactttaagtagttatggtatagtacgtcggtacgggtcccgccgaagtaccgtccggaagggggtaacgggtcgttagggtacggttccggtacggaaccaaaacgtaacgtaaaaaccgaaggttaagaaaggggtaaaaggtaaaaacgttaaacgttagtacggtaggttacttacgtagggtagggaacccgggtcctaacttaccgaacctacgttaccctaaccgaaggaacccgaaacgaaccgtaaccgaaaaggtaaccgtacctaagttacgttacttacctaagtaacctaaagtaccgtaaacgtaccgtaccggtaacggaaccggtaacggaacccggggaaaccgtaccggtaaaccgggttcttaaacgggttacttaacccgttaggtcggtaacgggaacggtaagtacgttaccgtaaccgttacgttcttaaaccggtttccgtttacgttttcgtaaccttcggg

SEQ ID NO: 46434 - DNA, 671 bp, Homo sapiens
  misc_feature: GYAE6OF02G10K3.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcacgcctctggacttcctacctttagtagtttattggatggagtcgtgggtcccgccgagaccgtccggaggggaaggggcgtgggacggttcggtcggaccaaacaactaaaaccgaagacgtagggaaaggtaaaagaaaactagttaggtacggacttacgtaggtagggaacggggtcccgtaagttaccaacctattcctaccgaagacgaaccaaccgaccaaagtaacgtcacttagtactcgtacgactaaagtcgaaacacgacctaggacgaacggacccgaagggaccgacgggtacttagtaacgttaccgttacgtcggtaacggaccggaaggtaacgttacgttacccgttaaggtacccttaaccgtttcccggtttactttttggacctttcccggg

SEQ ID NO: 46435 - DNA, 731 bp, Homo sapiens
  misc_feature: GYAE6OF02HIR62.27.57.F02.1.454.CMB.1.raw
  modified_base (570)..(570): a, c, t, g, unknown or other
  misc_feature (570)..(570): n is a, c, g, or t
  modified_base (721)..(721): a, c, t, g, unknown or other
  misc_feature (721)..(721): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggaccccaccagtggaacgtggggctggagtcgttgggttttccttgttgcttattttagaaggtgtccagtgtgaggtgctaacgtggtaggtattcgtgggaggtagggtggtggtcccagtccgtgggaacgaactcccgtgacgtaccttcctccgtgtacgcacgtcctcgtaggtacttcctacgtttagttagtttagtggtatggtacgtcggtcgggtcccgacgacggtaccgtaccggaggggtacggggtcgttagggttacgttcgggtcgaaccaaacgtaactaaaaccgaaggtacgtaggggaaaacgtaaaacgtaaactgtggtaacggtactcgtaggtaacgggacggtactcgttacacctacgtcctaacgaggaaccgaccgaaacggaccaaaggtaactccgtagttagtctacgtaanaacttaaacgcgtaaacgtcgaccgtaggaacggtaccggaacggaaccgacgtacggtagttaacgtacgtttaccgtaggtcgggtaacgcggtaaacgtcgtaccgtttacgttacttacgtaccgtttttcccggtagttttaccgngttccccggg

SEQ ID NO: 46436 - DNA, 802 bp, Homo sapiens
  misc_feature: GYAE6OF02IBH4A.27.57.F02.1.454.CMB.1.raw
  modified_base (116)..(116): a, c, t, g, unknown or other
  misc_feature (116)..(116): n is a, c, g, or t
tcagagcgtcgtctcacgaccggtgctcgatttagctcgatatagttgggtttgagtctcagagaggagccttagccctggactccaaggcctttccacttggtgatcagcacggngcacagaggacccaccatggaactggggctgagcttgggttttccttgttgcttattttagaaggttgtccagttggtggaggtgcaacgtggtggtatttctagggaggaggtgtggtccgaggcctggagtaactccctggaacgtacctcctcctggtcgcctacgtcctcgtaggtacttcgtacctttagttaacgttattggtatcggagtcgtcggggtcccgaccgagtaccgtaccggtagggggaaggggtcgttaggggtacgtttccggtacgggaccctaaaacgtaaacgtaaaaccgtaaaggtacgtaagggggtaaaaacggtaaaaacggtaaaaacctttaaggttacgggtacggtaacgtttaccgtggttaacgggaaaccgggtaccgttaacgtttaacccgaaaccttacgtaccccgtaaccgtaaaggaaacccggaaaacccgtaaaccggaaacccgtaaaagggtaaacggttaccaaccgttaacgttacgttacgtaacgtaacctaaaaggtaccaacggtacgaccgttagaacgacgggcggaaacggtccgacgtctagtacgtacttaacggtggtacgtacggaagtccgtaacttcgtaacgttcccgtttaacgtttcccggtttacttttcggaccgtttaccgg

SEQ ID NO: 46437 - DNA, 809 bp, Homo sapiens
  misc_feature: GYAE6OF02JKATW.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgttgggttttccttgttgctattttagaggtgtccagtgtgaggtgcaacgtggtggtattcgtggaggaggttgtggtccagcctggagaactccctgacgactctcctgtgcacgcctcgtggtacttcctacctttagtagtttattggattggacgtcgttcggggtcccgaccgtagtacccgtaccggaagggggaacggggtccttggggtaacggtttccggtaccgggacccctaaaacgtaaacgttaaaaacccgaaggtaacgttaggggtaaaagggttaaaaaacgaaaaaccgtttagtacgggttacgggtaaaccctttcggttagggttaaacggggaaacgggggtaccccgtaaagttttcccgaaaccccgttaagttaccccgttaccccggtaaagggaaccgaaacccgtaaaaccggtacccgaaaaaggtaaccggtaccctaacgttaggttaaccttacgttacggaactaaaacgttcggaaaaccgtcggtacccgttaggaacggaaccggacccgggtaacggaaccgtaccggtacttaaggttaacctacgtttaacgtgggtacgaacgaagacgtactttaccgacggttactaccgtttccggtacttttagacttaccgg

SEQ ID NO: 46438 - DNA, 639 bp, Homo sapiens
  misc_feature: GYAE6OF02HASXL.27.57.F02.1.454.CMB.1.raw
  modified_base (312)..(312): a, c, t, g, unknown or other
  misc_feature (312)..(312): n is a, c, g, or t
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtcagtgtgagatgcaactggtggattcgtgggaggaggtgtggtccagccgtggagaactccctgacgactcctcctgtgtcagcctctggacttctaccttttaaggtagttacttaggtagtgtaggngtcggtcggccgacgacgtaccgtacgggaaggggaccgtggtaggtacggttcggacgaaccaacgtaaaacgtaacgagtaggtaaagggtaaaacgtaaaaagtaacttaggtaggtaaccgtactggttagggaacgggtaacgacgttacctaaccgactactaccgtacgaagacaaacgacaaggaagtacaactntactacnacaaanacgaanactacgtacgagagccggtagaacgacgcgtacgtagtacgtaacgtggtacgacgacgtaagtacgtacgttcgtaaccgttactaccgtttattcggttaccg

SEQ ID NO: 46439 - DNA, 616 bp, Homo sapiens
  misc_feature: GYAE6OF02IV1GN.27.57.F02.1.454.CMB.1.raw
  modified_base (238)..(238): a, c, t, g, unknown or other
  misc_feature (238)..(238): n is a, c, g, or t
  modified_base (347)..(347): a, c, t, g, unknown or other
  misc_feature (347)..(347): n is a, c, g, or t
  modified_base (466)..(466): a, c, t, g, unknown or other
  misc_feature (466)..(466): n is a, c, g, or t
  modified_base (598)..(598): a, c, t, g, unknown or other
  misc_feature (598)..(598): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtgggaggaggtgtggtccagcctgganaactccctgagactctcctgtgcagcctcgtggtattcactttagtattagttggatgagcgtgggtccgcagacctccgagggagggctaggtagttcgtaggccaanactaaacaagataggaaggtaaaagaaaactagtagtagactgtagtaggaacgggccagttaccaccgtaactctaccagaacgacaacgaccaaagacgtcaacgttagattccganaactaaatacgaaacgcgacccgtaggaacgacggtacccgaagggaaccgaaccggtcttaaggttaacctacgtaacgttggtaacgaccggaagtacgtacttacccgtagttacctagtttcccggtntttttaacgacgttccgg

SEQ ID NO: 46440 - DNA, 766 bp, Homo sapiens
  misc_feature: GYAE6OF02F155R.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacagaggacccaccatggaactggggctgagctgggttttccttgttgcttattttagaaggttgtccagtgtggaggttgcaacgtggtggattctgggaggaggttgtcgggtccaggccttaggacgtaacgttcccctggacgaccttccttcccgtggttcgaccacggtcccttcgttaggtactttcctaaccgttttaagttagtttaagttggaattcgaggtccgtcgggttaccgcctaagaccgtaccggaagggggtagggcgtagggaggttcggacggacctaaacaacgtaaaaccgaagtaacgtaaggggtaaaggtaaaaagtaaaaaccgttgttaggtaacggtactcgttagggtacggggaacgggtaccgtaatacccgtaactacgtacccgttaccgaaacgaacggaaccgaaacccgaccgtaaaaacggtacctaacgtaccttaaggtaccttaccgagaaccgtaaagttacgaaacctacgaccgtggaaacggtccgaccggaacgacggaccgtcgttagtaaccgttaccgtaggtacgtaggacggtaacggtagttaccgttaccgtattaacccgttccgtttacgttacgttttacggagttcccgg

SEQ ID NO: 46441 - DNA, 673 bp, Homo sapiens
  misc_feature: GYAE6OF02J2KCE.27.57.F02.1.454.CMB.1.raw
  modified_base (192)..(192): a, c, t, g, unknown or other
  misc_feature (192)..(192): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggtttccttgtgctatttagaaggtgtccagtgtgaggtncaactggtgattcgtgggaggtaggtgtggtccaggtcctgganaactccctgagtctctcctgtcggnacgtcctgtcggtattccgtacctttagtacgtttagttggatggacgtcgtcgggccaccgtagaccgtcggaaacgggggagggtcctaggtacggttcggtacggacctaaacaacgttaaaaccgaaggtagaacgggtaaaggtaaaaacgtaaactagtcggaacggtattaccgtggtaacgaacggtctaattcacgtactcgaacgtagaacgaacgtaacgacgtaaaccgagtcctacgttagttacgtactacgaactaagtacaacgccgacgtaacgaacgtaggacccgtacggacctacgggtactaccgtacgtacgtaacgtcggtaacgaacggtaggtaacttaccgacgtttacgacgttaccttaccggtcttttacggacgttcccggg

SEQ ID NO: 46442 - DNA, 754 bp, Homo sapiens
  misc_feature: GYAE6OF02GOSI7.27.57.F02.1.454.CMB.1.raw
  modified_base (270)..(270): a, c, t, g, unknown or other
  misc_feature (270)..(270): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcactggtggattcgtgggaggaggtgtggtccagtccgtggagaactcccgtgagacctctcctgtgcacgcctntggtattcctacctttaggtagttacgttggattaggacgcgtcgggtccgaccagaccgtccggaagggggacgggtctgggtacgtttcggtacggacccaaacgtaactaaaacccgaaggagttacggggaaagttaaaaacgaaaacttagtaggtacggtacttcggtaggtacgggtaacgggtcccttaagttacccgaaccgtacgtaccctaccgaaggaaccgtaaccgaaaccgtacccgaaaaggtaccgtcctaacgttacgttaacttccgtacgaactaaagtacgaacgtacgtaccgtaggaacgtaaccgggaccgtaacgggaccggtaccggtacgttaacgttaacgttaccgttacggtcgggtacgggtaaccgggtaagtaaccggttaccttaacccggttacggttaaccgttccggttttacccgtttaccgtttttacggaacttttccccgggg

SEQ ID NO: 46443 - DNA, 709 bp, Homo sapiens
  misc_feature: GYAE6OF02HY9DG.27.57.F02.1.454.CMB.1.raw
  modified_base (239)..(239): a, c, t, g, unknown or other
  misc_feature (239)..(239): n is a, c, g, or t
tcagagcgtcgtctcacgaccggtgctcgatttagctcgatatagttgggtttgaggtctcagagaggagccttagccctggactccaaggccctttccacttggtgatcagcacggagcacagaggacccacatggaactgggctgagctggtttcttgtgctatttagagtgtcagtgtgaggtgcaagtggtggattcgtggaggtaggtgtggtccagcctggagaatcccaganactctctgtcgcacgcctgtgacttactacctttaggttagttagttggtatgacgcgtcgggtaccgcgtacgaccgtacggagggacgggtctgggtacgttcggtacgaccgtaagtaactaaaccgaagaacgtaaggggaaacgtaaagtaaacctagtacgtacgacgttagtgtaaggacggaccgtattacgagtccgtaacttccccgtaacgtaggaaaccgtaaccgaaccggacccgtaaaagggaactttacccgacggtttaccgtaacgtacccgtaggtaaaccttaaaaggcgtaaacccgtccgtacccgtagggttaaacgggaccgggtaacccgggaacgtaaaccgaccggttcgtaacgtacccgtatttaaccggtggtccgaacggtaacgtaacgtacgttcctacggttaattaaccccggttttccgttacgtttagtaccg

SEQ ID NO: 46444 - DNA, 676 bp, Homo sapiens
  misc_feature: GYAE6OF02HE2AZ.27.57.F02.1.454.CMB.1.raw
  modified_base (211)..(211): a, c, t, g, unknown or other
  misc_feature (211)..(211): n is a, c, g, or t
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcnggaggaggtgtggtccagcctggagaactccctgacgactcctcctgtgcagcctntggattctacctttagtagttattggatgagcgtgggtcccncagaccgtcgaggggaacgggcgtgggtacgttcgacggaccccaaacgtaactaaaaccaaagagtaaggggaaacggtaaaaagaaaactagtaggtacggtacctagtgtacggaacgggaccgtattccaacctatcctacccgaagaaccgaaccgaaaccgaccgaaaaggtaacgtaccctaaagtttagtacttacgtacgaaacttaaaggtaacgaaacggacctaccgtaagaacggtaaccgaccggggaacgggtaaacccgacggttcgtaagttaacctacgttacgtggtacggacgtaggaaccttcgacccttggtaaccttccgtttccgttcttttagacttcccgg

SEQ ID NO: 46445 - DNA, 549 bp, Homo sapiens
  misc_feature: GYAE6OF02H9LBB.27.57.F02.1.454.CMB.1.raw
  modified_base (305)..(305): a, c, t, g, unknown or other
  misc_feature (305)..(305): n is a, c, g, or t
  modified_base (342)..(342): a, c, t, g, unknown or other
  misc_feature (342)..(342): n is a, c, g, or t
  modified_base (453)..(453): a, c, t, g, unknown or other
  misc_feature (453)..(453): n is a, c, g, or t
  modified_base (492)..(492): a, c, t, g, unknown or other
  misc_feature (492)..(492): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagagtgtcagtgtgaggtgcaactgggtggattcgtgggaggaggtgtgggtccagcctggagaatccctgagactctcctgtgcagcctctggacttcacttttagtagttatggatgagcgtgggtccncagactccgaggggagggctggagttcgtggccaaanataaaccagatgggaaagtaaaagaaacgtatggtaggactacgtgaggaacgggcctaattcaccatcctacagaacacaacgaccaaagaacgtactacttagtatctncaaatagaacagaccgtagagagccgaggacacggctanatactacgtgtgacgagagtactacgtacgtctactttccgttcttttagcttccgg

SEQ ID NO: 46446 - DNA, 730 bp, Homo sapiens
  misc_feature: GYAE6OF02JODKT.27.57.F02.1.454.CMB.1.raw
tcagagcgtcgtctcacgaccggtgctcgatttagctcgatatagttggggtttgaggtctcagagaggagccttagccctggacctccaaggcctttccacttggtgatcagcacggagcacagaggacccaccatggaactggggctgagctggtttcctgtgctatttagaggtgtccagtgtgaggtgcactggtggattcgtggaggaggtgtggtcagccgtaggagaactccgtgagtactctcctgtgtacgcctcgtaggtacttccgtaaccttttaggtaacggttttacttagggattagacggtccggttggggtaccccgaccgtacgtaccgtaccggagggggtaacggggcgtcgggtacgttcggtaggccctaaacacgtaaaccgaagcgtaagggaaggtaaaagaaactagtcggacggtactagtagtaggaggtacctagtccaacgtactcgtacaaggataccgaaagcctaaagacctctaacgtagttctccgaatacgaaatacggtaaccgtagtacccgtaaagggcccttaaacggggcccggtaacggaaccggtaccggttaacgttaacggtaactaccggtttaacgcgggttaacgaccgggaaagtaccgtaacccgttaccggtttaacccgtaccgtttaccgggtacctttaacccggttttttacggaccccgtttccccttaagggg

SEQ ID NO: 46447 - DNA, 660 bp, Homo sapiens
  misc_feature: GYAE6OF02HFDMY.27.57.F02.1.454.CMB.1.raw
  modified_base (345)..(345): a, c, t, g, unknown or other
  misc_feature (345)..(345): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcccgtggagaactccctgagactctcctgtgcagcctcgtggtattccacctttagtagttattggatgagcgtggtcccgcagactccgaggggaagggctgggtacgttcggnggaccaactaactaaaccgaagtacgtagggaaagtaaaaggaaaactagtaggtacggacttcgtggtaggaaacgggtccgtaacttaccaaccatcctaccgaagaacgaacccaacgacccaaaggaacgtcctaacgttcgttaactcgtagaacgtaaatacggaaactccgtaccgtaggaaacggaccggaccgggaacggaccgacggtaccgttagttaactaccgttacgtaggtggaaccggtaaggaacggtaaccttcgttacggttactccgtttaccgtttacgttttagactttccgg

SEQ ID NO: 46448 - DNA, 653 bp, Homo sapiens
  misc_feature: GYAE6OF02HPACM.27.57.F02.1.454.CMB.1.raw
  modified_base (332)..(332): a, c, t, g, unknown or other
  misc_feature (332)..(332): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagatccctgacgactctcctgtgcacgcctctggattctacctttagtagttattggatggagcgtgggtccgccagacctccgaggggagggctggngttcgtcggaccaacaactaaaccaagatagggaaaggtaaaagaaaacttagtagtaggtactcgtagtagggaacggtccgaacgtttaccgaccgtaccttacctaccgaaggaaccggtaaaccgaaaccggtaaccgaaaggtaaacggtaccaacgttacgttaacgtacgttagaactaaagtacgaaactacggtaccgtagaaccgacgaccggacgggaacacggtactacgtaataccgtagtacggtcgacggtaagaagtacccgtacgttacgtcgttaccgttccgttacttttggaactttccgg

SEQ ID NO: 46449 - DNA, 654 bp, Homo sapiens
  misc_feature: GYAE6OF02IXJDB.27.57.F02.1.454.CMB.1.raw
  modified_base (463)..(463): a, c, t, g, unknown or other
  misc_feature (463)..(463): n is a, c, g, or t
  modified_base (601)..(601): a, c, t, g, unknown or other
  misc_feature (601)..(601): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggactggggctgagctgggttttcctgtgctattttagagtgtcagtgtgaggtgcaacgtggtggtattcgtggaggaggtgtggtccagccgtggagaatccctagagactctccgtgtgcacgcctcgtggtattcctactttaagtagtttattggatagacgtcgtcgggtcccgaccgagtaccgtccggaaggggaacgggtcgtagggtacgttcggtcggaccaaactaacgtaaaaccgaagtacggtaggaaacggtaaaacgtaaaacgttagtggtacgtactacgtagtagggtaacgggcctagttacaacctntacctacgagacgacaaccgacctaaagaacgtctaacgtatacttcgagactaaagacgtaacgacggtacacggaacgacggaccgaacgaaccgcggaccttacgttaacgtactacggtcggtaacgcggtaanacgtacgttaccgtaggttactaccgtttcggttaacttttcgcgttacccgg

SEQ ID NO: 46450 - DNA, 641 bp, Homo sapiens
  misc_feature: GYAE6OF02GKG94.27.57.F02.1.454.CMB.1.raw
  modified_base (498)..(498): a, c, t, g, unknown or other
  misc_feature (498)..(498): n is a, c, g, or t
  modified_base (545)..(545): a, c, t, g, unknown or other
  misc_feature (545)..(545): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccccaccatggaactggggctgagctgggttttccttgttgctattttagaaggtgtccagtgtgaggtgcaacgtggtggattctgggaggaggtgtggtccagcctggagaatccctgagactctcctgtgcagcctcgtggacttcctacctttagtattagttggatgagcgtcggggtccgccagactccggaggggagggctaggtgttcgtcggaccaacaataaaaccgagagtaggtaaaggtaaaagaaaacgtagtaggtcgactctaggtagaacgggacctattcccgaactataccctacgaaggaaccgaaccgaaaccgaccgaaaggtaacgtcctaacgttagtaacttcganaacctaaagtacgaactagccgtagacggacggaccgaagggaaccncggtacttagtaaccttacgtcggtgtacggaacgaacggtagtaaccttaccgtagttacctacgttttccgtacgtttttagaccgtttcccgg

SEQ ID NO: 46451 - DNA, 647 bp, Homo sapiens
  misc_feature: GYAE6OF02G55O0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtcgcacgcctcgtggtacttctacctttagtagttattggatgagtcgtgggtccgccagacctccgaggggaacgggctgggtacgttcgtcggaccaaacaacgtaaaaccgaagacgtagggaaaggtaaaacgaaaactagtggtacggactcgtaggtaggaacgggcctagttccaacctatccctaccgaagaacggaaccaaccggaccaaaggtaactctacgttagtaactcgtagaacctaaaagtcggaaaccacggtacccgtaggaacggaaccgggacccgggaagggtacccgaaccgggtgtaacgtaacttaccgtacgttgacggacgtaggactacgttctagttctacgttcccgttcttttgacttcgg

SEQ ID NO: 46452 - DNA, 708 bp, Homo sapiens
  misc_feature: GYAE6OF02HDWJQ.27.57.F02.1.454.CMB.1.raw
  modified_base (264)..(264): a, c, t, g, unknown or other
  misc_feature (264)..(264): n is a, c, g, or t
tcagagcgtcgtctcacgaccggtgctcgatttagctcgatatagttgggtttgaggtctcagagaggagccttagccctggactccaaggcctttccacttggtgatcagcacggagccacagaggacccaccactggaactggggctgagctggttttccttgttgctattttagaagtgtccagtgtgaggtgcaactggtggattctggaggaggtgtggtccagcctggagaatccctgagactctcctgtgcagcctntggattctacctttagtagttattggatgagcgtcgggtccgccagacctccggaggggaaggggctagggtagttcggtcgggaccaacaacgtaaaaccgaaagagtagggaaaggtaaaaacgaaaacgttataggtaggaccttcgtagggtaggaaacggggccgtaacgttaccaacccgtactacccgttaccgaacggtaacggaaacccgaaccggtaaccccgaaaaaggaaccgttaccgtaaaccgttcgttaaacgttcgtacgtaaactaaaacgtacggaaacgacggtaacccgtaggaaaccgtacggaaccgggaacggtaaccgaccgggtacgttacgtaattaccgtaacgtggtcggaccggaagtaacgtacgttaccgttacgtacttaccgtttaccgtttacgttttagtacttccgg

SEQ ID NO: 46453 - DNA, 729 bp, Homo sapiens
  misc_feature: GYAE6OF02GK6JL.27.57.F02.1.454.CMB.1.raw
  modified_base (265)..(265): a, c, t, g, unknown or other
  misc_feature (265)..(265): n is a, c, g, or t
  modified_base (376)..(376): a, c, t, g, unknown or other
  misc_feature (376)..(376): n is a, c, g, or t
  modified_base (680)..(680): a, c, t, g, unknown or other
  misc_feature (680)..(680): n is a, c, g, or t
  modified_base (685)..(685): a, c, t, g, unknown or other
  misc_feature (685)..(685): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggtttcttgtgctatttacgagtcgtcagtgtgaggtgcactggtggacttcgtggaggaggtggtcggtccgagtccgtaggaagtaactcccgtgacgtacctcgtaccngtcaccacgcctcgtcggtaattccttaacctttaaggttactttgttacggagtggaacgtcgtccggggtccaaccgaacggtacctacgggaagggggtaaaccgggnggttacggtacggtttccggtacggacccaaaaacgtaacctaaaaaccggaagtaacggtaacgggtaaaaggtaaaaacgtaaaacgtaggtaggttaccggtaaccttagtggggaacggtaaacgggcccgttaacttcctaaacctacctcgtccgaaacgtacggaaacccgtaaccggtaaccctaaaaggtaacccgtaccgtaacggttacgtaaacgttcgtaacgtaaacaaacgttacaacgtacgtcgtaggaacggcgtaacggaccgagtacggtcaacgttacacgtntcggnggtcgaatcgacttacgctacgtacctcgtttattacgctacgg

SEQ ID NO: 46454 - DNA, 696 bp, Homo sapiens
  misc_feature: GYAE6OF02F29R7.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggtttccttgttgctatttagaaggtgtccagtgtggaggtgcaacgtggtggattctgggaggaggtgtggtccagccgtggagaactccctagagactcttcctgtcgcagcctcgtggtattctaacctttagtagtttattggatgaggtcgtcggggtaccgccgtacgtaccgtccggagggggaaggggcgtagggtacggttcggcggaccaagaactaaaccgaagtagtagggaaaggtaaaacgtaaaacgttagtacggtacgtaacttcgaggttaacgggtaacgggacctaacgtttaccaaccctagttcccgtaaccgacggaaacgtaaacccgaaccgaacctaaaagggtacctactaacgttgtaaccgttctaacggtaactaaacgtgaaacgcgtacgtaggaacgtcggaccggtaaggaccgacggtacttacgtaacttaccgtacgtcgggtacgacggtaacgaacttacgtacgttagaccgtttacgttcccgttgttttacgacgttccg

SEQ ID NO: 46455 - DNA, 671 bp, Homo sapiens
  misc_feature: GYAE6OF02IN20D.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattctggaggaggtgtggtccagcctggagaatccctgagactctcctgtgcagcctctggattccacctttagagtttattggatggagcgttggggtccgcacggacctccgagggggaaggggctgggacggtttcggtggaccaaacataaaacccgaagtatcgggaaggtaaaagaaaacttatggttaggacttcgtggttagggaaacggggtccgaatttccaaccctacgttcctaccgaagaacggaaaccgaaaccgaccgaaaggtaaacgtacctaaacgttagttaattccgtagtaccaaaagtgaaaccaggacccttaggaacgacgggaccggaacgggaaccgaacggtacctaggtattaacctagttacggtggaaccggaggtaacgtaacgttacccgttagtccttaacgtttcccggtacgtttttacgagtttacccgg

SEQ ID NO: 46456 - DNA, 733 bp, Homo sapiens
  misc_feature: GYAE6OF02F8FXK.27.57.F02.1.454.CMB.1.raw
  modified_base (605)..(605): a, c, t, g, unknown or other
  misc_feature (605)..(605): n is a, c, g, or t
tcagagcgtcgtctcacgaccggtgctcgatttagctcgatatagttgggtttgaggtctcagagtggagccttagccctggactccaaggcctttccacttggtgatcagcacggagcacagaggacccaccatggaacgtgggctgagcttgggtttcctgttgctatttagagtgtccagtgtgaggtgcaacgtggtggattcgtggaggaggttggtggtccagccgtaggaagaacttcccgtagacgaccttcctccgtgtgccgacgcccttgtggtacttcctacgttttaaggtagtttagttggatgacgtcggtcgggtccgaccgtacgaccgtccggaagggggaacgggtcgtgggtacggtttccggtacggaacccaaacgtaaacgtaaaaccgaaggtaagtagggtaaaagtaaaaacgaaaacgtttagtacggtaggtaccttacggtagggtaacgggaaccgggtacctaacgttaccaaccgtacgtaccgtaccgaaaggtaaaccgaacccgtaaaccgacctaaaagggaacgtccctaacgttgtaaaccgtcgtaacgaactaaacgtcgaaacncggtaccgtaggaacgaccggacgggtacgactaccggtctaagttaactacgtacgtgggcgaacggtaagaccttacgttacccgtagttaccgttacgtttcccgtttagttttacgcttccggg

SEQ ID NO: 46457 - DNA, 636 bp, Homo sapiens
  misc_feature: GYAE6OF02JDFXF.27.57.F02.1.454.CMB.1.raw
  modified_base (181)..(181): a, c, t, g, unknown or other
  misc_feature (181)..(181): n is a, c, g, or t
  modified_base (595)..(595): a, c, t, g, unknown or other
  misc_feature (595)..(595): n is a, c, g, or t
  modified_base (630)..(630): a, c, t, g, unknown or other
  misc_feature (630)..(630): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggtttccttgttgctattttagaggtntccagtgtgaggtgacaactggtggattcgtgggaggaggtgtggtccagcctggagaactccctgagactctccgtgtcgcagcctctggtattcctacctttagtagttattggatggagtcgtcggtccgcagaccgtccgaggggaacgggctagggtaggttcgtcggaccaactaactaaaaccgaggaagtagggaaacgtaaaacgaaaacttagtacggtaggacctgtaggtaggaaacggtccgtaattaccgactacgtcctacgaacggtacaaccgtaacgaccgaaagacgtacctattacgtacttcgttacgaactaaagtacgaaacctacgaccgtaggaacgacgacccggaaggaacccgcggtatacgtactactacgtgtaccgagagtanaccgttccgttatccgttacttcccttagttacgnttccgg

SEQ ID NO: 46458 - DNA, 542 bp, Homo sapiens
  misc_feature: GYAE6OF02I9CA8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactcctcctgtgcagcctctggattcacctttagtagttattggatgagcgtgggtccgccagactccgagggaaggggctggagttcggtggccaacataaaccaagatggaaggtaaagaaaactatagtgatctgtgaagggcgatcgaccatctcagagaacaacgaccaaagaacgtaccacgttagtatccagtacaaagtagaacaacgccctagaagaggaccgaaggaccgacggcgtgtatactacgtagtgacgagagactctagtctacttccgtctttgattcg

SEQ ID NO: 46459 - DNA, 713 bp, Homo sapiens
  misc_feature: GYAE6OF02FNVI5.27.57.F02.1.454.CMB.1.raw
  modified_base (273)..(273): a, c, t, g, unknown or other
  misc_feature (273)..(273): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctatttagaaggtgtccagtgtgaggtgcaactggtggattctgggaggtaggtgtgggtccaggccgtaggaagaactcccgtagacgacctcctccgtgtcgcgngtcctcgtggtattcctacctttagtagttagttggatggagtcgtggggtccgaccgaagtacctaccggaagggggaacggggtcgtagggtacggtttccggtacgggaccccaaacgaacgttaaaaacccgaagtaaggtacgggtaaaagggtaaaaacgaaaaacgttagtaacggtacggtacgttacgtggtaacggaacgggtacctagttaccgacctactccgtacgacggaacgtaaccgaacgtaacccgaaagtaaacggtacctaacgttagtactactacgaccgaaatacgaacgacgtaccgtaggaacgtacggaccgacgaacgacggtacgtagtaactacgtagtacgtcgtacggtagtaagtaccgttaccgttaacgtaccttacgttaccggttacttttccggatttcccgg

SEQ ID NO: 46460 - DNA, 838 bp, Homo sapiens
  misc_feature: GYAE6OF02F8LVR.27.57.F02.1.454.CMB.1.raw
  modified_base (119)..(119): a, c, t, g, unknown or other
  misc_feature (119)..(119): n is a, c, g, or t
  modified_base (827)..(827): a, c, t, g, unknown or other
  misc_feature (827)..(827): n is a, c, g, or t
tcagagcgtcgtctcacgaccggtgctcgatttagctcgatatagttgggtttgaggtctcagagaggagccttagccctggactccaacggcctttccacttggtgatcagcacggancacagagacccacatggaactggggctgagcttgggttttcttgtgctattttagaggtgtccagtgtgaggtgcaacgtggtggattcgtgggaggtaggtgtcggtccagccgtaggaagtaactcccgtgacgtacttcctccgtggtcgacacgtccctcgtacggtactttaccgttaaccgttttaaggtacgtttagtttacgggaattggaacggttcggtaccgggggtcccctacccgtaacggtaccggttacccgggaaaggggggttaacggggtccgtacggggttaacggtttccgggtaaccggaaccccgtaaaaacgtaaacgtaaaaccgtaaaggtaacggttaagggggtaaaacggttaaaaaacggtaaaaacttggttacgggttacggtaaaccttccggtagggttaacgggaaacggggtccctaagtttacccgaaccttacgttcccgtaacgaacggtacgaaaccgaacccggtaacgaaaggtaacgtaccgttaacgttacggttaacttaccgtaacgaaacgttaaacgtacggaaaccgtaccgggtaccttaagggaacggtaaccggtaacccggacggtaaccggaccgttacgtaacgttaactacgttacgtacgggcaacggacgtactacgtaccgttacgtacgttccgttaccgtgttttacncgtttacccgg

SEQ ID NO: 46461 - DNA, 670 bp, Homo sapiens
  misc_feature: GYAE6OF02FY5BJ.27.57.F02.1.454.CMB.1.raw
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttccttgttgctattttagaaggtgtccagtgtgaggtgcaactggtggattctggaggaggtgtggtccagcctggagaatccctgagactctcctgtgcagcctctggattcacctttagtagttatggatgagtcgtgggtccnccgaggtacctccgaaggggaacggggctgggagtttcggnggccaaacgataaacccaagagtaggaaggtaaaagaaaactagtcggtaggaaccttcgtaggtcggaaacggggtccgtaatttccgaacccgtactccgttaccgaagtaacggaaacccgaaccggtaccgaaaacggaaacgttcccgaaacgtttacggtaacttaccgtaggaaccaaaagtttcggaaaacctcggtacccgttagaacggtacggaaccggagggaaacccgacggtccgtaagtacgtacgtacgtacggtgaccggtaaggaagtacgttccgtagtcctacgttcccggtattttacgattccg

SEQ ID NO: 46462 - DNA, 786 bp, Homo sapiens
  misc_feature: GYAE6OF02JNIO6.27.57.F02.1.454.CMB.1.raw
  modified_base (268)..(268): a, c, t, g, unknown or other
  misc_feature (268)..(268): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaggtgtccagtgtgaggtgactaactggtggattcgtgggaggaggtgtggtccagccgtaggacgaactccgtgacgactctccgtggtacncgtagcctgtgtacttcctaaccgtttagtagtttagttaggattacggacgttccggtacgggtccccgacgaaccggtaccgtaaccgggaagggggtaaccggggtcgtaggggttacggtttccggtacggaaacccaaacgttaaaaccgaaaccgtaaaggtacgggtaaacggggtaaaaggtaaaaacgtaaaacgttacggtacgggtaggtaacccgttggttaaggggtaacgggtaaacccgggtaccttacgtaacccgtaacgttacctaaccggtaccgaaaggaaaccgttacccggaaaccgtaaaggaagttaacccgtacgtacgttaagttaaccgttacgaacggaaacttaaaggaccgacggcgtaacgacgggaacgtaccgacgggtaaccgtcggacgttacttagtaacccgtgtaacggcgtaacggaatacgtaacggtacctacgtttacgtaccgtttccgttcgttagtttacccggctaccgggg

SEQ ID NO: 46463 - DNA, 718 bp, Homo sapiens
  misc_feature: GYAE6OF02ICN2Z.27.57.F02.1.454.CMB.1.raw
  modified_base (317)..(317): a, c, t, g, unknown or other
  misc_feature (317)..(317): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaacgtggtggattcgtgggagggaggttggtggttcccaggtcccgttgggaagtaactccccgtagacgtactctcctagtgcagcctcgtggacttcactttagtagttatggatggancgtcggtccgaccgagactccggagggagggtctggtagttcgcgaccaactaataaaccaagtagtacggaaaggttaaaacgaaacttagtacgtaggtaccgttgtaggtacgggaacggtcccgttaattcccaaccgtattacccgtaccgaagtaaccgaaccgaaaccgtaccgaaagtacgttacaaccgtttgtaacttcgtaacgaacgtaaacacgggtaaaccaccggtactacggaaacggtaccggaacccggaaagggaacccgtccggtaacttagtaacctttaccgtacggttagggtaaccacggtaaacgaacggttaccttaccgtacgggttcttaacccgttttacggtttaccttttaccgggactttacccggggg

SEQ ID NO: 46464 - DNA, 708 bp, Homo sapiens
  misc_feature: GYAE6OF02IHJDN.27.57.F02.1.454.CMB.1.raw
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgtgggttttccttgttgctattttagaggtgtcagtgtgaggtgcaactggtggattctgggaggaggtgtggtcagcctggagaatcccngagctctcctgtgcngcctntggtattctacctttagtagttagtgatgagtcgtcggtccncagactcgagggagggcgtggtacggttcgcggacctaaacgaactaaaccgaagtacgtaagggaaaggtaaaaacgtaaacgttagtcggtaggtaaccttcgtagggtacggtaacgggacctacgttaccaacgtacgtaccgtaccgaagaacgaacaaaccgggacccgtaaaagtaaccgtactaacgttacgttacgtaccgtagaaaccgtaaataccggaaacgtaccggacccttagggaaacgacgggtaacccgaacgggtacctaacccgggttcttacgggtaaacctttaacccgttccggtaggtaaccggaaccggtaaggaccttaaccgttccgtaaagtttcccgtacgttttcccggtaacgttttttcggacgttacccggg

SEQ ID NO: 46465 - DNA, 567 bp, Homo sapiens
  misc_feature: GYAE6OF02IYWTX.27.57.F02.1.454.CMB.1.raw
  modified_base (391)..(391): a, c, t, g, unknown or other
  misc_feature (391)..(391): n is a, c, g, or t
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtgggctgagtcgttgggttttccgttgttgtcttatttaggaggtgtcctagtgtgaggtgacgtaacgtggtggtattcgtaggaggtaggtgtggtccccaggccctgggacgaagtcccctgtagactctcctgtgccagccgtactggactttcacccttttagtagttattgggaatgagctggtccgcagacgtccaggagggctggagtcgtgcaacataaaccagatgagtaaagaactangtgatctagtgaaggccgattcacatctaccaganacaacgtcaagagtcaatgtatcgtancaagtgaacagctagacgagtaccgaagcacgtcgtacgtaataccgtagtcggtcgtacgagtaacgtaacgttccgtaacgtctaacgtttcccgtacttttcgattcccgg

SEQ ID NO: 46466 - DNA, 774 bp, Homo sapiens
  misc_feature: GYAE6OF02J28HJ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagtctgggttttcctgtgctatttagaggtgtccagtgtgagtgcaacgtggtggattcgtggaggaggtgtggtccagccgtggagtaactcccgtgacgtacctcgtccgtggtcgcgacggtccctcgtggactttccgtaacccgtttagtagtttattgggaatgaggtccgtggggtcccacgagccgttaccggaaggggtaacggggcttgggaggtttcggtcggaccaaacgtaactaaaaccgaaggaggttagggaaaggtaaaaactaaacgtatacgggtacgtacgtacgttaggtagggtaaaccggggaccgtaacgttcccgtaacctacgtacctacccgaaggtaaccggaacccgttaaaaccggacccgaaaacgggtaaccgtaccgtaacgttagtttaacctaccgtaacgaacgtaaaggttaaccgaaacgtaccgtaccgtacggaaacgtacggacccgggtaaaccgaacggccgttaaccggtagttaaccgtaccgttacggttacgggtaacgtaccgggtaataacggttccgttaactaccggtttacgtaacccgttttccggtttaccgttttacgacgtttaacccggg

SEQ ID NO: 46467 - DNA, 720 bp, Homo sapiens
  misc_feature: GYAE6OF02JBCHO.27.57.F02.1.454.CMB.1.raw
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaggtgtccagtgtgaggtgcaacgtggtggattcgtggaggaggtgtggtccagccgtggagaatccctgacgactctcctgtgcagcctctggattcctaccgtttagtagtttattggatggagcgtcggggtccnccgaggaccgtaccggaggggaaggggcgtgggtacggttcgtacggaccaaacgaataaaaccaaggaagtagggaaaggtaaaagaaaacgtagtaggtacggtacttcgtaggtacgggaaacggggtcctaacgttccacccaacgttcctaccgaaggaacgtaaccgaaaccgtaacccgaaaaggtacgtaccgtaacttggtaacttccgtagaactaaacgtacgtaaaccgaggacccgtaggaacggaccggacccgggaacggtaaccggtaccggtacgtaacgttaaccgtaccgtttaccggtggtcgggtaaccggtaaggaaccgttaaccttacccggtttacgtaccgttaacctttcccgggtttactttttacggacgtttcccgg

SEQ ID NO: 46468 - DNA, 752 bp, Homo sapiens
  misc_feature: GYAE6OF02IQ1RJ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggtttttccttgttgctattttagaaggtgtccagtgtgaggtgacaacgtggtggtattcgtgggagggaggtgtcggtccagccgtaggagaactcccgtagacgtacctcctccgtgtgccgtacgtccttacgtcggtactttacctaacgttttaaggtagtttagttggattggacgtcgttcggggttccctacgacggtacctaccgggaagggggtaacgggtcgtagggtacgtttcggacggtaaccaaactaaacgtaaaccgaaggtaacggtaaggggtaaaaggtaaaaacgtaaagttagtaggtacgtacgtcgttaggtaagggacggtacctagttaccaacctactcccaacgaacgaacgaaaccaaccgaacgaaacggtacgtactaacgttacttaacttacgtagaactaaaacggtacgaaaccgagtaccggtaggaaccggtaacggacccggtaagggaaccgtaggtaccgttacgttaacgttaccgtacggttacggtacggtaagacgtactaacgttaccgttcgttaccgttccgtttccggtttacgtttacgattaccggg

SEQ ID NO: 46469 - DNA, 651 bp, Homo sapiens
  misc_feature: GYAE6OF02F6LB7.27.57.F02.1.454.CMB.1.raw
  modified_base (181)..(181): a, c, t, g, unknown or other
  misc_feature (181)..(181): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggtttcctgttgcttattttagaggtntccagtgtgaggtgcaacgtggtggattctgggaggaggtgtcggtccagccgtaggagaactcccgtgagactcctccgtgtgcagtccctgtgtattcctacctttagtagttatggatgagcgtcgggtccgcagaacctccggaagggggtacgggctgggtagttcggtacggcctaaacgaacgtaaaacccgaagtaacggtagggtaaagggtaaaacgaaaaacttgtacggtaggacttgtagtacgggaacgggacctacttaccacctacgtcctaaccgagaacggtaaccaaccgaccgaaaaggacgtaccagttgtaactagtcgaataactaggaactcgtacgtacgacgaccgccgaacgaccgtacggtactacgtaacgttactacgtgggcgacggagtacgtacttaccgtaggtaccttaccgttccgttcgtttagcttacccgg

SEQ ID NO: 46470 - DNA, 764 bp, Homo sapiens
  misc_feature: GYAE6OF02JKSTR.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaagtgtccagtgtgaggtgcaactggtggattcgtggaggaggtgtggtccagcctggagaactccctgagactctcctgtgcagccctcgtggtattcctacctttagtagtttaagttggatgacgtcgtcgggtcccgtaccgagaccgtccggaagggggtaacggggtcgtgggtacggttcggtcgggacccaaacgtaacgtaaaaccgaagtaaggtaagggtaaacgggtaaaaagtaaaaaccgtttagtacgggttacggtaaccgtttacggttagggtaacgggaaacggggtacccgttaactttaccggaaccctaacgttccccgttaccgaaagggttaaccgaaaccgtaacccgggtaacctaaaacgggtaacgttacctaacgttgttaaaccgttacctaaggaaacgtaaacgtacgaaacgtcgtaccctagggaacggtaaccggacgggtaccggaacgtaccgggaacttagttaaccgttactaaccggtggtaacgacggaagtacgtaaccttccgtaacggttacttaccggttacgttttacgttgtacgttccgg

SEQ ID NO: 46471 - DNA, 686 bp, Homo sapiens
  misc_feature: GYAE6OF02GLYP2.27.57.F02.1.454.CMB.1.raw
  modified_base (320)..(320): a, c, t, g, unknown or other
  misc_feature (320)..(320): n is a, c, g, or t
tcagagcgtcgtctcacgaccggtgctcgatttagctcgatatagttgggtttgaggtctcagagaggagccttagccctggacctccgaaggcctttccacgttggtgatcagcacggagcacagaggaaccaccatggaactggggctgagctgggtttccttgttgctatttagaaggtgtccagtgtgaggtgcaacgtggtggattctggaggaggtgtggtccagcctaggagtaatcccgtagacgacttcctcctggtagcagtcctcgtggacttctacctttagtagtttatggactgagcgtgggtccncctaagcctcgaaggggaacgggcctagggagttcggtacggccaaacgaactaaaccgaagtaacgtcgggtaaaagggtaaaacgaaaaaccgttagtggtacggtaaccttgtaggtaggaaacggggtaccagtttaccgaacctacgtacctacccgaagaacgaacgaaccgaccgtaaagaacggtacacgttacgtagtcgtagaacgaaactacgaactacgaccgtagaacgtacgaccgggaagaccgtacggtacgtagttaacttacccgtagttacggtcgaccggaaggtaaccgtaacgttaccgtaggtacccttcggttacccgttacggtttttacaccgtttccgg

SEQ ID NO: 46472 - DNA, 788 bp, Homo sapiens
  misc_feature: GYAE6OF02G92AG.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaacgtggtggattcgtggaggtaggtgtggtccagcctggagaactccctgagactctcctgtcgcacgtcctcgtggtattcctaccgtttagtagttattggatggagtcggtgggtcccgccgacggtaccgtccggaagggggtaacggggcgtgggtaggtttccggacgggtacccaaaaccgtaacgtaaaacccgaaggtaagtaggggtaaacgggttaaaaagtaaaacttagtacggtaggtaccttaggtaggttaacgggaacgggggtccctaagtttacccgaacccgtacgtttacccgtaaccgtaacggaaacggttaaacccgaaacccgtacccgtaaaaacggtaaccgttacccgtaacgttacgtttacttacggtacgtaaacctaaaaggttacgaaacccgtacgtaccgttaagggaaccggtaacggacccggtaacgggaccgtaaaccggtacggtttaacgttaacctacgttaccgttaggtccggacgtaaacggtacgaaccgtttcgtaacgttaccttaccggtttcccggttactttttacggactttacccggg

SEQ ID NO: 46473 - DNA, 565 bp, Homo sapiens
  misc_feature: GYAE6OF02HLS8A.27.57.F02.1.454.CMB.1.raw
  modified_base (343)..(343): a, c, t, g, unknown or other
  misc_feature (343)..(343): n is a, c, g, or t
  modified_base (367)..(367): a, c, t, g, unknown or other
  misc_feature (367)..(367): n is a, c, g, or t
  modified_base (446)..(446): a, c, t, g, unknown or other
  misc_feature (446)..(446): n is a, c, g, or t
  modified_base (462)..(462): a, c, t, g, unknown or other
  misc_feature (462)..(462): n is a, c, g, or t
  modified_base (557)..(557): a, c, t, g, unknown or other
  misc_feature (557)..(557): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtgcagcctcgtggattcacctttagtagttattggatgagcgtgggtccgcagactccgaggggagggctggagttcgtagcctaanataaaccaagagtaggaagtaaanaaactatggtgactgtagtggaacggcgattccactatcctacgaagacaacgaacgaccaaagaacgacactagttanctgacaaatacgaacngaccgtgagacgcgagacgacgcgtagtactacgtacgtcgtggcgaaggacgtactaccgttacgttacctacgtttcccggtacttttacggnttacccgg

SEQ ID NO: 46474 - DNA, 858 bp, Homo sapiens
  misc_feature: GYAE6OF02JC5ZF.27.57.F02.1.454.CMB.1.raw
  modified_base (562)..(562): a, c, t, g, unknown or other
  misc_feature (562)..(562): n is a, c, g, or t
tcagagcgtcgtctcacgaccggtgctcgatttagctcgatatagttggggtttgaggtctcagagaggagccttagccctggactccaaggcctttccacttggtgatcagcacggagcacagaggacccacatggaactggggctgagcgttgggttttccttgttgcttattttaggaaggtgtccagtgtgaggtgcacgtggtggattcgtggaggaggttgtggtcctagccgtggacgactcccgtgagaccttctcctggtcgacctagtcccttcgtggtacttccttaaccgttttaaggtacgtttaattgggacgttggtaacgtcggttcgggtccccgaccgacggtaccgttaccgggaaggggggaacgggtccgttaggggtacgtttcggggtcgaaacccctaaacgtaacgtaaaaccgtaggtaacggtaagggtaaaacggttaaaaacgaaaacctttagggttacggtaaacggtctttacggtagggttacgggaacggggttacccagtttaccaccgtacttaccgacggtaaanacgaaacccgtaaccgtaccaaaaggttacctaccgtaacgttacggtaactcgttaacgaaacgtaactaccgaaaccgtcggtaaccgttaacgggaacgttaacgggaccccgggtaacgggtaaaccggaccgggtttaacggttaacgttaaccgttaccgggttaacggttccgggttaaggggaaaccccggttaaagggttaacccgggtaacccttttacggtttaacccggtactttaccccggttttaaccggttttcgtttaaacccggtgttttaaccccggg

SEQ ID NO: 46475 - DNA, 639 bp, Homo sapiens
  misc_feature: GYAE6OF02GCRRG.27.57.F02.1.454.CMB.1.raw
  modified_base (181)..(181): a, c, t, g, unknown or other
  misc_feature (181)..(181): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (362)..(362): a, c, t, g, unknown or other
  misc_feature (362)..(362): n is a, c, g, or t
  modified_base (579)..(579): a, c, t, g, unknown or other
  misc_feature (579)..(579): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaaggtntccagtgtgaggtgcaactggtggattctggaggaggtgtggtccagccgtggagaactccctgagactctcctgtgcngcctntggattcctacctttagtagttagttggatgagtcgtcggggtccgccaggacctaccgagggggaaggggctgggtacggttcggtcggacctaanaactaaaaccgaagtagtaggaaagggtaaaagaaaacgtgtggtacggtactcgtaggtaggaaacggggtcctaattccacctatcctaaccgaaggacgaaccaaccggacgaaacgtaacgtacacgttgtactcgtacgaacaaatcgaaacgacgtccgtagacgacggaccggaaaggaccggacggtacgtacgtaattaccgttacgnggtaacggacgtaggacgtacgtacgttactcgttaccttcgtacgttttcgacttccgg

SEQ ID NO: 46476 - DNA, 768 bp, Homo sapiens
  misc_feature: GYAE6OF02G2RGT.27.57.F02.1.454.CMB.1.raw
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggaccccaccatggaactggggctgagctgggttttccttgttgctattttagaggtgtcagtgtgaaaggtgcaacgtggtggattcgtggaggaggtgtggtccagcctaggagaactccngacgactctctgtncagcctctaggtacttctaacctttaggtagtttagttaggagtaggtaggtccggttcgggggtccccaccgtaacggtacccggttacccggaaggggggtaacgggggcgttaggggtacggtttccgggtacgggaacccctaaaccgtaaacttaaaaccgaaaggtaacggtaagggggtaaaacggttaaaaacggtaaaaacttaggttacgggtacggtaacttcgttagggttacgggaaacgggtcccgtaagttacccaaccgtacttccgacccgtaagaaccgggtaaaccaaccgggaacccaaagggtaaactccgtaacgtacggtttataccgtagaactaaacgacgaaccaacggtccgtagaacggaaccgggaccggtaacgggacctaccgggtaacttagtaaccttacgttacgtggtccggacgagtacggtaccttacgtacgttcctaccgtttacccgtcgttttacgacttcccgg

SEQ ID NO: 46477 - DNA, 805 bp, Homo sapiens
  misc_feature: GYAE6OF02J1FA4.27.57.F02.1.454.CMB.1.raw
  modified_base (176)..(176): a, c, t, g, unknown or other
  misc_feature (176)..(176): n is a, c, g, or t
  modified_base (267)..(267): a, c, t, g, unknown or other
  misc_feature (267)..(267): n is a, c, g, or t
  modified_base (627)..(627): a, c, t, g, unknown or other
  misc_feature (627)..(627): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgtggttttctgtgctatttagaggtntcagtgtgaggtgactaactggtggattcgtggaaggtaggtggtggtaccagccgtgggacgaactccgtagagacttcgtccgttggtncgacgtcctcggtagtacgttacctaccgtttaaggtacttttaaggtaggtagtagtacgtcgtccggggtcccaacctcgtaaccgtccggaggggacgggtacgtcggtagttcggtacggaacctaacgaaacgtaaaccgtaaagacggttaaacggggaaaacgtaaaacggaaaagtttacgttagggttacgggaacgtttaccgtgggttaacgggtaaacggggaccgttaacgtttacccgaaaccgttacggttacccgtaaccgtaaaggaaacccggtaacccgaaacgggttaacccaaaaccggggttaacgtccttaaaccgttgttaaactacccggttaanaaacgtaaaccgtaacggaaacccgtacggtaaccggttaggaaccggtaaccgaccgggaaccggtaccgaccggtaaccgttacgtaacgtaccgttacggtgggaaccggtacgtaacgtaacgttaccgtaccgttagtaaccgttagttccggtttacgtttacgtacgtacg

SEQ ID NO: 46478 - DNA, 735 bp, Homo sapiens
  misc_feature: GYAE6OF02JIH24.27.57.F02.1.454.CMB.1.raw
  modified_base (317)..(317): a, c, t, g, unknown or other
  misc_feature (317)..(317): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaaccaccatggaactggggctgagctgggtttcctgttgctattttagaaggtgtccagtgtgaggtgcaactggtggattctggaggaggtgtggtccagccgtggagaatcccgtgagactctcctgtgcagcctcgtggtacttctaacctttagtagtttagttggaactggagtcgttggggtccncctacgacgtccgaggggaagggctgggagttcggtaggccaaaactacgtaaaaccgaagaacgttaggggaaacggttaaaagaaaaaccttagtaggtacggtaacctgtaggtaagggaacgggtccgtaatttccgaaacctagtacctaccgaaggaacgtaaccgaaaccgaccgaaaacgggtaaacgtaccgtaacgttacggtaacttacccgtacgtaacttaaaacgtacggtaaaccaacggtaccccgttaaggaaaccggttacggaacccgggtaacggaacccggaaccggtaacgttacgtaaaccgttacgtaacgttacgggtaacggacggtaacggtaacggtaaccttaccgtaacgttcgtacgtttacccgttacgttttacgtagttcccgg

SEQ ID NO: 46479 - DNA, 671 bp, Homo sapiens
  misc_feature: GYAE6OF02GTFBU.27.57.F02.1.454.CMB.1.raw
  modified_base (247)..(247): a, c, t, g, unknown or other
  misc_feature (247)..(247): n is a, c, g, or t
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctatttagagtgtccagtgtgaggtgcaacgtggtggattcgtgggaggacggtgtcggtccagcctggagaactccctganactctcctgtcgcagcctgtaggtacttacctactttagtagttattggatgagtcgtggggtccnccagacctccggaaggggacggggctgggacgttcgtcggaccaacaactaaaccgaagtagtagggaaaggtaaaagtaaaactagtaggtaggacttcgttaggtagggaacgggaccgtaattaccgaacctacgtacctaccgaaggtaacgaaaccgaaaccgaccgaaaggtaacgtacctacgtacgttactcgtacgaacgtaaagtaacgaaaccgacgtaaccgttaggaacggacggaccgggaacgaaccggtaccggtattacggtaattaccgttactagggtagacggaagacgttactaccgttactcgttaccgtttcccgttacgttttacgacgttccg

SEQ ID NO: 46480 - DNA, 689 bp, Homo sapiens
  misc_feature: GYAE6OF02JU5UF.27.57.F02.1.454.CMB.1.raw
  modified_base (500)..(500): a, c, t, g, unknown or other
  misc_feature (500)..(500): n is a, c, g, or t
tcagagcgtcgtctcacgaccggtgctcgatttagctcgatatagttgggtttgaggtctcagagagagccttagccctggactccaacggcctttccacttggtagatcagcacggagcacagaggacccaccatggaactgggctgagctggtttccttgtgctatttagtaaggtgtccagtgtgaggtgcgacgtggtggattcgtggaggacggtgtggtccagacgtggagtaactcccgtgagactccgtcctgtggccagtcctacgtgacttctacctttagtagttagttggatagcgcgtcgggacctccgagaccgtcggaggggtaacgggctaggtagtccgtaggtcccaaagtaacgaaaccgaagtagtagggtaaacgtaaaacgaaacgtagtggacggtactgtacggaggacggtactcttacacattccgacgaagacgtaacgaaccgtacgaagttaacgacctagacggtttacncgtaacggaactaacgtaaccgaacgaacgtcggtaaacggacggggaaccgtaacgggtaaccgaactacccgggttagtacttaacgttacgtcgtacggttaccggtaaggtacgaacgttccgttaaccgttaacgtaacgtttccgggttttaacccttccgggttttagtaacccttaccggg

SEQ ID NO: 46481 - DNA, 736 bp, Homo sapiens
  misc_feature: GYAE6OF02FG9EQ.27.57.F02.1.454.CMB.1.raw
  modified_base (373)..(373): a, c, t, g, unknown or other
  misc_feature (373)..(373): n is a, c, g, or t
  modified_base (457)..(457): a, c, t, g, unknown or other
  misc_feature (457)..(457): n is a, c, g, or t
  modified_base (518)..(518): a, c, t, g, unknown or other
  misc_feature (518)..(518): n is a, c, g, or t
  modified_base (548)..(548): a, c, t, g, unknown or other
  misc_feature (548)..(548): n is a, c, g, or t
  modified_base (608)..(608): a, c, t, g, unknown or other
  misc_feature (608)..(608): n is a, c, g, or t
  modified_base (625)..(625): a, c, t, g, unknown or other
  misc_feature (625)..(625): n is a, c, g, or t
  modified_base (653)..(653): a, c, t, g, unknown or other
  misc_feature (653)..(653): n is a, c, g, or t
tcagagcgtcgtctcacgaccggtgctcgatttagctcgatatagttggggtttgaggtctcagagaggagccttagccctggactccaaggcctttccacttggtgatcagcacggagcacagacggacccaccactggaactgggctgagcttgggtttccttgttgctattttagaaggtgtccaagtgtgaggtgcaactggtcggtattctggagggaggtgtcgggttcccagcccgttaggacggaactccccgttagacggtcctccttccctggtcgccacggccctacttcgggtactttcctaaccccgttttaaggttacgtttaagtttgggaatcgaacgggtcgttcggggttacccnccttaaggaacccttcccggaaaggggtaacggggcttacgggacggttacggtacggaacccttaaagaaccgttaaaaaccnggaagttacgggaaacgggtaaaaacgttaaaacctggtaacgttcggaaactcgttacgnggaaaccgggcctacgttaccaaccgttanacccttcaaacggcgaaacctaaccggacctaaacgaacgacctcgtagttacttccganaccctaaatacgaactnccgtagtagggacacggaacgggaaacncgggtactaggtaactaccgtactggtacgaacgcgtaagccgttactacggtacacggttccctttagttgtacgttaccgg

SEQ ID NO: 46482 - DNA, 816 bp, Homo sapiens
  misc_feature: GYAE6OF02G4RJK.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgttgctatttagagtgtcagtgtgaggtgcacgtggtggattcgtggaggaggtgtcggtccaggccgtaggagaactccctagagacctctcctgtgcagtcctcgtggtacttcctacctttagtagttattggatgagtcgtcgggtcccacgacgtaccgtccggaagggggaacggggtcgtagggtacggtttcggtacggtaacccaaacgtaaacgaaaaaccgaaggtaagttaacggggaaaacggttaaaaaacgtaaaaaccgtttaggttacggtacggggtaaccttacggttaacgggttaacgggaaaccgggggtcccgtaaacgtttacccgaacccgttaaaccgtttacccgtaacccggttaacggaaacgggtaaaccccaaacccgggaaactaaaacggggaaaaccgttttccgaaccgtttaaacgggttacttaccggtaaagaaacccgttaaaagttaacccgggaaaacgtacggtaccccggtaaggtaaccggacggaaccgggtaaacggaaccgtacggtacttagttaacctacgttacgtggtacggaacggtacgtacgtaaccgttccgttaacgtcgttaaccgtttcccggtttacttttaccggactttaccgg

SEQ ID NO: 46483 - DNA, 657 bp, Homo sapiens
  misc_feature: GYAE6OF02FNZM8.27.57.F02.1.454.CMB.1.raw
  modified_base (263)..(263): a, c, t, g, unknown or other
  misc_feature (263)..(263): n is a, c, g, or t
  modified_base (554)..(554): a, c, t, g, unknown or other
  misc_feature (554)..(554): n is a, c, g, or t
  modified_base (612)..(612): a, c, t, g, unknown or other
  misc_feature (612)..(612): n is a, c, g, or t
  modified_base (640)..(640): a, c, t, g, unknown or other
  misc_feature (640)..(640): n is a, c, g, or t
tcagagcgtcgtctcacgaccggtgctcgatttagctcgatatagttgggtttgaggtctcagagaggagccttagcccctggactccaaggcctttccacttggtgatcagcacggagcacagaggacccaccatggaactggggctgagctgggttttccttgttgcttattttagaaggtgtccagtgtgaggtgcaacgtggtggattctgggaggaggtgtggtccagccgtggagaactcccgtgagactctcctgngcacgcctcgtggacttctaaccgtttagtagtttagttggatagacgtcggtcgggtcccgaccaggacctccggaagggggaacgggcgtacgggaggtttccggtggacccaaacgaactaaaaaccgaagagttagggaaacgggtaaaaagaaaacgtagtaggtacggtactcgtgtagggaacgggcctagttccaaccgtatacctaccgaaggtaacgaccaaaccgacctaaagaacgtcctaactcgtactcgagtaactaaacgacgaacgacgtacgnggacgacggaccgacgggaactaccggacgttagtactacttacggtgcggacgaagnttaccgtagtacgttctaccgtttaccncgttttacgacttccgg

SEQ ID NO: 46484 - DNA, 733 bp, Homo sapiens
  misc_feature: GYAE6OF02H5OW4.27.57.F02.1.454.CMB.1.raw
  modified_base (211)..(211): a, c, t, g, unknown or other
  misc_feature (211)..(211): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcngggaggaggtgtggtccagcctggagaactcctggagactctcctgtgcacgcctcgtgattcctaccgtttaagtagttagttggagtagaggtcgttcggggccgtaccgacgtaccgtaccggaaggggacggggtcggtaggtacgggttcggtacgggaccctaaacgaaacgtaaaaccgaaagtacggttaaaggggaaacgggtaaaaacgtaaaaacgttagtaacgggtacggtaccttacgtacgggtacgggaaacggggccgttaacgttaccgaaccgtacctacccgtacgtaaacggaacgaaccgtaaacgaacccgaaagaaccggttacacgttaacgtactgtacgaactaaagtacgaacgaccggtacagaacggacgaccggaacgaccgacggtcctaagttaacgtaccgttaacggtcggacggaccggaacggtaacgtacttacccggttgtacctacgtttacccgtttacgtttttacgaccgtttaccggg

SEQ ID NO: 46485 - DNA, 567 bp, Homo sapiens
  misc_feature: GYAE6OF02FXNC7.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggattgagcgtgggtccgccagacctccgaggggaaggggctgggagttcggtggccaacataaaccaagagtagggaaggtaaaagaaaactagtaggtggactctggtaggaaggggccgattcaccatcctaccagagacaacgccaaagacgtcaacttgtactctagacaaatgaacagcctgagacgccgaggacacgggctagtactactacgtggtacgacgaagacgacttccgtaaggtcctaactttccggtctttttaggacttccgg

SEQ ID NO: 46486 - DNA, 995 bp, Homo sapiens
  misc_feature: GYAE6OF02FI2T0.27.57.F02.1.454.CMB.1.raw
  modified_base (268)..(268): a, c, t, g, unknown or other
  misc_feature (268)..(268): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggttttccttgttgctattttagaggtgtccagtgtgaggtgcaacgtggtggattcgtgggaggaggtgtggtccagccgtgggaagaacttcccgtgacgactcctcctggtcncacgtccttcgtggtacttcctaaccgtttaggtacgtttagttcggaattcgaaggtccgttacggggtccgaccgtagtacccgttaccggaagggggggtaaaccggggtcggttaaggggttaacggttttcccgggttacgggaacccctaaaaacgtaaccggttaaaaaacccgaagggtaacggttaacgggggtaaaacgggttaaaaaaaccgtaaaaaaccgtttacggttaacggggttaacgggtaacccctttacggtttagggggttaaacgggtaaaccgggggggtacccttaaagttttacccccgaaaccggtttacgttccccggttaaaaccccggaaggggaaaaccccgtaacccgtaaaaccccgggtaacgtaaaaaggggttaaacccgtaccgtaaacccggttttaaggttaaccgttttaaaaccggtccgggttaaaaccaaaagggttttaaacccgggaaaaccccgtaacgggttaccccggttaaacgggggaacggttaaaaccccggggaccccggggtaaaagtaacccccgggtaaacgggttcccgtttaacggttttaaaacccggttaccttaacgggtttttccggggacggaaccgggttaaaacggtacgttaaccggttaccgtttaacggtacccttaccgggttttacccgtcgttttttaggacccgttttacccgggg

SEQ ID NO: 46487 - DNA, 728 bp, Homo sapiens
  misc_feature: GYAE6OF02GXF4W.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctattttagaaggtgtccagtgtgaggtgcaactggtggattctggaggaggtgtggtccagcctggagaatccctgagactctcctgtgtcagcctctggattcacctttagtacgttagttggattggagcgtggggtcccgccaggactccggaggggtaacggggctgggacggttcgtacggacccaaacgtaataaaacccaaggtacgtaggggaaagggttaaaaacgaaaaaccgttagtacggttaggaaccttacgtaggttaacggaaacgggggtcccttaagtttacccgaacccgtaattaccgttaccccgaaggaacgtaaccgaaacccggtaaccaaaaggtaaccggtaccaaacggttacgttaacttacgttacgtaaaccgtaaagttaacgaaacgtaacggtacccgtaggaaacggtacggaaccgggtaaacggaaccggaacggtacgttaacgtacgttaccgtacgtgggtacggacgtaacggaagtacgttaccgtaagttcgtacttaccggttcgttttagaccttcgg

SEQ ID NO: 46488 - DNA, 836 bp, Homo sapiens
  misc_feature: GYAE6OF02JQ2OR.27.57.F02.1.454.CMB.1.raw
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (284)..(284): a, c, t, g, unknown or other
  misc_feature (284)..(284): n is a, c, g, or t
  modified_base (499)..(499): a, c, t, g, unknown or other
  misc_feature (499)..(499): n is a, c, g, or t
  modified_base (755)..(755): a, c, t, g, unknown or other
  misc_feature (755)..(755): n is a, c, g, or t
tcagagcgtcgtctcacgaccggtgctcgatttagctcgatatagttgggtttcgaggtcgtcagagagggaggccttagccctgggactccaaggcctttccacttggtgatcaggcacggagcacagaggacccaccatcggaactggggctgagctgggtttccttgtgcgtattttagaggtctcctagtgtgtagtgctactggtggattctggaggnggtgtggtccngtccgtggacgtaatcccctagacgtactctcctgtcgactgtcccgttntaggtacttcctacctttaggttaggtttagttcggagttacgtacggtccggtacggtcccggtcgacgtaccttcgaaggggtaacggggtccttaggggtacgtttcggtacggacctaagtaactaaaaccggagtacgtaaggaaacggtaaacgtaaacgtttagacggtcggaaccgttgtacgggttaacgggaccggtaaaccgtntttaaccaaccggtcgttaaccccgttacggaaacggaaccgttaaccccgaaaaggtcccggaaacgttaaaccgggttcacccggttaaaggttacccgtttacgaacgttaaaaccgaaaagttcccggaaaccgtaaccggtcccggtaagttccggaaacccggaacccgttaggggaaccccgtaaggtccctttaaagggttaccccaacgtttacccggttggacccggggtaaataacccggggttnaaccccgtaccgggtttaaactaccggtttaaacccgggtttccctttaaccgggggttttacccaaggggggttaacccg

SEQ ID NO: 46489 - DNA, 607 bp, Homo sapiens
  misc_feature: GYAE6OF02I9P9D.27.57.F02.1.454.CMB.1.raw
  modified_base (302)..(302): a, c, t, g, unknown or other
  misc_feature (302)..(302): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (483)..(483): a, c, t, g, unknown or other
  misc_feature (483)..(483): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaggtgtccagtgtgaggtgcaactggtggattctggaggaggtgtggtccagcctggagaatccctgagactctcctgtgcagcctctggattcacctttagtagttattggatgagcgtgggtccncagactccgaggggagggctgggagttcgnggccaanataaaccgaagagtagggaaggtaaagaaaactagtacgtaggtactacgtggtaggaacgggccgtattcacctatcctaccagagaaccaacgaccaaagtaacggtcaagttgtaactcgtacgaactaaatacggaaacngtacctaggaacgtacggaccggaagggaacccgacggtaccgtaggtaactaccgttacgtacggtgaccgaaggagtacttaccgtagtaccgttacgttaccgttcttttacgacgttccg

SEQ ID NO: 46490 - DNA, 865 bp, Homo sapiens
  misc_feature: GYAE6OF02JTLQO.27.57.F02.1.454.CMB.1.raw
  modified_base (179)..(179): a, c, t, g, unknown or other
  misc_feature (179)..(179): n is a, c, g, or t
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgtgctatttagaggtntcagtgtgaggtgcaactgggtgattcngggaggnggtgtcggtccagtcctgggaagaacgtccctggagtaccttctcccgtgtcgacncgtcctcgtggtaatttccaacctttaggttagttagttgggtatggaggtccggttcgggtcccgaccaacgtaccggtaccggaagggggtaacgggggtcgtagggttaaccgggttccgggttaccggaccccgtaaaaccgtaaacgttaaaaacccgaagggtaaggtaacggggtaaaacgggtaaaaaccgttaaaaacgtttaaacggttcgggtaacggttaaccgtacgttaacggggtaaggggtaaaccgggtaccggttaacttacccgttaaacccgaccgtttaccctaaacccgggaacgtaaaaccggtaaccgaaacccgggaacctaaaaaggggtacccttaaggtaaccccgttagtttaacgttaccgtaacccgttaaactaaacgtaaacgtaaaccgtacggtaacccgtaaggtaacccgggacgaaacccggtagggaaacccgtaccgggaccgttaacgttaaacccgtacgttaccgttggtaacgggacccgtaaggtaaccgttacccgtaacccttaggtccttaaccggtttcccgtttcggtttaccgtacgtaccggg

SEQ ID NO: 46491 - DNA, 671 bp, Homo sapiens
  misc_feature: GYAE6OF02IEG14.27.57.F02.1.454.CMB.1.raw
  modified_base (541)..(541): a, c, t, g, unknown or other
  misc_feature (541)..(541): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtcagtgtgaggtgacaatggtggattcgtgggaggaggtgtggtcagccgtggaagaatccctgagacctctcctgtgcagcctcgtggtattcctaaccgtttagtagttagttaggatgagtcgtcgggtcccaccgtagacctaccggaaggggaacgggtcgtgggtacgtttcggacggacctaaaacgaactaaaaccgaaggtaagtaggggtaaaggtaaaaagtaaaacgtttgtaaggtacggtacttacgtaggtagggaacggtaccgtagttacccaacgtactacctacgaagtaacgaaccgaaccgtaacgaaacgtaagtacctacgttattaactcgtanacgaaaatggaaacctcgtaccgtagggacgtacggcccgaaggtacccgacggtactacgtaactacttgtcgagacgtagacgtacgttaccgtagtaccttcgttacccttgtttacgtacttccgg

SEQ ID NO: 46492 - DNA, 780 bp, Homo sapiens
  misc_feature: GYAE6OF02FH7I2.27.57.F02.1.454.CMB.1.raw
  modified_base (310)..(310): a, c, t, g, unknown or other
  misc_feature (310)..(310): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctatttagaaggtgtccagtgtgaggtgcaactggtggattcgtggaggaggtgtcggtccagcctggagactccctgagactctcctgtcgcagcctgtggattcctaacctttagtagttagttggatgagtcgtgggtccnccagtacctaccgaggggacgggtctgggtacgtttcggacggtacccaaacgaacgtaaaacccaaggtacgtaggggaaacggttaaaaacgtaaaaacctgttaggtacggaaccttcgttagggtacgggaacgggtcccgtaattacccgaacccgtatacccttacggaaacggtaaccgggaaaccctaaacccgggaaccctaaaagggtaacccgttaccaaaccgttttaacggtaaccgtttaccggtaagaacccgttaaaaagttccgggaaaaccgttacggtacccgttaaggaaccgggaacgggtaacccgggaacggggaacctaccggggtacttacggtaaaccgttaccctacggtgggttaacggacggtaacggtaacgttaccgttaacccgtacggttcccttaaccgttttcccggtttactttttacggaccgtttacccggg

SEQ ID NO: 46493 - DNA, 780 bp, Homo sapiens
  misc_feature: GYAE6OF02FJEBZ.27.57.F02.1.454.CMB.1.raw
  modified_base (322)..(322): a, c, t, g, unknown or other
  misc_feature (322)..(322): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttaattttagaaggttgtccagtgtgaggtgcaactggtggatttctgggaggaggtgtggtccagcctggagaactccgtagagactctcctgtgcagcctcgtggtattctaccgtttagtagttagttggataggacgtcgtcggggtccnccgagacctccggaagggggaaggggtctagggacggtttcggacggtaccaaacgtactaaaaccgaaggtaagtacggggaaagggtaaaaagtaaaactaggttaggtaggtaacgttccgttaggtaaccgggaacggggtaccgtaagtttacccgaaccctacgtaccttaccgaacggtaaccgaacccgtaaacccggaaccgtaaaacggtaaacggtacctaaacgttagtaacttaccgttacaacgttaaacgtacggaaaacctacggtaccgtacgggaacgtaccgggaccgggaaacgggtaacccgaccgggttacttaacgttaaccgtttaacgttacgttaggggtaccgacggaaggttaacggtcccgtttaaccgttacgggttaacctttaccgtttaccccggtttacttttttacgggaccttttacccggg

SEQ ID NO: 46494 - DNA, 985 bp, Homo sapiens
  misc_feature: GYAE6OF02IT8Y0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctatttagaggtgtccagtgtgaggtgcaacgtggtggattcgtggaggtaggtggtcggtccaggtccgtagggaacgtaacttccccgtggacgaccttcctaccgttggtcggccgtacgtcccgttcgtacgggtactttaccgtaacccgttttaaggttaacggttttaagtttacggggaactttaggtaacggttacccggttacggggggtaccccgtaccgtaaccggtacccgttacccgggaagggggggtaaacgggggtccgttagggggtaacggttttacccgggtacggggtaacccctaaaacggtaaacgttaaaaaccccgaaaggttaacggtaacggggtaaaaacgggttaaaaacggtaaaaaacgtttacggttagggttaacggtaaccgtttacggttagggttaaccggggaaaccggggtacccgtaacgtttcccgaaacccgttaacctttacccgtaacccgaaacgggtaaccggtaaacccgtaaaaccggtaccccgaaaaagggttaaccggtacccgtaaacggtttacgttaaccttacggttaaccgaacgtaaaacgttacggaaacgtaccgggttacccttaaggggaaccgtaaccggaacccgggtaaacgggaacccgtaacccggggttaacttacgggtttaaaccgttaccgttaccggttacggtaccgggtaaaccggtaagggttaacccgtaaccgtttaccgttaacggtttacccgttaaccgtttttcccgggttactttttttacggacccgttttaacccggg

SEQ ID NO: 46495 - DNA, 702 bp, Homo sapiens
  misc_feature: GYAE6OF02HEVRX.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctattttagaggtgtccagtgtgaggtgcaacgtggtggattctgggaggaggtgtggtccagcctaggagaactccctgagactctccgtgtcgcacgcctcgtggattcctacctttagtagtttagttaggatggacgtcgttcgggtcccacgacgaccgtccggaagggggaacggggcttagggtaggtttcgtacgggacctaaacgtaactaaaaccgaagtagtacggggaaagtaaaacgtaaaacgtgtaggtacggtactcgtaggtacggaaacgggtcctaacttccgaaccgtacttacctacgaacggaacgaaaccgtaaccgaaccgtaaaggtaactacgtaacgttactttaacgtccgtacggtaactaaaacgtacgaaacgtacggtaccggtagaacggtaccggaacggaacggtacgacggtacttacgtaacctaaccgttgtacggtacggacggtaagacgttaccgtacccttagtaccttacgttccgtttacttttgacttccgg

SEQ ID NO: 46496 - DNA, 578 bp, Homo sapiens
  misc_feature: GYAE6OF02FS6N4.27.57.F02.1.454.CMB.1.raw
  modified_base (266)..(266): a, c, t, g, unknown or other
  misc_feature (266)..(266): n is a, c, g, or t
  modified_base (371)..(371): a, c, t, g, unknown or other
  misc_feature (371)..(371): n is a, c, g, or t
  modified_base (534)..(534): a, c, t, g, unknown or other
  misc_feature (534)..(534): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtgtggtccagcctggagaactccctgagactctcctgtgcagcctntggattctacctttagtagttattggatgagcgtgggtccgccagacctcggagggaggggctggagttcgtggaccaacaataaaccagagtggaaaggtaaanaaaacgtataggtagtactcgtagtagggacggccgaattccaactctcctaccgaaggacgaacgaacgccaaaggacgtcaacttagtactcgtgaacaatcgaacacgctaggagtacgaccggagacgacggctagtacctacgtactggagacgaganacttacgtaggtacctagtttcccgtcgttttagacctttccgg

SEQ ID NO: 46497 - DNA, 746 bp, Homo sapiens
  misc_feature: GYAE6OF02G6W83.27.57.F02.1.454.CMB.1.raw
  modified_base (168)..(168): a, c, t, g, unknown or other
  misc_feature (168)..(168): n is a, c, g, or t
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (326)..(326): a, c, t, g, unknown or other
  misc_feature (326)..(326): n is a, c, g, or t
  modified_base (663)..(663): a, c, t, g, unknown or other
  misc_feature (663)..(663): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctggagtcgttggtttcttgtgtnttagtttagagtgtacagtgtgagtnacagtggtgtattgnggaggngtgtcgcngcgtagganactccngacgtctctcgtgtcgacgtctccgtcgtggtactttacctaccgtttagttagtttagtggtattacggagtcggtcgggttacccnccgacgtccggtaccggagggggtacgggtgttgggtcggttcggcggtaaccaaataaccgtaaacgaaggtacgtaaagggtaaagtaaaacgtaaagttcgaggtacgtacgttagtacggaagggacggtacctacgttaccaacgttcgtaccctaaggacggtaacgaaccgaacccggtaacgaaagtaccgttacgtaacgttagttaccgtacgtaaccggaaacttaaaggtacccggaaaactcccgggtaacgtacggggaacgaacccgggtacgaaacggggaacccggttccgtaacgttacgtttaacctacgtttaacgnggtaccggaaaccgaggttaaacgttaccgtaccgttaccgtacgtttcccggtttacgtttacgtttacgccgtttaccggg

SEQ ID NO: 46498 - DNA, 720 bp, Homo sapiens
  misc_feature: GYAE6OF02FW5H4.27.57.F02.1.454.CMB.1.raw
  modified_base (581)..(581): a, c, t, g, unknown or other
  misc_feature (581)..(581): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctggtttccttgttgctattttagaggtcgtccagtgtgaggtgcaacgtggtggattctgggaggaggtgtggtccgagccgtggacgaactcccgtgacgtactcgtcctgtgcagtccttcgtggtacttaccgtaccgtttagtaacgtttacgttggattacgagtcgttcgggtcccgccgacggtacctccggaaggggaacggggtcgtacgggtacgtttccggcggaccaaacgtaacgtaaaacccgaagtaacgtagggaaacggttaaaacgaaaacggttagtacggtacggtaaccttcgtaggtaccggaaacgggtccctagttaccaacctaagtcccgtaacgaagtaacgaaccaaccgaccgaaaaggacgtacctaacggttgtaacttcgtacgaacaaagtcgaaacgngtacctaggaacgtcggaaccgagaccgacggttcgtacgttaacgtcgtacgtcggtcggaacgtaagggtacgtaaccttaccggttacgttaaccggttacctttcccgggttactttttacgggactttaccggg

SEQ ID NO: 46499 - DNA, 664 bp, Homo sapiens
  misc_feature: GYAE6OF02I3TUO.27.57.F02.1.454.CMB.1.raw
  modified_base (315)..(315): a, c, t, g, unknown or other
  misc_feature (315)..(315): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggtttccttgtgctatttagaggtgtccagtgtgaggtgcaacgtggtggattcgtgggagggtaggtgtggtccagccgtaggagaactcctgacgacctctccgtgtcgcacgcctgtggacttctactttagtagtttatggatggagtcgtcgggtccncagcctcggaggggagggctgggacgttcggcgaccgaacaacgtaaaccgaaggtacgtaggggaaaggtaaaacgaaaattgtaggtacgtacgtgtaggtaggaaacgggctactccgaactcgtactaccgaagaacgaacgaaccgacgtaaaagtacgtaccaagttacgtactcgtagaactaaagtacgaaacgaccgtaccgtagaacggtaaccggaccggtaaggaccgaacggtcgtaacgttataaccgtcggttaggtcggaacgggagtaaccggtcgttaccggttaacgaccgttacgtttccccggttaaggtttttcgacgtttaccggg

SEQ ID NO: 46500 - DNA, 531 bp, Homo sapiens
  misc_feature: GYAE6OF02GSZGW.27.57.F02.1.454.CMB.1.raw
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattccacctttagtagttattggatgagctggggtccgccgagacctcccgaggggaaggggctgggagttcggtcggcccaacataaaccaagataggaagtaaagaaactangtgatctgtgaggcatcacatcncagagacanccaagatcactgtatctgactaatagaacagcctgagagccgagacgacggctaggtactacgtactgtaggcgaaggagtactccgtaagttctacttccggtacttttgacttcgg

SEQ ID NO: 46501 - DNA, 759 bp, Homo sapiens
  misc_feature: GYAE6OF02FMH7J.27.57.F02.1.454.CMB.1.raw
  modified_base (325)..(325): a, c, t, g, unknown or other
  misc_feature (325)..(325): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtgtccagtgtgaggtgcaacgtggtggattcgtgggaggaggtgtggtccagcctggagaactcccgtgagacctctcctgtgcagccctgtggtattcctaccgtttaagtagtttagttggatggacgtcgtcggggtcccncgagtacctaccggaggggaacgggtcgtggtacggttcggcggtacccaaacgtaacgtaaaaccgagtaagttacgggaaacggttaaaaacgtaaaacttagtacggttaggtaaccttacgttaggtaacgggtaaacgggggtccctaagtttacccgaacccgttactacccgttaccggaaggtaaccgaaacccgaaaccgtaccgaaaacggtaacgtaccctaacgttacggtaacttaccggtacgaaacgtaaacgtaaccggaaaccgtacggtacccgtaagggaacggtacggtaacccgggaacggtaacccggacggttaccttaggtaacttaccgtacgtaggttaccgacggtaagacgttacttaccggtacgttaccgtaccgtttccggtcgttttagccgtttaaccggg

SEQ ID NO: 46502 - DNA, 594 bp, Homo sapiens
  misc_feature: GYAE6OF02F1JG9.27.57.F02.1.454.CMB.1.raw
  modified_base (304)..(304): a, c, t, g, unknown or other
  misc_feature (304)..(304): n is a, c, g, or t
  modified_base (334)..(334): a, c, t, g, unknown or other
  misc_feature (334)..(334): n is a, c, g, or t
  modified_base (373)..(373): a, c, t, g, unknown or other
  misc_feature (373)..(373): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctggaggaggtgtggtccagcctggagaatccctgagactctcctgtgcagcctctgggattcacctttagtacgttattggatgagctgggtccncagactccgagggaagggctgggagttcgnggccaacataaaccaagactgggaaggtaaagaaaactntagtggactctaggtgaagggccattcacagtctacagagacaacgacaagagtcactgtactcgtacgacaaatacgaactacgcctagagacggaccgaggaccacgggtactagggttaataccgtacgttacggtcggtacggtacggaacgttaacgttacccgttaacggttacctaccgtttccccggtacgttttttacgacgttttacccgg

SEQ ID NO: 46503 - DNA, 653 bp, Homo sapiens
  misc_feature: GYAE6OF02FJYDB.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctgggaggaggtgtggtccagccgtggagaactcctgagactcctcctgtgcagcctctggattcctaccgttttagtagttattggatggagtcgtgggtccgccagactccgaagggaaggggctgggagtttcggtcgggaccaactaactaaaaccgaaggtagtaggaaacggtaaaacgtaaaaactagtagtaggtaactcgttagagggaacggtccgtaattccgaaccgtatacctacgaacgtaacgaacccgaaacgaccgtaaagaaacgtacctacttaggtaattcgttaacgacgtaaaatacggaaactacgtaccgtagaacggtaaccggacgggaacgtaccgaacggtagttacgtaacttaccgtaatcggtaggacgaaggtagacttacgtcgtacttacgttacctgttttgacttccgg

SEQ ID NO: 46504 - DNA, 589 bp, Homo sapiens
  misc_feature: GYAE6OF02HHPC7.27.57.F02.1.454.CMB.1.raw
  modified_base (393)..(393): a, c, t, g, unknown or other
  misc_feature (393)..(393): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcactggtggattcgtggaggaggtgtggtccagcctggagaatccctgacgactcctcctgtgcagcctctggattccacctttagtagttattggatgagcgtgggtccgcagacctccgaggggaaggggcttgggattcggtcggaccgaacataaaaccgaagagtagggaagtaaaagaaaaacgtagtacgnggactcctggtacggaagggccgtagttccaccacgtctaccgagacgaaccaacgaccaaagaagtaccagttagtatacngtaacaaatgaanacgcctgacgtcgacggagacgacggctagtactacttacgtgtcggacgtacggacgtactccttacgtactagtttccgtacgttttcggaatttccgg

SEQ ID NO: 46505 - DNA, 738 bp, Homo sapiens
  misc_feature: GYAE6OF02IBB15.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacagaggacccacatggaactggggctgagcgttgggttttccttgttgctatttttagaaggtgtccagtgtgaggtgcaactggtggattcgtgggaggaggtgtggtccagcctggagaatccctgagacctctcctgtgcagccttcgtggattcctacctttagttagttattggataggagtccgttcgggcccgcagaccgtcggaaggggaggggcttgggacgttcggtcggaccaacaactaaaaccgaagtagttacggttaaaggaaaaagtaaaacgtagtagggtacggtacttacgtaggttaggggaaacgggtccgtaagtttacccgaacctacgtccgttaacccaacggtaacgaaccgtaaaccgacccgaaaacgtaaacgttacctaacgttacgttaactacgttacgaactaaagtaacggaacgtaaccggtaccgttagaaacggaccggaacccggaaaggtaacccgtaccggacgttaacggttaacttaaccgttaacgttacggtagaacggaacggtaacgtaaccgtaccgtttaacgttaccgtaaccgttttacccggttcgtttttaccgacgttacccgg

SEQ ID NO: 46506 - DNA, 697 bp, Homo sapiens
  misc_feature: GYAE6OF02GPJRC.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctggaggaggtgtggtccagcctggagtaactccctgagactctcctgtgcagcctcgtggattcctacctttagtagttattggatggagtcgtgggtccgcagacgtccgaaggggagggtctgggtacgttcggtgggaccaacgaacgtaaaaccgaagatagggaaaggtaaaagaaaaacttagtagtacggtaactcgtaggtaacggaacggggcctaagttaccgaaccctattccgtaccgtaagaccggaaaccaaccgggaccctaaaggtaacgaccgtaacctagttaactcggtacaacgtaaaatcggaaacgagacccgttaggaaacggaccggtaccgggaacgtaccgaaaccgggtcttaagtaacttaaccgttactacgggtacggttaacggaacggtaacgtcgttaacccgttagttacgttaccgttttacccggttacgttttagtaccgttacccggg

SEQ ID NO: 46507 - DNA, 842 bp, Homo sapiens
  misc_feature: GYAE6OF02IWXVV.27.57.F02.1.454.CMB.1.raw
  modified_base (183)..(183): a, c, t, g, unknown or other
  misc_feature (183)..(183): n is a, c, g, or t
  modified_base (681)..(681): a, c, t, g, unknown or other
  misc_feature (681)..(681): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctggagcgttgggttttcctgttgcttattttagaggtntccagtgtgaggtgcaacgtggtgattcgtgggaggtaggtgtcggtccagcctggagtaactcccgtgacgacctcctcgtgtcgcagcctcgtggtacttcctactttagtagttagttggactgagtcggtacgggtcccacgtagaccgtaccggaagggggtacgggtcgtagggtacgttccggtcggaaccctaaacgtaaacgtaaaacccggaaggtacggtaagggtaaaacgggtaaaaaacgtaaaacgtttaggttacggtaacggggttaaccttacggtttagggtaaaccggggtaaaccgggggtacccttttaacgttaaccccgtaaacccgtaaccgtttacccgaaaccccggtaaagggtaaacccggaaaccccgtaaaacggaaacccgtaaaaggttaaacccgtacccggttaaacgttaacgttaaccgtcgttaaacggtaaacccgttaaaagtaacccggtaaaaccnccggtaaccgttaaggaaaccgggaccggaaccgggaaacgggtaaccgaccgggttactaagggttaaccaccgtttacggtacggtacgaacggtaacggaacttaccgttaccggtacttacgtttaccgttaccgttcgttttacgaccgttaccgg

SEQ ID NO: 46508 - DNA, 836 bp, Homo sapiens
  misc_feature: GYAE6OF02HKPG6.27.57.F02.1.454.CMB.1.raw
  modified_base (211)..(211): a, c, t, g, unknown or other
  misc_feature (211)..(211): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctggttttcctgttgctattttagaaggtgtccagtgtagaggtgctaactggtggattcgnggaggaggtgtggtccagtccgtggacgaactcccgtgacgtactcgtccgtaggtgactacgtccttcgtaggtacttaccttaccgtttaggtaacgttagttacggacttaggacgtcggttcgggacccgtaccgaacggtaccgttaccgggaagggggtacgggtaccttagggtaacggtttcgggtacgtaaccccgaaacgtaaccgtaaaaccgaggtacggtaagggtaaaggttaaaaaccggtaacgtttaagtccgggtaaacggtcgttaacggtttacgggaacgggtaaaccgggtaccgtaacgtttacccggaacctaccggttaccttacccgggaaagttaaaccgggaaaccgtaaacccgttaacgggaaaacgtacgggttaaccctaacggtttacggtttaactaccgtaccgttaaacgtaaacgtaccggtaaaccaccgggttaacttagggaccggtaacggtccgtaaaggggaaccccgttaagggtacccttaagggttaccttaaccgtacggttggaacggacggttaagaacgttccgtaacgttacgttcctacgtttaccccggtttagtttacgactttcccgggg

SEQ ID NO: 46509 - DNA, 709 bp, Homo sapiens
  misc_feature: GYAE6OF02HPV8G.27.57.F02.1.454.CMB.1.raw
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
  modified_base (544)..(544): a, c, t, g, unknown or other
  misc_feature (544)..(544): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctggagctgggttttcctgttgctatttagaggtgtccagtgtgaggtgcaactggtggattcgtggaggtaggtgtggtccagcctggagaactccctgagtacctctcccgtgngcacncctcgtggtattccacctttagagtttagttggatgagtcgtacgggtccncagctccggaaggggagggtctggacgttcggtcggacccaataacaaacgaaggacgtaggggaaacggtaaaacgtaaaacgttaggttaggtaacggtacttaccgtaggtaacgggacggggtacctacgtttacccgaaccttagttccctaccggaagaaccaaccgtaaaccgacctaaagggactaccgaacctttggtactacgttgaaacgttaaanacgggtaaaccacgtcccgtttaggaacggaccggtaacccgggaaggtaacccggacggtacgttacgtaaacctacggttacgtccgggtaacggcggtaagacgttaccccgtaacttaggtcccgtattttcccccggtttatttcccgagtttacccggg

SEQ ID NO: 46510 - DNA, 815 bp, Homo sapiens
  misc_feature: GYAE6OF02JLQVS.27.57.F02.1.454.CMB.1.raw
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
tcagagcgtcgtctcacgaccggtgctcgatttagctcgatatagttgggtttgaggtctcagagaggagccttagccctggactccaaggcctttccacttggtgatcagcacggagcacagagacccacatggaactgggctgagcgtggtttcctgtagctatttagaggtctcagtgtgagtgcacgtggtagattcgnggaggaggtcgtggtccagcctaggagaactcccgagacgacctctcctggtcgacacgcctcgtaggtaccttacctaccgttttagtagttacgttagggnttaccgagttccgtggggtacctccaggtacctccggagggggtaacgggcttaggggaacgtttcggacggaccccaaagtactaaaaacccgagtaggtaaccgggtaaaggtaaaaaacctaaagtacgtgtaaccggtaacttccgttaggaaggtaacccgggntaacgttacaaccgtnttaccgtaacgaccggaacgtaaccaaccgaccgggaaaataaccgtttccgtaaacggttcgtttaaacttacccgtggaaaacttttaaacccggagaaaaacccgttccggttaaccggaaacggttaaaccggggtccggtaaaccggtaacccggacgggttttaaacccggcgttaaccgggtttaaaccggtttaccctttaccggagggttaacccggtaacttaaccggggactttaacccggtttcccgtaacgttaacccctttaaccggggttttcccttttaaacggttacccgtttccccgggtaaacgg

SEQ ID NO: 46511 - DNA, 690 bp, Homo sapiens
  misc_feature: GYAE6OF02IUYBG.27.57.F02.1.454.CMB.1.raw
  modified_base (196)..(196): a, c, t, g, unknown or other
  misc_feature (196)..(196): n is a, c, g, or t
  modified_base (275)..(275): a, c, t, g, unknown or other
  misc_feature (275)..(275): n is a, c, g, or t
  modified_base (337)..(337): a, c, t, g, unknown or other
  misc_feature (337)..(337): n is a, c, g, or t
  modified_base (557)..(557): a, c, t, g, unknown or other
  misc_feature (557)..(557): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactggggctgagctgggttttcttgttgctattttaggaagtgtccagttgtgaggcncaacgtgggtggtattcgtggagggtaggtgtgggtccaggcccgttaggagtaactcccgtgacgtctcctctgtgcncgcctctggtacttcctacctttagttagttagttaggtagtagtaggcgttcggggtcccncgtacgaccgtaccggaagggggaaggggtcggtagggtacggttcggtcggaccaaacaactaaaccaaggtaggtaggggtaaaggttaaaacgtaaaaactgttacgtaggtactcgtggtacgggacggtaccgtacgttaccacctctccgttacaggtacaaccgaaccgaacgaaggtaacgacctacggttatactctagaactaaacgtanaaccgagttcccaaggacgtaccggacggacgaaccggagtaccgtagtaaccgttacgttacgtcggtcggaagtacgaacgttacgtaccgtacgtaccgttaccgttcctttagtttcgtcgttaccggg

SEQ ID NO: 46512 - DNA, 583 bp, Homo sapiens
  misc_feature: GYAE6OF02IVJOH.27.57.F02.1.454.CMB.1.raw
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
  modified_base (430)..(430): a, c, t, g, unknown or other
  misc_feature (430)..(430): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaaggtgtcagtgtgaggtgcaactggtggattcgtgggaggagtgtggtccagccgtggagactccctgagactctctgncagcctcgtgattctactttagtagttatggatgagcgtcgggtccncgagaccgtccggaaggggagggctggtcgttcggacggaccaaactaactaaaccgaagacgtagggaaaggtaaagtaaaactagtgtaggtaactgtaggtaggaacggccgtaatccgaacctntacctacgagaacgacaacgacaaagacgtacgacttagtactactgaacaatacgacacgcctagacgacgcggaagcgacgtgtatacgtactagtcgaaggacgagagtacctacgtacgtcttaaccgttccgttacgtttgactccgg

SEQ ID NO: 46513 - DNA, 720 bp, Homo sapiens
  misc_feature: GYAE6OF02ITT2X.27.57.F02.1.454.CMB.1.raw
  modified_base (188)..(188): a, c, t, g, unknown or other
  misc_feature (188)..(188): n is a, c, g, or t
  modified_base (260)..(260): a, c, t, g, unknown or other
  misc_feature (260)..(260): n is a, c, g, or t
  modified_base (429)..(429): a, c, t, g, unknown or other
  misc_feature (429)..(429): n is a, c, g, or t
tcagagcgtcgtctcacgaccggtgctcgatttagctcgatatagttgggtttgaggtctcagagaggagccttagccctggactccaaggcctttccacttggtgatcaggcacggagcacagaggacccaccatggaactggggctgagctggttttcttgttgctatttagaggtgtcagtgtgngtgcagtggtgattcgtggaggaggtgtggtccagccgtaggtagaactcccgtgacgtaccttctccgtgngcacgtcctcgtggtacttacctaccgtttagttagttagttggagtgtagcggttcgggccgacgagtaccgtacggaggggtacgggtcgttggtcggttcggacggtacccgaaagtaacgtaaacgaaggagtacgggtaaacggtaaaagtaaactagttaggnggttactgtaggtacgaacgggtcctaacgtaccgacttacgtaccaacgaggaacgtacaaacccgtaagaaacgttaccgtacgtacgttaagttctaccgtaagccttaaaagggtccaaaacggtccgaaccggtacgaaccggtaacggcccgggtaaaggtaccgggaccgttacggttacgttaaccgtaccttaggttacgggaagttccggtaacggtaacgtccgtaaccggttacgttaacccgttcgttttaacccttcggtttaacgccgtttccggg

SEQ ID NO: 46514 - DNA, 849 bp, Homo sapiens
  misc_feature: GYAE6OF02JC0TB.27.57.F02.1.454.CMB.1.raw
  modified_base (345)..(345): a, c, t, g, unknown or other
  misc_feature (345)..(345): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctggttttcctgttgctattttagaaggtgtccagtgtgaggtgcaactggtggattcgtgggaggaggtgtggtccagtcctggagaactccctgacgactcctcctgtcgaccgagtcccttcgtgggtactttcccgtaaccgttttaggtaaggttttattgggaagttggaggtccgtcgggggttccccnccgtaaggtaccctccgggaaggggggtaacggggtccttaggggtaacggtttcggtacgggaccctaaaacgtaaacgttaaaacccgaaggtacgttaaggggaaaacggttaaaaacgtaaaacgtttagtagggttaccggtaacttcggttagggtaacgggaacgggggtaccctaactttacccgaaacccgtagttacccctaacggaacgacgtaaacccgtaaacggaccctaaaaggtacgtcctaacgttcggtactttacgacggaaacttaaagtacccgtaaacgacggtaccctagggaaacgtacccgggacccgggaaaggtaccccggtaaccgggttacgttaacgtaaaccgttttaccgttacggttaccgggtacgtaaccgggaaaggtaaccgggttacctttaaccccgggtttagtttaacccgttacccggtttttaccggtttaccgttttttacggaccgttttaccccgggg

SEQ ID NO: 46515 - DNA, 642 bp, Homo sapiens
  misc_feature: GYAE6OF02FW8A2.27.57.F02.1.454.CMB.1.raw
  modified_base (196)..(196): a, c, t, g, unknown or other
  misc_feature (196)..(196): n is a, c, g, or t
  modified_base (401)..(401): a, c, t, g, unknown or other
  misc_feature (401)..(401): n is a, c, g, or t
  modified_base (510)..(510): a, c, t, g, unknown or other
  misc_feature (510)..(510): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtncaactggtggattctggaggaggtgtggtccagcctggagaatccctgagactctcctggtgcagcctcgtggacttccaccgtttagtagtttattagggatggagtcgtgggtcccgcctaaggcctaccggaggggaacggggtctagggtacgtttcggtggaccaacactaaaaccgagaacgtgggaaacgggtaaaanaaaaccgttgtggtacggacttcgtaggtacggaagggtaccgtattaccgacctaatcctaccgaagtacgaacaacgaccaaagtacgtacacgttcgacttacgtnaacgaatcgtaaacgacgactacgagacgtaccgaaggaccgacggtcgtacgtacttacggtacctggttacgcggtaaggacgtacttaccgtcgtactacgttcccgttacgttttacgacgtttccgg

SEQ ID NO: 46516 - DNA, 824 bp, Homo sapiens
  misc_feature: GYAE6OF02GN1QT.27.57.F02.1.454.CMB.1.raw
tcagagcgtcgtctcacgaccggtgctcgatttagctcgatatagttgggtttgacggtctcagagaggagccttagccctggacgtccaaggcctttccacttggtgatcaacacggagcacagaggacccaccatggaacgtgggctgagcgttgggttttccttgttgacttattttagaaggtgtccagtgtgaggtgcaactggtgattcgtggaggaggtgtcggtccagcctggaagtactcccgtgacgacctctcctggtcgcacgccttcgtggtactttcctaaccgtttttagtagtttagttggatggtagtcgttcgggtcccgactagtaccgtaccggaaggggacgggtcttaggggtacgttcggtacggaccctaaacgaacgtaaaaccgaaggtacgtaagggtaaaggttaaaaacgaaaacgtttagtacggtacggtaaccttgttaggtacgggaaaccgggtccgttaacgttacccgaacccgtagttacccgtaacccgaaaggaaccgtaaaccgaaacgaacccgtaaaaggtaaccgtaaccctaacgttacgttaactaccgttaacgaaaccgtaaaactaccggtaaaaccgaccgttacccgtaagggaaccggtaaccggaaccccgggtaaacgggaaccgaaccgggttaccttaaagggttaaccttaaaccggttacgtagggttaccggaaaccggtaaggtaaaccgttacccgttaccgttaaggttaccctttacgtttccccggttttaagttttacccgacgtttacccgttccgggg

SEQ ID NO: 46517 - DNA, 689 bp, Homo sapiens
  misc_feature: GYAE6OF02HYRS0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctattttagaggtgtcagtgtgaggtgcaatggtgattctggaggaggtgtggtccagccgtggagaactcccgtgagactctcctgtcgcacgtcctcgtggtacttctacctttagtagttattggatggagtcgttgggtccgcgagtaccgtccggaagggggacgggtctagggtacgttcggtacggaccaaacgtaaacgtaaaaccgaaggtacgtaaggggaaaggtaaaaacgaaaacgtttgtacgggtacgtaacgttcgttaggtaagggtaaccggggtccgttaacgtttacccgaaccgttagttccccgtaaccggaaaggaaacccggtaaacgaaacccggtaaccaaaaagggtaccttacgaactttagggtaacttaccgtacggaactaaacggactaacgcgtaccgtagacgtaacgccggagaccgacggtctagtactacgtgtggcgaacgtagaactacgtaccgtattacgcctttcgtagtttcgacttacgg

SEQ ID NO: 46518 - DNA, 814 bp, Homo sapiens
  misc_feature: GYAE6OF02IUQA7.27.57.F02.1.454.CMB.1.raw
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgacaacgtgggtgattcgngggaggaggtgtgggtccagccgtggaanaactccctaggtaagacctctcctgtgacagtcctcgtggtattccgtaccgtttagtaagtttagttggtaactggtacgtccggtcggggtaccctaccgaacgtaccgtaccggaagggggtacggggcttacggggacgttcggtacgggacccaaacgtaactaaaccgaaaggtagtaagggtaaagtaaaaacgtaaaacgttagtagggtaacggtactacgttagggtaaggtaaccggggtaccgttacttaaccggaaccctaacttacccgtaccgaaaggtaccgaaacccgaaacggaacccgtaaaaggtaacctacgtaaccgttagtaacgttacgttaccgaaactaaagaacgtaaacccgacgtacccggtaacggaaacgttacccgggaacgggtaaaccgggaacccggtaacgggttcgtaaacgttaacgtttaacccgtaaggttaccgggtaacggaccggtaaaacggacgtacctttaacccggtacgtacccgtttaaccgtttcccgggtttaacctttttacggacgtttaccccgg

SEQ ID NO: 46519 - DNA, 896 bp, Homo sapiens
  misc_feature: GYAE6OF02I7RFF.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgcttatttagaggtgtccagtgtgaggtgcaacgtggtagattctgggaggaggtgtggtccagccgtggaacgtaactccccgtaggacgtaccttccgtcctaggtacgtccgacggtcccttcgtcgggtaacctttcctaacccgttttaaggttacggtttagttagggtatgtaacggtcggttcgggggttccccgaccgtaacggtacccgttaccgggaagggggggtaacggggtcccgttagggggtaacggttttcccgggtaacggtaccccgaaaactaaaccgttaaaaaccccggaaaggtaacggttaaacgggggaaaaacgggttaaaaaacggaaaaaaacctttaggttaaacggggttaacgggtaaacctttacgggtgggtaaacgggtaaacggggtcccgttaaagttacccgaaacccgttactttacccgtaccgaaagggtaaccgaaaccgaacccggtaaccaaaagggtaaccgtaccgtaacgttagttaccgtactagggaaacctaacgtaacgaaacggaacgtccgtaaggacgaccgggtaccggaaaccgggaccgtacccggttactacgggtttaaaccttacgttaaccggttcgggaccggtaacggtaacggtaaccggtaccgtttaacccgttacggttacctttaaccggtttcccgttaaccgttttagtacccgtttcccggg

SEQ ID NO: 46520 - DNA, 791 bp, Homo sapiens
  misc_feature: GYAE6OF02JUFZX.27.57.F02.1.454.CMB.1.raw
  modified_base (257)..(257): a, c, t, g, unknown or other
  misc_feature (257)..(257): n is a, c, g, or t
  modified_base (665)..(665): a, c, t, g, unknown or other
  misc_feature (665)..(665): n is a, c, g, or t
tcagagcgtcgtctcacgaccggtgctcgatttagctcgatatagttgggttgaggtctcagagaggagccttagccctggactccaaggcctttccacttggtgatcagcacggagcacagacggacccaccatggaacgtgggctgagcgttgggttttccttgttgcttattttagaaggtgtccagtgtggagtgctaacgtggtaggtattcgtggaggtaggtgtggtccagtccgtaggagtaactccgngacgctcgtcctagtcgactcggtcctcgtaggtacctttacctaacgtttaggtagtttagttggtagtgacgtcggttacgggtccctaccgacgtaccgtcggaagggggacgggtccgtagggtacgttcgggtaccgaccaaaacgtaacgtaaacaaggtacgtaaggtaaacggttaaaagtaaaacgtaggtaggtacggtacttaacggtaggtaacgggaaccgggtaccgttaactaccgtaaccgtacgtttacccaaccggaaacgaacggaaccctaaaccggtaaacgtaaacggttaacggtacccttaacgacgtttacgtacgtaacgaagtaaactaacggtactaacgtaacccgtaagggaaccgtaccgggaacgtaccggggtanaaccggttaaggtacgttaaccttaccgtacggttacggtccgggtaatacgggttaactaccgttacgggtttactaacggtttccccgttttacggttaccgtttttagggaaccctttcgggg

SEQ ID NO: 46521 - DNA, 736 bp, Homo sapiens
  misc_feature: GYAE6OF02JYT2M.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttggaggtgtccagtgtgaggtgcaactggtggattctggaggaggtgtggtccagcctggagtaactccctagagactctccgtgtgctagcctctggacttcgaccgtttaagtagttacgttaggataggagtcgtcggggtccgtaccgacgaccgtaccgaagggggaacggggtccgtagggtaacggttccggtacgggaaccctaaacgtaacgttaaaaacccgaagaagttacggggtaaaacggtaaaacggtaaaaacgttacgttaagggtacggtaactaccgtaggtaacgggaacgggtacccgtaagtttaccgaaccctacgttaccgtaaccgaaggtaccgaaacctaaaccggaacctaaaaggtacgtacccagttacgtaacgtctaacggactaaaagtactaaccgtagtacccgtagggaactacggacccgtaacggaaccgtacgggtactagggttacctaccgttgtacggtcggaacgtacgtataccgtacgtacgtacgtaccgtttacccggtattttcggattacccggg

SEQ ID NO: 46522 - DNA, 716 bp, Homo sapiens
  misc_feature: GYAE6OF02JQMQ4.27.57.F02.1.454.CMB.1.raw
  modified_base (610)..(610): a, c, t, g, unknown or other
  misc_feature (610)..(610): n is a, c, g, or t
  modified_base (649)..(649): a, c, t, g, unknown or other
  misc_feature (649)..(649): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggtttccttgttgctattttgaaggtgtccagtgtgaggtgcacgtggtggattcgtggaggaggtgtggtccagcctggagactccctgagactctccgtgtcgcagtccctgtggtacttaccacgtttaagtacgtttagttggtagtgtagcgttcgggcccgtccgacgtacgccgaagggggtaacgggtcgtagggtcggtttaccggtcggaaccctaaccgaaacgttaaaacccgaaggtacgtaaggggtaaacggtaaaacggtaaaacgttaggtacgtaggaccgttacgttagggtaaggaaccgggtaccgtagtttaccgaaccgtactaccgtaccgtaaaggaaccgtaacgaaaccggtaacccgaaaggaaccgtaccgttaacggttaacttacttaacgtcgtaaactaaaggtacgaacgtacgcgtagaacggngaccgaacggcaacgggtctaacgtacgtacgttaccgnggtcggtacgaaggtacgtaccgttacgtacgtccttaacgtttcccttagtttacgtcgttaccgg

SEQ ID NO: 46523 - DNA, 661 bp, Homo sapiens
  misc_feature: GYAE6OF02JTFXL.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacgagcacagaggacccacatggaactggggctgagctgggtttccttgtgctatttagaagtgtccagtgtgaggtgctaacgtggtgtattcgtgggaggagggtgtggtaccagccgtaggagaactccgtgagtcctcgtcctgcgtcacgtcctgtcggtacttctaccgtttaagtacgttagtggatgagtcggtggtccgtacgagtccgtacggaggggtacgggtctagggtacgtcggtacgacctaacgaactaaaccgagtagtaggtaaacggtaaagaaaacgtgtacggtcggtaacgtcgtaggtacgtacgggtacgtactacctaccgtacttccacgaacggtaaccgaaccgaacgaaccgtaaagaaccgtacgtaccgttagttaccttcgaacgacctaatacggaacgtacgtaccgtagacgtacgaccggtaacgaccgtaggtcctaagggtactacgtaacgtggaacgtacgacgtaagtacgttacctaggtctaccgttcgttcttcgtactaccgg

SEQ ID NO: 46524 - DNA, 694 bp, Homo sapiens
  misc_feature: GYAE6OF02HIX11.27.57.F02.1.454.CMB.1.raw
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
tcagagcgtcgtctcacgaccggtgctcgatttagctcgatatagttgggtttgaggtctcagagaggagccttagccctggacctccaaggcctttccacttggtgatcagcacggagcacagaggaccccacatggaactggggctgagcgtgggtttccttgttgctatttagaaggtctccagtgtcgngtagcagtggtgattcnggagngtgtgtccngctgagactcctgagtcctcttccgtgtacgcactccgtcgcgtattcctaaccgtttgtagttattggactgngtcgtcggtccncganactcgtagggaacggcgtagtcggtcggttaccgacgtaaccgaataaacccaggtataggggtaaaccggaaaataaaccgtagttcggaagttccacgttaggtaaggaaccgggttcctaaacgttccgaacctacgtacgtaccggaacgtacgaaaccaacccggaacggaaactaacggttcgaaaccgttcgtacgttcaacgtaacgtactacgaacgttaacccgtagaacgacgggaaaccgccggtaagaaaccgggtctaacgtacggtaactacccgttaaacggtttcggaacggttacggacgtaacggtaaccttacgttaccggacctttaccggttaccttacgttttacgaccctttacgg

SEQ ID NO: 46525 - DNA, 754 bp, Homo sapiens
  misc_feature: GYAE6OF02HL96R.27.57.F02.1.454.CMB.1.raw
  modified_base (239)..(239): a, c, t, g, unknown or other
  misc_feature (239)..(239): n is a, c, g, or t
  modified_base (595)..(595): a, c, t, g, unknown or other
  misc_feature (595)..(595): n is a, c, g, or t
  modified_base (739)..(739): a, c, t, g, unknown or other
  misc_feature (739)..(739): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctatttagaggtgtccagtgtgagtgcaagtggtggattcgtgggaggacggtggtggtccagtcctgggaanaactcccaggtacgacgtctaccgtggtcgcacgtcccgtctggtacttacctacctttaggttagtttaagttggaattaggacggtcgtcggggttaccctccgaagtaccgtaccggaaggggtaacggggtccgtagggtaacggttccggtacggacccctaaaacgtaacttaaaacccggtagtaacgtagggtaaaagggttaaaacaaaaaggtttcgtacggtacggtacgtttacgtaagggtaacggggtaaacgggtcccgtttattaccgaaaccttacgtacccttaccggaagtaaaccgaacggaaacccgtaacgaaaggaaccggtaccaacggttntaacgttctaccggaaataaacgtagaaccgtacgaccggtaggaacgaccgtaccggaggtaaacccggaggttacgtacgttaacgtactacggttggaacggtcaaggtaacgtcgtacgtaccgttcacgtttacccgtntttcggacttcccgg

SEQ ID NO: 46526 - DNA, 660 bp, Homo sapiens
  misc_feature: GYAE6OF02FM3VU.27.57.F02.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (263)..(263): a, c, t, g, unknown or other
  misc_feature (263)..(263): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaggtgtccagtgtgaggtgcactggtggattctggaggnggtgtcggtccngtcgtggagactccgtgagtacctctctgtcgacncgcctcgtaggtcttacttacgtttagttatttacgtgtagtgacgtcggtcgggtcccacgacgtaccgtaccgggaaggggacgggtcgttagggtaggttccggtacgaacctaacgtaaacgtaaaccgaaggtaaggtacgggtaaaagtaaaagtaaactagtaggtaacgtacttgtaggtacggacggtacctaagtctactgtccagagacgaacaacgacctaaaggactaccattcgtatacgtcaaacgacgtaacgacgtagcccgtaggacgtacggaaccgtaaggacctagggtcttaacggtataccgttaggtggtaacggacggtaatacggttacctacgttagaaccttccgttacgttctttacggccttacggg

SEQ ID NO: 46527 - DNA, 702 bp, Homo sapiens
  misc_feature: GYAE6OF02JZRCL.27.57.F02.1.454.CMB.1.raw
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (401)..(401): a, c, t, g, unknown or other
  misc_feature (401)..(401): n is a, c, g, or t
tcagagcgtcgtctcacgaccggtgctcgatttagctcgatatagttgggtttgaggtctcagagaggagccttagccctggactccaaaggcctttccacttggtgatcagcacggagcacagaggacccaccatcggaactggggctgagcgtgggttttccttgttgctattttagaaggtcgtccaggtgtgaggtcgcaacgtggtggtattcgtgggaggagggtggtcggtccagccgtggacgactcctgagctctcctgtgcacgtcctntggcttacctacctttagtagttnttaggtatgagtcgcgggtccncgaagcctacggacgggagggcgtggtacggttcgtcgaccaacgaactaaacgaaggtacgtaaggaaggtaaanaaacgtagtaggtacggtaccgtacgtaggtagggaacggtaccgtacttaccgactacgtccctaacgaagaccgtaaaccgaaccgtaaaccgaaaggtaactacgtagttacgtaactaccggtaataacaacgtacggtaaccaacgtacgaaggaaccggtaaccgacccggtaagggaccacggtacgtaacgttacgtaccgtcgttacgggcggtaaggtaccggtaaccacgtttaccgtaccggttaacttccggttacccggtttcgtttaacggtcccgtttaaccggg

SEQ ID NO: 46528 - DNA, 702 bp, Homo sapiens
  misc_feature: GYAE6OF02GATV3.27.57.F02.1.454.CMB.1.raw
  modified_base (265)..(265): a, c, t, g, unknown or other
  misc_feature (265)..(265): n is a, c, g, or t
  modified_base (306)..(306): a, c, t, g, unknown or other
  misc_feature (306)..(306): n is a, c, g, or t
  modified_base (685)..(685): a, c, t, g, unknown or other
  misc_feature (685)..(685): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctatttttagaaggtgtccagtgtgaggtgcaactggtggattctggaggaggtgtggtccagcctggagaatccctgagactctcctgtgcagccctntggattcacctttagtagtttattggatgagctggggtccnccagacctcgaggggtaaggggctgggacgttcggcggaccaactagtaaaacccgaagacgtaggggaaggtaaaagaaaacttagtacggtaggactacgttggacgggtaaacggggtcctaagtttccgaaccgtaacgttccctacccgtaaggaaccgaaaccgtaaaccggtaaccgaaaacgggtaacggtaccctaaacgtttcgggtaaacttccgttacggaacctaaaagtttcgaaacgtacggtaccccgttagaacggtaccggcgggaacgggttaaaccgacgggtactttaggtaacttacgttaccgtggtcggaaccgtaaggtacgtaacttccgtaacgtccttacgtttcccggtnttttacggacttccggg

SEQ ID NO: 46529 - DNA, 754 bp, Homo sapiens
  misc_feature: GYAE6OF02J1TND.27.57.F02.1.454.CMB.1.raw
  modified_base (198)..(198): a, c, t, g, unknown or other
  misc_feature (198)..(198): n is a, c, g, or t
  modified_base (343)..(343): a, c, t, g, unknown or other
  misc_feature (343)..(343): n is a, c, g, or t
  modified_base (654)..(654): a, c, t, g, unknown or other
  misc_feature (654)..(654): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccccaaccatggaactggggctgagctgggttttccttgttgctattttagaaggtgtccagtgtgaggtncaacgtggtggattcgtgggaggtagggtgtcggtccagtccgtgggataatccctggagtactcctccgtgtcgtcgacgtcctacgtaggtattctaaccgtttaggtaagtttagttcggaatggacggtcgtcgggtcccncgaacgaccgtaccggagggggaacgggtcgttagggacgtttcggtacggaccctaaaataactaaaacccggaagtaggtaacgggaaacggtaaaacggtaaaacctaggtagtaggtaccttaggttacggaggtaacgggtaccgtacttaccgacctacgtcctaaccgaacgaacgtaacccaaacggaccctaaaggtaactacccgtaagttagtaactccggttaagaacttaaagccggaaacgttaccgaccggtgtaacgaaccgggtaacccgtacgggaaaccgtcgggttaaccngttaaacgttaccgtacggtacgggttggaccgtaaaggtcgtaaccttacgttaccgtccgttaccgtttaccggttagtttacgacgtttaccccggg

SEQ ID NO: 46530 - DNA, 750 bp, Homo sapiens
  misc_feature: GYAE6OF02GFJVP.27.57.F02.1.454.CMB.1.raw
tcagagcgtcgtctcacgaccggtgctcgatttagctcgatatagttggggtttgaggtctcagagaggagccttagccctggactccaaggcctttccacttggtgatcagcacggagcacagacggacccaccatggaactggggcctgagcttggttttccttgttgcttattttagaagtgtccagtgtgagtgcaacgtggtgattcgtgggaggaggtgtcggtccagcctagggagtaactccccgtagacgtacctcctccgtgtcgccagtccttacgtaggtacttcctaaccgtttagttagtttagtttggacgtgacgtcggttacggtccccggaccacggaccgttaccgggagggggtaacgggtcgtagggtacgttcgacggtaaccaacgtaaaccgtaaaaccgaagtaagtaaggggtaaaacgtaaaacgtaaaacttaggtacggtacggtaaccttcggtaggtaacgggtacgggaccgtttaactaccgacgtaaccttccgaaccgaacgtaaacgaaccgtaaccgaaacgtaaacggaactacccgaagtttacgtaacttacgaactacgtaaatacgaaacgacgttacgacgtacgggaacggccggacggaacgtaaccggtgttaaccgtaaacgttctacggtacggtcgtacgggaactaaggttacttaaccgttactacgttaccttcggtttacttttcggacctttcggg

SEQ ID NO: 46531 - DNA, 653 bp, Homo sapiens
  misc_feature: GYAE6OF02HHKRI.27.57.F02.1.454.CMB.1.raw
  modified_base (545)..(545): a, c, t, g, unknown or other
  misc_feature (545)..(545): n is a, c, g, or t
  modified_base (553)..(553): a, c, t, g, unknown or other
  misc_feature (553)..(553): n is a, c, g, or t
  modified_base (602)..(602): a, c, t, g, unknown or other
  misc_feature (602)..(602): n is a, c, g, or t
  modified_base (641)..(641): a, c, t, g, unknown or other
  misc_feature (641)..(641): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagacctctcctgtgcagcctctggacttcctacctttagtagttattggaatgagtcgtcggggtcccgccaaggacctaccggaagggggaacggggccttagggaggtttccggtcgggacccctaaacgaactaaaacccgaaaggtagtacgggaaaggtaaaaagaaaaacttagtacggtaggtactcgtaggtagggaaacgggccgtacttaccgaaccgtacttaccgtaccaaggaacgaacaaccgaccgaaaagaacgtaccaacgttgtaactccttagaactaaanacggaacncgaccgtgaacgacgacggagacgacggtactagtactacttacgtcgnggacgtagacgttactaccgtatccgttaatcccggttntttacgatccgg

SEQ ID NO: 46532 - DNA, 731 bp, Homo sapiens
  misc_feature: GYAE6OF02HJHO4.27.57.F02.1.454.CMB.1.raw
  modified_base (188)..(188): a, c, t, g, unknown or other
  misc_feature (188)..(188): n is a, c, g, or t
  modified_base (648)..(648): a, c, t, g, unknown or other
  misc_feature (648)..(648): n is a, c, g, or t
tcagagcgtcgtctcacgaccggtgctcgatttagctcgatatagttgggtttgaggtctcagagaggagccttagccctggactccaaggtcctttccacttggtgatcagcacggagcacagacggacccacatggaactgggctgagcgttggtttctgtgctatttagagtgtcagtgtgagtncagtggtgattcgtgggaggaggtgtcggtccagtccgtaggacgtaactcccgtaggacgtaccttccgtccttggtagccgacgtccttcgtacggtactttacctaaccgttttagtaagtttagttggatggacgtcggtcggggtcccaccgtacgccgtaccgggaggggacggtgtaggtaggttccgacggacctaaacgtaaacgtaaaaccgaaggtacgtaaggtaaaggtaaaactaaacgttgtacggtaggtacgtaggttaggtacgggaacggtacccgtattaccgaaccttacgtccgtaaccgaacggaaccgtaaaccgaacccgtaaacggaaacgtaaccgttactaagttaccttaacgttccgaactaaacgtaaagaaccggacaacggtaccaagggtaacgaccggtaccgggaaagcccgtacgtaacgttnttaaccgtagttcgtaggtccggaatacggtaaccttacgtacccgtagttccctagtttcccgttaatttcggacttccggg

SEQ ID NO: 46533 - DNA, 722 bp, Homo sapiens
  misc_feature: GYAE6OF02JMN0O.27.57.F02.1.454.CMB.1.raw
  modified_base (166)..(166): a, c, t, g, unknown or other
  misc_feature (166)..(166): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
tcagagcgtcgtctcacgaccggtgctcgatttagctcgatatagttgggtttgagggtctcagagaggagccttagccctggactccaaggccttccacttggtgatcagcacggagcagagaggacccaccatggaactggggctgagcttgggtttcctgttnctagttttagagtcgtcagtgtgagtgctacgtggtgattcgtggaggagtgtgccagtcgtgganacgttccngactcgtctcctggngacncgtcctgagtacttccacgtttagtagtacttggattcgagtcgtggaccctcgaacgccgtaccggagggtacggggtctagggtacgttcgtacgggacccctaataacgtaaaaccgagtacgtaacgggtaagtaaaacgtaaaactggtcggtacggtaatcggtacggtaagggtaacgggccttaacgttacccaaccggttactccggtaaaccgtggtaacccgagtaaacccgtacaaacggtaacgtaccctaacgttgtaactggtaaccgtactaaaggtcgaaaccgcgtaccgtaagggcgaacccggttaacgggaacgtacggaaacccggttagttacgtaacgttcgttaacggcggttaacgtaccggaagtacccgttagtaacccgttacgggttaaccttaccggttttacccggtttaaccgtttgacccgtttacggg

SEQ ID NO: 46534 - DNA, 752 bp, Homo sapiens
  misc_feature: GYAE6OF02G0GM7.27.57.F02.1.454.CMB.1.raw
  modified_base (592)..(592): a, c, t, g, unknown or other
  misc_feature (592)..(592): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgtgggtttctgttagctattttagaaggtgtccagtgtgaggtgcaactggtggattctggaggaggtgtcggtccagccgtggagaatcccgtgagtactctcctgtacgcacgcctcgtggtacttcgtacctttaagttagtttacttagggataggtagtccgtacgggggtccccgtcccgtaacggaccgttccggaaggggggtaagggggtccgtggggtaacggtttccggtacgggacctaaaaccgtaataaaaacccgaagtaacgtaggggtaaaacggtaaaaggtaaaaaacgttagtacggttaagggtacttaccgttaggtaaggaacggggtacccgtaacgtttaccgaaacccgtataccgtaccgacgaaacgtaccgaaacgacccgaaaggtaacgaccgtaacttagttaaccgttntacgaactaagtacgaacgtacgtccgtaggacgaccggtacggaacggtaacgtacggtagttacgtaacgttacggtacgttcgggtagaacgggtaacgtaacgttaccgtacgttaacgttaccgttacgtttacccgttcgtttaggaccttcgg

SEQ ID NO: 46535 - DNA, 746 bp, Homo sapiens
  misc_feature: GYAE6OF02F87HF.27.57.F02.1.454.CMB.1.raw
  modified_base (181)..(181): a, c, t, g, unknown or other
  misc_feature (181)..(181): n is a, c, g, or t
  modified_base (333)..(333): a, c, t, g, unknown or other
  misc_feature (333)..(333): n is a, c, g, or t
  modified_base (733)..(733): a, c, t, g, unknown or other
  misc_feature (733)..(733): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtntccagtgtgaggtgcaactggtggattctgggaggaggtgtggtccagcctggagaactccctgacgactctcctgtgcagtcctcgtggtactttccgtaccgttttaggtaggtttatttggggattggacggtcgttcgggggtccccnccgaacggtaccgttcccggaaaggggggaacggggccttaggggtaacgtttccgggtacggaaccctaaaactaaacgttaaaaacccgaaaggtaaggtacgggggtaaagggttaaaaaacgaaaaacgttagtacgggtacgggaacttacggtagggtacgggaaacggggcccttaacgtttacccgaacgttaacgtcccgtaacccgaaagggtaaaccgtaaaccgaaaacccggtaccgaaaaggtaacggtcctaaacttggtaacttcgtacgaactaaagtcgaaactcgcctagggaacgacggaccggaaggtaccaacggtcttaaggtacttaccgtagtgtaggaccgagtacgtacttacgtacgtctacgttaccgttnttttagcttccgg

SEQ ID NO: 46536 - DNA, 640 bp, Homo sapiens
  misc_feature: GYAE6OF02GEIC3.27.57.F02.1.454.CMB.1.raw
  modified_base (268)..(268): a, c, t, g, unknown or other
  misc_feature (268)..(268): n is a, c, g, or t
  modified_base (352)..(352): a, c, t, g, unknown or other
  misc_feature (352)..(352): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttattttagaaggtgtccagtgtgaggtgcaactggtggattctggaggaggtgtggtccagcctggagaactccctgagacctctcctgtgcagcctntggattcctacctttagtagttattggatgagcgtcgggtccgccagactccgaggggaagggctggagttcggtggacccaanactaaaccgaagaagtaggaaaggtaaaagaaaactagtaggtaggtaacttcgtagtaggaacgggcctaacttaccaaccgtatccgaccaaggacgtaaccaaccgacccaaaaggtaacgtccaacgttagacttacgtagtaactaaatacgaacacgtaccgtaggaaggtacgccggaaggaacccgacggtacttagtaacttaccgtagtggtaacggaccgtaagtacgaacgttccgtaacgttcctacctttcccgttagttttacgctttaccgg

SEQ ID NO: 46537 - DNA, 629 bp, Homo sapiens
  misc_feature: GYAE6OF02J2YCC.27.57.F02.1.454.CMB.1.raw
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (372)..(372): a, c, t, g, unknown or other
  misc_feature (372)..(372): n is a, c, g, or t
tcagagcgtcgtctcacgaccggtgctcgatttagctcgatatagttgggtttgaggtctcagagaggagccttagccctggactcccaaggcctttccacttggtgatcagcacggagcacagaggacccaccatggaactggggctgagcggtgttcgtgtaggccgtattagaggctcagtntgacgtgctacgtggtngttcgnggaggcgttgacggtaccngttccgagcgtactcgtnaccgtcnctactgcncgcnctcgtcgtaactctaccgttaagnggttactgngtccgntcgttcggacaaccgtgacgtcggnggtaagtccngggtacttcggacaccgtaaaacggttaaccggngtagtaacgaacgtaactaacgtgacgtcgtacgttacgaaggtaccggtcggtactacgtaccgtactcgtacgtacgaacggaacctacggaacctacgacgttacgacgtacgtacgtctacgaactaacgtacgtacgtataccgcacgtaccgtaacgacggacgtcgtaaacgtctacgtcgtacgcgtaacggtcgacgtacgtacctacgtaccgttcgtacttacccgtagtacttacggtcgtacgg

SEQ ID NO: 46538 - DNA, 757 bp, Homo sapiens
  misc_feature: GYAE6OF02GXL8Q.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagtcgttggttttccttgtgcttattttagaaggtgtccagtgtgaggtgcaacgtggtggtattcgtgggaggtggtgtggtccagccgtggagaactccctgacgtcctcctcgtgtcgacacggtcctcgttgtacttctacctttagttagtttagttggattggagtcgttcgggcccgtccgacgtaccgtaccggaaggggtaacgggtcggttgggtacggttcggtacggaacccaaacgtaacgtaaaaccgaaacggtaaggtaacggggtaaaaagggttaaaaacgtaaaactttagttaacggtacggtacttcgtacgggtacgggtaaccggggtaccgtaacttaccgaaccttacgtacccgtaccgtaaaggaaccgtaaaccaaaccgggtaacctaaaggtaacctacggtaacttaacggtacgttactaacgtaactaaaagtcgaacgtacgacgttacggagacccgtacgggaccggtaaccggtactacggtaactacgttaccgagttacggcggtaacggaacgtcgttaccgttccgtaactccgtttaccgtaccgtttgtttaccgacgttccggg

SEQ ID NO: 46539 - DNA, 636 bp, Homo sapiens
  misc_feature: GYAE6OF02FNSOM.27.57.F02.1.454.CMB.1.raw
  modified_base (370)..(370): a, c, t, g, unknown or other
  misc_feature (370)..(370): n is a, c, g, or t
  modified_base (628)..(628): a, c, t, g, unknown or other
  misc_feature (628)..(628): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagtctgggttttccttgttgtcttattttagaaggtgtccagtgtgaggtgcaacgtggtggattcgtgggaggtaggtggtggtccagcctagggagtaactccctgacgtactctcctgtcgcacgcctgtggtattctacctttagtattagtggtatgagcgtgggtcccgcgagacctccggaggggaacgggcgtagggtgttcggcggacccaanaactaaaccgagagtaggggaaagtaaagaaactagtaggtacgtactggtaggaggaacgggacctattaccacctatccacgagacaacgaaccacgaaagacgtcaacgttgcttcgacgaactaaagacgaacgagtacccgtggaacgaccggaccggaacggacgaccggtacgtagttaccttacgtaccggtggtcggaaccgtaggaccgtattacccgtagttccttaccgttccgttacgtttacgngtttccgg

SEQ ID NO: 46540 - DNA, 892 bp, Homo sapiens
  misc_feature: GYAE6OF02H963X.27.57.F02.1.454.CMB.1.raw
  modified_base (208)..(208): a, c, t, g, unknown or other
  misc_feature (208)..(208): n is a, c, g, or t
  modified_base (875)..(875): a, c, t, g, unknown or other
  misc_feature (875)..(875): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgtggtttctgtagctatttagaaggtgtcagtgtgaggtgacaacgtggtggtattcngggaggaggtggtggtaccagccgtagggagaacttcccgtggacgtacctctccgtgtgctacgccttcgtacggtatttcctaccgttttaaggttagtttacgtaggtacgttaggaacgtccggttacggggtccccgtaccgaaccggtacccgtacgggaacggggggtaaggggtccgttagggtaaccgggtttcggtaccggaacctaaacgaaaccgttaaaaccggaaaggtacggtaagggtaaaacgggtaaaaacgtaaaacgttacggttaagggtaccggtacttcgttagggtacggggtaaacccggggtacctttaacggtttaacccaccggttaacttaccccgtaaccgaaagggaacgtaaaaccccgaacggtaaacccgtaaaaggtaccgtacccggtaacgtttacgtaacttcccgtaaagtaacccgaaaacgttacggaaaccgttaaaccgggtaccggttaacggaacgggttaaacccgggcgggtaaacccgggtaacctacccgggggttaatttaacgggtttaaaccgtaccgtttcggtaacggttcgggaacggttaaccgggtaaccttaacccggttttcggtaccgtttacgttaaccggttttccccggttttggttttaaccncggttttaaccccgggg

SEQ ID NO: 46541 - DNA, 975 bp, Homo sapiens
  misc_feature: GYAE6OF02HY1AH.27.57.F02.1.454.CMB.1.raw
tcagagcgtcgtctcacgaccggtgctcgatttagctcgatatagttgggtttgagggtctcagagaggagccttagccctggactccaaggcctttccacttggtgatcagcacggagcacagaggacccaccatggaactggggctgacgcgtggttttccgttgttgctattttacgaaggtcgtccagtgtgaggtggaccgaactggtggattcgtggtacggtaggttgttgggtaccaacggcccgttaggaggtaaacgttcccctggtaacgtaccgttccttccgtagttcggacctaacggccttacgttgggtacttaccgtaaccgttttacggtaacggtttaactttcgggaattcggaacgttaccttacggggtacccgtaccgtacggaaccgtcccgtaacgggggaacgggggtcccgttagggtaaccgggtttcgttaccgggtaccgtaaaccggtaaccgttaaaaacccgaaaggtacgttacggggtaacgggttaaaaacggtaaaaaccgttaacgttacggttaacgggtaaaccttccgtttacggttaacggggaaacgggggtaccccggtttaacttttacccggtaaaccgtaaccgtttaccggtttacccccgaaaggtaaccgggtaaaccgtaaaccgggtaacccaaaaacgggttaaaccggttttaaccgaccggtttaacggttaacgtacccgtttaagggtaacccgtaaaacggttaaccgggtaaccgtaaccgggtacccttaaccggggtaaacggtacggtaaccccggggtaacgggtaacccggtacgggtacccgttaacgggttaacttaacccggtttccgtacggggttaactccgggtaaggtaaccgtaccggtttacccgttacggttacccgttacctttaccccggggtacttttttacggacccggtttaccgg

SEQ ID NO: 46542 - DNA, 891 bp, Homo sapiens
  misc_feature: GYAE6OF02H8MYC.27.57.F02.1.454.CMB.1.raw
tcagagcgtcgtctcacgaccggtgctcgatttagctcgatatagttgggtttgagtctcagagaggagccttagccctggactccaaggcctttccacttggtgatcagcacggagcacagaggacccacatggaactggggctgagctgggttttcctgtgctattttagaaggtgtccagtgtgaggtgcaactggtggattcgtggaggaggtgtggtccagcctggagaatcccgtgagaccttctccgtgtcgacacggtccctcgtgggactttacctaccgttttaaggttagttttaagtttggggaattcggtaaggtcccgtttcgggggttccccgtcccgaagggtaacccttcccgggaaaggggggtaaacggggggtccctttaggggggtaaacggttttccgggttacggggaaccccctaaaacgtaaaccgtaaaaaacccgtaaaggaaccgttaagggggtaaaaagggtaaaaaaaccggtaaaaaacgtttagtttaggggtacggtacctttaccgtaggggtttaacgggaaacggggtcccgttaaagtttacccaacccgtaacgtttcccgtacccggtaaacggaaggtaaaccccaaacggtaaccccgaaaaagggtaacgttacccgtaaaccgttacggtttaaccttcggttaacggaacctaaaaggttaacgaaaccaacgggtcccgtaaggaaccggttacggacccggggtaaagcccgggaaacccggtaacgttacgttaacttaacccggttacgtacgggtacggaacggtacgaaggttaacccgtttacgttacggtaccttaaccggttttcccggtttactttttacgggccgtttaacccgg

SEQ ID NO: 46543 - DNA, 626 bp, Homo sapiens
  misc_feature: GYAE6OF02GYVJB.27.57.F02.1.454.CMB.1.raw
  modified_base (266)..(266): a, c, t, g, unknown or other
  misc_feature (266)..(266): n is a, c, g, or t
  modified_base (315)..(315): a, c, t, g, unknown or other
  misc_feature (315)..(315): n is a, c, g, or t
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
  modified_base (567)..(567): a, c, t, g, unknown or other
  misc_feature (567)..(567): n is a, c, g, or t
  modified_base (618)..(618): a, c, t, g, unknown or other
  misc_feature (618)..(618): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttccttgttgcttattttagaaggtgtccagtgtgaggtgcaactggtggattcgtggaggaggtgtggtccagccgtaggagaactccctgagactctcctgtcgcngcctgtggtacttctactttagtagttattggatgagtcgtcgggtccncgagaccgtacgaggggacgggcgtagggtgttcggtccccggactaaacgaactaaaaccgaagagtagggaaaggtaaaagtaaaacgttagtaggtaggtactcgtaggtagggaacggggtacctaacgttaccaacctactccacgaagactaaaccgaaccgaacaaaagtaacgcctagttntacttcganactaaagcaactcgacgtagaaggacgccgaaggacgtcggatacgtacttacngtcggcaacggaagcgtaacttcgtacgtacttaccgtttctaggtttacncgttccgg

SEQ ID NO: 46544 - DNA, 856 bp, Homo sapiens
  misc_feature: GYAE6OF02HXIC3.27.57.F02.1.454.CMB.1.raw
  modified_base (176)..(176): a, c, t, g, unknown or other
  misc_feature (176)..(176): n is a, c, g, or t
tcagagcgtcgtctcacgaccggtgctcgatttagctcgatatagttgggtttgaggtctcagagaggagccttagccctggactccaaggccttccacttggtgatcagcacggagcacagaggacccacatggacctggggctgagcgtggttttcctgttgctatttagagtntccagtgtgaggtgcaacgtggtggtattcgtgggaggtaggtcgtggtcctacggtccgtgggacgaactaccccgtagacgtacctacgtccttggtcgctacgtcctcgtacggtactttacctacccgtttaaggttaagtttaacgttggtaacgttaggtaagtcccggtcggggttacccgaccgtaacgtacccgttacggaaggggaacggggtccgttacgggtaccggttaggtccggaaccaaacctaacgtaaaacccgaaaggtagtagggtaaaacggtaaaggtaaaactaggttaggtacgggactttaccgtagggtacgggtaaccgggtaccgtaacttaaccggtaccctaaacccgtttccgttaaaacccggaaaggtaaaacccggtaaaaaccgggccgtttaaaaacgggtaacctaacccgggttaacttaacggttactttaccgtaacggtaacctaaaacgttactaaaacgggtcggtaaccgtacgggaacgtacgggaaacccgttacgggaaccgtaaccgggacgtttaacgtacgttaacgtaccgttacggtacggaccgttaaacgtacgtaaaccgtttcccgtaacggtactttaccggttacccgtttacgttttaccggtacttccggttaaccgggg

SEQ ID NO: 46545 - DNA, 836 bp, Homo sapiens
  misc_feature: GYAE6OF02INPP0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttccttgttgctattttagaggtgtcagtgtgagtgcaactggtggattcgtgggaggtaggtgtggtccagtccgtggagtaactcccgagacgtacctctcgtgtgcgacgtccttcgtacggtaccttctaaccgttttagttaagtttacttgggtataggacggtcggtccgggtccccgtacgaacgaccgtaccgggaaggggacggggtcgtagggtacggtttcggtaaccgaacctaaaacgtaaaacctaaaaccggtaaggtaacggtaaggggtaaaaacgttaaaaaacggtaaacgtttaggtacggtacggtaccttacgtacgggtaacgggtaaccggggtaccgtttaactacctaaccgtaaccgttacccgtacggaaaggaaacccgaaaccgtaaacgtaacccgtaaaaaggtccgttaactaaccggttagtaaccctacggttaacgaaacgtaaaagttccggaaacgacccgtaagggttcggaaacgggaccggtaaccggggtaaacgtaaccgggtaaccggttacttaagttaaaccggtacccttacggggtgttaaaaccggggcctaaggtaaccgtttaccgtaacccggttctaacccgtttaggtttaccccgttttggtttacccggtcttaccccggg

SEQ ID NO: 46546 - DNA, 677 bp, Homo sapiens
  misc_feature: GYAE6OF02JT9W4.27.57.F02.1.454.CMB.1.raw
  modified_base (237)..(237): a, c, t, g, unknown or other
  misc_feature (237)..(237): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggactggggctgagctgggtttcctgtgctatttgaaggtgtcagtgtgaggtgcaacgtggtgattcgtggaggaggtgtggtccagccgtggagatcccgngagactcgtcctgtagcagcctctggattctacttagtagttagttggtatgagtcgtcgggtccgacagcgtccgagggagggtctagggtgttcgtggacctaacgaataaaccgaagtacgtaggaaacggtaaaagtaaaactagttaggtacggtaacctcgtaggtaagggaacggtaccgtaagttaccaaccgtactccgtaccagtaaagaccgaacgacgaaacgtacaccgtaactaggtacttagacgactaaacgtcgaacacggtcttacggaagtaccggaaccgtaacgggtacggaaaccgttcgtaagttaccgtaacgttaccggtaggttacccggaacgtacggtaacggttacgtaacccgtttacggttacgttaaaccgttttcccgttaaggtttttaccgtaccgtttaccggg

SEQ ID NO: 46547 - DNA, 746 bp, Homo sapiens
  misc_feature: GYAE6OF02GN4Y0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggtttccttgttgctatttagaagtgtccagtgtgaggtgctaacgtggtggattctggaggaggtggtggtccagtccgtggagaactcctgacgtactctcctgtgctacgcctgtggtacttacttaccgttaggttagttacgttggaacttggaacgcgttacgggtccgaccgtagaccgtaccggaaggggaacggggtcttaaggggtcgtttccgggacggtacccaaaacgtaaactaaaaccgaaaggtaagtacggggtaaaaggttaaaaacgtaaaaccgttagttacgggacggttaaccttcgttaggtaacgggtaagggggtaaccctattacccgaaccgtactaccgtaccgtaacggacgtaaaccgaaaccgtaacgaaacgtaacggtactaacgtacgttactacgtacgtaacgaaagtacgaaacgtacgtaccctagggaacgtacggaccggaacggtacgaaccggttacgtaacgttaacgttacctacgtacggtacggtacggaagtaacgtagttaccgtaagtccgttacgtttcccggttagttttcgacgttaccgg

SEQ ID NO: 46548 - DNA, 793 bp, Homo sapiens
  misc_feature: GYAE6OF02HSCJE.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaactggtgattcgtgggaggaggtgtggtccagccgtggagaatccctgagactcgtcctgtgcagcctcgtggtattctacctttagttagttagttaggtatggtaggttcgggtacccgtccgacgaccgtcccggaagggggaacggggtcgttacggggtaaggtttccggtacgggtacccaaaacgtaaacgtaaaaacccgtaaaggtaagtaaggggtaaaaggtaaaaacgaaaaaacgttacgtaaggtacggtaacttcgtaggtaacgggaaacgggtcccgtaagtttacccaaccgtaactccgttaccaaacggtaacgaacccgaaaccgtaaccgaaaaggtaaacgtctaacgttagttaacttacgtacgaaacgttaaaagtaacggaaaccgtacggtacccggtaagaacgggtaaaccggacccgggtaaaccggaccggaaccgggtacttaacggttaactaaccgttacgttaggtacggtaacggaacggtaacgttacccgttaaccgttaacgttccgttaactttcccggttttacggtttacgtttaccgtcggttacccggggg

SEQ ID NO: 46549 - DNA, 875 bp, Homo sapiens
  misc_feature: GYAE6OF02I8VAJ.27.57.F02.1.454.CMB.1.raw
tcagagcgtcgtctcacgaccggtgctcgatttagctcgatatagttggggtttgaggtctcagagaggagccttagccctggactccaaggcctttccacttggtgatcagcacggagcacagaggaccccaccatggaactggggctgagctgggttttccttgttgctattttagaggtgtccagtgtgaggtgcaacgtggtggattcgtgggaggaggtggtggtccaggccgtggagaactccctgagtacctcctccgtgtgcagcctctggtattccaacctttagtagttattaggatggagtcgtgggtcccgtcagtaccgtccgtaaggggaacggggtctagggacggtttcggtacgggacccctaaacgaaacgtaaaaacccgaaaggtaagttaaggggaaaagggtaaaaaacgtaaaaaacgttaagtaacgggttaggtaaccttacggttagggtaaggtaacggggtaccgtacgtttacccgaaccgtaacgttacccgtaaccccgaaggtaaaccggaaaacccctaaaacccgggacccgtaaaaaaccggtaaaaggttacccgtaaaccgtttacggttaaaccgttaccgttaacggtaaccgttaaaaaacggtttaccggaaaaaccgtacccgggtaacccgtacgggtaaacgggaaacccggggtccgggaaaaccgggtaaacccgggtaaccgggttaaccgttaaggttaaacccgtttaaccgttaccgtttaagggtaccggtaccggtaaaggttaacggtaacccgtttaacgttaacggttacccgttaacgttttaccccggtaccgttttttaggtacccctttacccggg

SEQ ID NO: 46550 - DNA, 765 bp, Homo sapiens
  misc_feature: GYAE6OF02GD773.27.57.F02.1.454.CMB.1.raw
  modified_base (181)..(181): a, c, t, g, unknown or other
  misc_feature (181)..(181): n is a, c, g, or t
  modified_base (348)..(348): a, c, t, g, unknown or other
  misc_feature (348)..(348): n is a, c, g, or t
  modified_base (524)..(524): a, c, t, g, unknown or other
  misc_feature (524)..(524): n is a, c, g, or t
tcagagcgtcgtctcacgaccggtgctcgatttagctcgatatagttgggtttgaggtctcagagaggagccttagccctggactccaaggcctttccacttggtgatcagcacggagcacagagacccaccatggaactgggctgagcttgggttttcttgttgcttattttagaaggtntccagtgtgagtgctaacgtggtggattcgtggaggtaggtggtcggtcagccgtagggagaaactcccgttagacgacctcgttcctagtcgacagccctatcggtattacctaccgttttagttagttacttagggattacggacgtcggttaccggggtacccncggtaacgtaccgtcccgggaaggggaacgggtcgtagggtacggttcgtcggaacctaacgtaataaaaccggaagtacggtaaggggaaaacggttaaaaactaaaaacgttggttagacggttaacctgttacgggtaagggaaccgggtaccgtaagttacccaacccggtntacccaccgtagaaacgtaccaaaccgacccgaaagtaccgactaacgttacgtaccttacgtagaacctaaagtacgaacgtaccggaccgttaaggaaccggaaacggtccgggaaaccggggtacccaggttaaccgttacgtaacgtttacgtaccggtagggtcgaacggtaacgtaacgtaaccgttaaccgtccgtatttaccgttcccgtttaagttttcccgactttccggg

SEQ ID NO: 46551 - DNA, 944 bp, Homo sapiens
  misc_feature: GYAE6OF02HJP5Y.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagccgtggagaatccctgagactctcctgtgcagcctcgtggacttcaacctttagtagttattggatgtacgtcgtgggtccgcctaacgacctccggaaggggacggggctgggtacgttcgtcgggacccaaacgaacgttaaaaacccgaaggtaagtacgggggtaaaacgggttaaaaaacggtaaaaaacctttaagttaacggggttacgggttaaacctttaccgttacgggtaagggaaaaccggggggttcccggttaaacgttttcccgaaaccccgttaacgtttaccccgttaacccccggaaaagggttaaacccgggaaaccccggtaaaaacccgggtaccccgtaaaaaacggggtaaaaccgggttaccccttaaaacccggtttacggttttaaacccgtttacccggtttacgggaaaacccgttaaaaaacgttacccgggaaaaccgaaccgggttaccccgtttaacggggaaacgggtaacccggggtaaccccgggggaaaccggggtaaacccggtaacccgggggtttaaccctttaaggggtttaacctttaacccggtttaaccgttacgggtttaacgggaccgggttaaacgggtaacggtaaccgtttttaccccggttaaagtttacccggttaacctttttccccgggtttaaccttttttaggggtaccttttccccgggg

SEQ ID NO: 46552 - DNA, 664 bp, Homo sapiens
  misc_feature: GYAE6OF02GX86R.27.57.F02.1.454.CMB.1.raw
  modified_base (258)..(258): a, c, t, g, unknown or other
  misc_feature (258)..(258): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgacgactctcctgtncacgcctctggtattcctacctttagttagttattggtatggagcgtcgggtcccgccagaccgtccggaggggaacggggcgtagggtggttcggtcggaccaaacgaactaaaccgaaagagtagggaaaggtaaaagaaaactagtaggtacggtactacgtaggtaggtaacgggaccgtaagttaccacacgtcctaccgagaacgaaccgaaccgaccgaaagtaacgtcaactgttactcgtagaactaaagtacgaaacgtacgtacctaggaacgacggacggaacggaccgtacggacgtagttaacgtacgtacgtggtacggaccggtaaggtacgtacgttcccgttaggttacccttaaggtttcccgtttacttttacgacgtttcccggg

SEQ ID NO: 46553 - DNA, 827 bp, Homo sapiens
  misc_feature: GYAE6OF02FHRX4.27.57.F02.1.454.CMB.1.raw
  modified_base (118)..(118): a, c, t, g, unknown or other
  misc_feature (118)..(118): n is a, c, g, or t
  modified_base (672)..(672): a, c, t, g, unknown or other
  misc_feature (672)..(672): n is a, c, g, or t
tcagagcgtcgtctcacgaccggtgctcgatttagctcgatatagttgggtttgaggtctcagagaggagccttagccctggactccaaggcctttccacttggtgatcagcacggancacagaggacccaccatggaactgggctgagctggtttccttgttgctattttagaaggtgtccagtgtgaggtgcaactgggtgattctggaggaggtgtcgggtccagcctgggacgaactccctggacgtaccttcctccttggtcgccacggtcccttcgtacgggttactttaccgtaacccgtttttaaggtaacggttttaacgtttagggtattacgacgtaccggttcggggttcccgccctaagggacccttcccgggaaggggggtaacggggttcctggggttaacgtttccgggttaccggaacccctaaaacgaacttaaaaacccgagtaacggttacggggaaacgggttaaaacggtaaaaaaccttggttacggttaccgtaaccgtcgttaggttaacgggaaaccggggtccttaaacgttaccctaacccgtactccgttaccccggaagtaaccggaaaccctaaaccgaacccgtaaaagaaccgtccgttaactaggttacttcgtaacgaactaaacgtcggaaaaccncgtaccgtaaggaacgaaccggtccggaaacggtaccgaacgggttcttaacgggttacctaccgttaacgtgggttacgcgggaaacgtaaagcctttaacccggtacgtttaccgtaaccctttccggtttcttttaggaccttttacccggg

SEQ ID NO: 46554 - DNA, 707 bp, Homo sapiens
  misc_feature: GYAE6OF02JVFSF.27.57.F02.1.454.CMB.1.raw
  modified_base (249)..(249): a, c, t, g, unknown or other
  misc_feature (249)..(249): n is a, c, g, or t
  modified_base (396)..(396): a, c, t, g, unknown or other
  misc_feature (396)..(396): n is a, c, g, or t
  modified_base (635)..(635): a, c, t, g, unknown or other
  misc_feature (635)..(635): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactgggctgagctgggtttccttgtgctatttagaaggtgtccgagtgtgaggtgcagtggtggattctggaggaggttggtggtccaggccgtggagaactccctggacnctcgtcctgtcggcagtccctcgttagtacttctaacccgtttggttaagttattgggtaactggtaagtcccggttaggggtcccaccgtaggaccgttcggaaggggggaaggtccgtgggtacgttcgggtaccggaccaaaanacgtaaacgaagtagtaacgggtaaagaaaacgtaaactgtgtaacgcttagttaggacgggacgggtaactacgttacgacacttcggacctaggaaccggtacaaaccgaccgtaaagtacgaacgtcgtagtaatacggtacgaacttaacggacctaacggacgtaccgtaaggacggaccggaaccggaggtaaccgcgggtaactagtttaacccgtacttggtttaccgggnggtaaccggtaagacgtacgttcccgtacgtttcccgtaacgttccgttttacggtttacgagtttacccgg

SEQ ID NO: 46555 - DNA, 665 bp, Homo sapiens
  misc_feature: GYAE6OF02IPDNQ.27.57.F02.1.454.CMB.1.raw
  modified_base (512)..(512): a, c, t, g, unknown or other
  misc_feature (512)..(512): n is a, c, g, or t
  modified_base (525)..(525): a, c, t, g, unknown or other
  misc_feature (525)..(525): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctggttttccttgttgctattttagaaggtgtccagtgtgaggtgcaactggtggattctggaggaggtgtggtccagcctggagaatcccgtgagactctctgtgcagtcctgtgtattctactttagttagttattaggagtgacgtcgttacgggtccgaccaaggtacctaccggaagggggtacggggacttgggtagtttcggcggacccaaataaactaaaccgaagtagtaggggaaaaggtaaaacgtaaacgtagtagtaggactacgtaggtaacggaacgggctaactacgaaccgtatacccgtccgaaagcgaaccgaaacgacaaacgtaagtaccaagttacgtaanctacaaacgtaanacggaaactacgaacgtcgaaacgacggaccggtaacgacggaaccggtcgtaagtaacgttaactcggttcggaaggacggaagtaactacggttaaccacgtttaccgttcttacccgtttattttacggaattccgg

SEQ ID NO: 46556 - DNA, 848 bp, Homo sapiens
  misc_feature: GYAE6OF02I0SMF.27.57.F02.1.454.CMB.1.raw
tcagagcgtcgtctcacgaccggtgctcgatttagctcgatatagttgggtttgaggtctcagagaggagccttagcccctggactccaaggcctttccacttggtgatcagcacggagcacagaggacccacatggaactgggctgagctgggttttccttgttgcttattttaggaaggttgtccagtgtgaggtgacaagtgatggattcgtggaggaggtgtcggtaccagtccgtaggagtaactcccgtagacgtactcctccgtgtcgacgaggccctcgtaggtacttaccttaaccgtttaaggttaacgtttagttaggtaacgttaggacggtccggtttacggggacccgtcccgtaacggaaccgttaccgggaacgggggaaaccggggtcggtacgggtacggtttccggtcggaacccaaaacgtaaaaccgtaaaaacccgaaagggtaaacggtaaacggggtaaaaggttaaaaaacggaaaaaacgttagtaacgggttacggtaaccgttacggtttaacgggtaacggggtaacggggtaacccgttaacgttaacccgtaaaccgttactacccgttaaacccgaaggaaaccggtaaacccgaaacgtaacccgtaaaggaaaccgttacctaaccgttagttaaaccgtcgttacgaactaaagttaacgaaactaaccggaccgtaaggaacgtaaccgggaccgaacgggtaacccgaacggtccgttaaggtaccttaacgtacgttggttcggaacgtaaggtaccttaagtaccgttaaacggtacctaaccgttttaccgtttacgtttagtaaccg

SEQ ID NO: 46557 - DNA, 727 bp, Homo sapiens
  misc_feature: GYAE6OF02J1DIH.27.57.F02.1.454.CMB.1.raw
  modified_base (613)..(613): a, c, t, g, unknown or other
  misc_feature (613)..(613): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccccaccatggaactggggctgagcttgggttttccttgttgcttattttagaaggtgtccagtgtgaggtgcaacgtggtggattcgtgggaggaggtgtggtccagcctggagaactccctgacgactcctccgtgtcgccagtcctgtcggtattcctaaccgtttagtagtttagttggatggacgtcgttcggggccctaccagaccgtccggaagggggaacggggtctagggtaacgttcggtacggaccaaacgtaactaaaaccgaaggtagtaaggggtaaagtaaaaaggtaaaccttagtacggtaggacttcgtaggtaacgggaacggtcgtaacttcgacctactccgaaccgagaacccgaacgtaaccgaccgtaaagtaacggtcctaacgttcgttaagtccgaagtaaactaaagtcgaactacgtaccggaagaccggtacgaccgggtagaaccgtaaccggtntaacgtttacgaccgttacggtttggaaacgggtccgtaaagccgttaaacggttacccggttaacgtcggttaccctttcccggtttaacttttaccggtaccttaacccggg

SEQ ID NO: 46558 - DNA, 693 bp, Homo sapiens
  misc_feature: GYAE6OF02F5OGL.27.57.F02.1.454.CMB.1.raw
  modified_base (152)..(152): a, c, t, g, unknown or other
  misc_feature (152)..(152): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagagcgtcgtctcacgaccggtgctcgatttagctcgatatagttgggtttgaggtctcagagaggagccttagcccctggactccaaggcctttccacttggtgatcagcacggagcacagaggacccaccatggaactggggctgagngttgggttttcctgttgcttattttagaaggtgtccagtgtgaggtgcaacgtggtggattctggaggaggtgtggtcccagccctgggacgaactccctagagaccttcctcctgtcgcacggcccttcgtaggtacttcgtaacccttttaggtagtttaagttgggtagtacgtagcggttcggggtcccgaccagtacccgtccgaaggggagggtcgtggaggtttcgnggacccaanaacgtaaaccagtagtggaaagtaaagaaaacttntaggtagacttcgnggtgggaacggtctataccaccgtactcctaaccagaacgacaaccgtaccgaaacgaacggtacctaattacgtacgtcgttaacgaactaagtacgaaaccgtacggactaagaacgggtaacgccggaaaccggaacgaccggtacgttagtaacctttactacgtagttaacggacgtaacggtacttaacgttaccgttaacggttacctaccggttttcctttacgttttagctttacccggg

SEQ ID NO: 46559 - DNA, 710 bp, Homo sapiens
  misc_feature: GYAE6OF02F2DOJ.27.57.F02.1.454.CMB.1.raw
  modified_base (272)..(272): a, c, t, g, unknown or other
  misc_feature (272)..(272): n is a, c, g, or t
  modified_base (324)..(324): a, c, t, g, unknown or other
  misc_feature (324)..(324): n is a, c, g, or t
  modified_base (573)..(573): a, c, t, g, unknown or other
  misc_feature (573)..(573): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggtttccttgttgctatttagaggtgtccagtgtgaggtgacaactggtggattcgtgggaggaggtgtggtccagcctaggacgaactcccgtagacgtacctctccgtgtgcagtcctntggtacttcctaccgtttagtacgtttattggatggagtcgtcggggtcccncgtacgaccgtaccggaagggggtaaggggtcctagggtacgttcggtcggaccctaaacgtaactaaaaccgaagtagtacggggaaaacggtaaaagtaaaacgttgtaaggttacggaaccttgtaggtacgggaacgggtacccgtaatccaaccgttacgtcccgtaacgaagtaaccgaaaccgaaccggaaccgaaaggaacggtcctaacgtagtacttcgacgtactaaaagtcgaaacncgaccggtagagggtccgaacggaacgtaccgacggtacgtacgttaactactaccggttagcgggaacgtacggaagttaccgttaccgttacggtcctttaaccggttcgtttaccgtttaggaacccttccggg

SEQ ID NO: 46560 - DNA, 779 bp, Homo sapiens
  misc_feature: GYAE6OF02FIS6U.27.57.F02.1.454.CMB.1.raw
  modified_base (771)..(771): a, c, t, g, unknown or other
  misc_feature (771)..(771): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttattttagaggtgtccagtgtgaggtgcactggtggattcgtgggaggaggtgtcggtccagtccgtggagaactccctgacgtacctctcctgtcgccagcctcgtggtacttccttaactttagttacgtttagtggattgagtcgttcgggtacccgcctagacctccggaaggggaacggggtctagggtacgtttccggtacggacccctaaaagaacgtaaaaaccgaacggtaaggtacggggtaaaacggttaaaaacgtaaaaacgttcgttaacgggttaacggaactttaccggtaagggttaaacgggaaaccggggttacccgtaacgtttacccgaaacccgtacgtttaacccttaccggaaacggtaacggaaaacccgtaaacccgggaacccgtaaaaagggaaccggttaactaaccgttaacggtttaaccgttgtaaccgaaacgtaaagttacggaaaccctacggaccgttaaggacggaacggtacccgggtaaccgacgtaacgggctttaagggtacttacgtagtacggtgacggaacgtacgacgtaccgttgaccttcgttacgttcgtttancgttccgg

SEQ ID NO: 46561 - DNA, 730 bp, Homo sapiens
  misc_feature: GYAE6OF02F4BRT.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggaaccacatggaactggggctgagctgggtttcttgttgctatttagaaggtgtccagtgtgaggtgcaactggtggattctgggaggaggtgtggtccagcctggagaactccgtgacgtactcctcctgtgccagccctctggtactctacctttagtacgtttattggattgagtcgtcggggtccgtccgtaaggacctcccgaaggggggtaacggggcgttagggagtttcggtcggaccaaacaacttaaaaccgaagtacgtagggaaacggtaaaagaaaacttagtagacgggtaacttcgtaggtacggaagggtcctaagttccaccgtacgttaccctccgaaggacgaaccgtaaaccggaaccgtaaaaggtaacgttaccgtaaccgttacgtaaaccgttcttacgaacgtaaaactacggaaaccttacggacccgtaagggaacgaccgggtaaccgggaacggaaccggcgtaacggttcgtaaacgttaccttacgtacgggttcggaaccgtaaggaaccgtatttaacccgtaggtacctttacccgtttaccggttacgttttttacgacttttacccggg

SEQ ID NO: 46562 - DNA, 674 bp, Homo sapiens
  misc_feature: GYAE6OF02F3LKV.27.57.F02.1.454.CMB.1.raw
  modified_base (183)..(183): a, c, t, g, unknown or other
  misc_feature (183)..(183): n is a, c, g, or t
  modified_base (664)..(664): a, c, t, g, unknown or other
  misc_feature (664)..(664): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgcttattttagaaggtntccagtgtgaggtgcaacgtgggtggattcgtgggaggacggttgtcggtccagcctggagaactccctgacgactctcctgtcgcagccctgtcggtattacctaccgtttagtagttagttggatggagtcgtcggggtcccgactacgacctccggaagggggaacgggtccgtgggtagttccggcggaacctaacaacgtaaaaccaagaagtcgggaaaaggtaaaacgtaaaacttagtacggtggtacttcgtgtaggaacggtccagttccaccgtactcctaccaggtaacaaccgaaccgacgaaagactcctaagttgtacttctaagactaaacgtcgaactagtcctaggagacggaccggaacggaacgaccgtcgttagtaaccttacgtaacggtggaccggaacgacgggtataaccggttacccttaggtcctttaaccgtttcccggttatttttacccgngttacccggg

SEQ ID NO: 46563 - DNA, 775 bp, Homo sapiens
  misc_feature: GYAE6OF02HIZKM.27.57.F02.1.454.CMB.1.raw
  modified_base (215)..(215): a, c, t, g, unknown or other
  misc_feature (215)..(215): n is a, c, g, or t
  modified_base (736)..(736): a, c, t, g, unknown or other
  misc_feature (736)..(736): n is a, c, g, or t
tcagagcgtcgtctcacgaccggtgctcgatttagctcgatatagttgggtttgaggtctcagagaggagccttagccctggactccaagcctttcacttggtgatcagcacggagcacagacggacccacatggaactggggctgagcttgggttttcctgttgacttattttagaaggtgtccagtgtgaggtgacaacgtggtggtattcgngggagggaggtcggttcggtacccaggtcccttgggaacgaacttccccgtggacgtacctccgttccgtggtgcctaacgtccttcgtaggtacttccgtaaccgtttagttacgttagttagggtataggacgtcggttcggggtcccacgacggtaccctccgggaaggggaggggtcctagggtacggttcggtacgggaacccaaactaaaactaaaccggaaagaggttaacgggaaaacggtaaaaacgtaaaacgttgtacgggaagtaccgttacgtacgggtaagggaaaccggtccgttaactttaccggaaccctagttaccgtaaccgtaaggaaaccgaaaccgaaacctaacggaaacggtacgtaacctaacgttagtaacttcgaagtaaacgaaacgtacggaaaaccgtcggaaccgttggaaacggtcgggaaccggtacggaaacccggtcgggacttagaacccttacgtacggttccggtcgacggaagccgttaacnccgttaagtcctcgttacggtttctttaggccttacggg

SEQ ID NO: 46564 - DNA, 1006 bp, Homo sapiens
  misc_feature: GYAE6OF02FWTTQ.27.57.F02.1.454.CMB.1.raw
  modified_base (218)..(218): a, c, t, g, unknown or other
  misc_feature (218)..(218): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgcttattttagaaggtgtccagtgtgaggtgcaactggtggattctgggaggnggtgtggtccagccgtggagaactcccgtagacgactcctcctagtgcacgcctcgtggtacttccttaacccttttaggtaagtttagttggtacgtaggtacgtccggttcggggtccccgccgtaaccggaaccctccggaacggggggaacgggggccgttagggggtacgggtttccggtcggggacccctaaaaccgtaacgttaaaaaccccgaaacggtacggtaacgggggtaaaagggttaaaaacgaaaaaaccggtttaggttaacgggtacgggtaaccttaccggttagggttaacgggaaacggggggtccccgtaacgtttacccgaaacccgttaacgtttccccgttaaccccgaaagggttaaacccggaaaccccgaaaacccgggttaacccccgaaaaacgggtaaaacccggtttaaccgtaaacccggtttaacggttaaacccgtttttacccgggttaaaccggtaaaccgttaaaaacgttaccgggaaaaaccccggtaccggttacccggttaacggggaaacccggggaaccgggtaaccccgggggaaaacccggggtaacccggtaacccggggaaacccgtttaccggggttttaaaacctttaacccggtttaaccggttaccggggtttacgggaacccgggtaaacgggttaaccggtaacccgttttaacccggtaaccggtttacccgtttaacccggtttttaccccgggttttacgttttttaaccgggaacctttttacccccgggg

SEQ ID NO: 46565 - DNA, 951 bp, Homo sapiens
  misc_feature: GYAE6OF02F3DTH.27.57.F02.1.454.CMB.1.raw
tcagagcgtcgtctcacgaccggtgctcgatttagctcgatatagttgggtttgaggtctcagagtaggagccttagccctggactccaaggcctttccacttggtgatcagcacggagcacagaggacccacatggaactggggctgagctgggtttctgtgctatttagagtgtccagtgtgaggtgcaacgtggtggacttctggaggtagggtgtcgggtccacggtccgtgggaagtaacttccccgtggaaccggtaccttaccgttcccgtgggttcgaccacggtaccccttcggttaacgggactttaccgtaaaccccgttttaaggttacggtttacgtttgggtaacttggaacggtcgttcgggggtccccgtaccaacgggtaccctaccggaaggggggtaacggggtctacggggtaacgttcggtacggaacccaaacgaaaccttaaaaccgaaggtacgtaacggggtaaacggtaaaaacggtaaaaactttcgttaacggtaacgggtaacttcggtttacgggtaacgggtaaaccgggtaccccgggtttaaattacccgtaaccccgtaacggttacccctttaaacccggaacgggttaaacccgtaaaacccgaaaacccgggtaaacccgtaaaaaggttaaacccggtaccgttaaaccgttttaacggttaaaccgttacgttaaaccggtaaccgtaaaaaggtttacccggaaaaaccggttaacccggtaacccgttaaggggaaacccaacggggttaacccgggaaaccggtaacccgtaaccggtaccggttttaagaacccgtttaacgttaccgggtacggtttaacgggaaccgaagggttaccgtaaccgtttacccgttaaacggtccttaaaccggtttcccgttaacgttttacgaaccgtttccgggg

SEQ ID NO: 46566 - DNA, 795 bp, Homo sapiens
  misc_feature: GYAE6OF02HEVDJ.27.57.F02.1.454.CMB.1.raw
  modified_base (208)..(208): a, c, t, g, unknown or other
  misc_feature (208)..(208): n is a, c, g, or t
tcagagcgtcgtctcacgaccggtgctcgatttagctcgatatagttgggtttgaggtctcagagaggagccttagccctggactccgaaggcctttccacttggtgagtcagcacggagcacagaggacccacatggaactgggctggagcgtgggttttcctgttgctatttagagtgtccagtgtgagtgcacgtggtgattcgnggaggaggtgtggtccaggcctggacgaatccctagagacttctccgtagtgctaggtcctacgtcggacttcctacctttagtagtttagttcggaatggagaccgttgggtacccgccgaacggtaccttacccggaagggggtaaccggggtctaggggtacgtttacggtacggtacccctaaaacgaacgttaaaaacccgaaggtaccgttaagggaaacgggttaaaacgaaaaacgttagtacggttaacggactttacgtggttaacggaaagggtccccgtaatttcccgaaccgtacgttacctaacccgaggtaaccgtaaaccgaaccgacccgaaaggtaaccgtacgaacgttacgttaactcgtaacgaactaaagtacggtaaacgacgtaccggtacggaacgtaacggacccgggtaacgggtacccgaacgggtaccgttaacgttaacgttaccgttaccggttacggtaacggtaccggaacgggttaaccgtaaccgtttaccggttaaccgttaccgtacccgtttttacccgggtacgttttttaccgacgttttacccggg

SEQ ID NO: 46567 - DNA, 838 bp, Homo sapiens
  misc_feature: GYAE6OF02H2LW9.27.57.F02.1.454.CMB.1.raw
  modified_base (187)..(187): a, c, t, g, unknown or other
  misc_feature (187)..(187): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgtggtttctgtgctatttagaggtgtcagtgtgaggtncacgtggtggtattcgtgggaggtaggtgtcggtccacgccgtggacgaactcccgtagacgaccttcgtcccgtgtcgcaacggtcctcggtaggtacttaccgtaacctttaggttacgtttagttaggagttaggagtccgtcggggtcccaccggaagaccgttacggaacgggggaacgggcgttggggtaacgttccgggaccggaaccctaaacgtaaaacttaaaacccggaaagtacgggttaaagggaaaacgggttaaaaacgaaaaacgtttaggttaacgggtaacggttaaccttagttaaagggggtaaccggggtaacgggtacccgttaacgttaccctaacccgacgtttaaccccggtaacgtaaaaggacccggaaaacccgtaaaccgaaaccggaaaacggtaacgtaccgttaacctaagggttaccttaccgtaacggaaacttaaacgggaaccggtaaacacccgggtacgttacggaacgggaacccgacggggtaaaccgacccggtacggtaacgtaacgttaccttaaggttaccgacgggtacgtaaccgggtagaacgtaaccgttccggttaaagtccgttaccggttttacccgtttattaccgtcgtttacccggg

SEQ ID NO: 46568 - DNA, 954 bp, Homo sapiens
  misc_feature: GYAE6OF02G72Y6.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggtttccttgttgcttattttagaaggtgtccagtgtgaggtgcaacgtggtggattctggaggaggtgtggtccagcctggagaactccctagacgctctcctggtcgcacggccttcgtgggtactttacctaaccgttttaggtaacgtttagttaggagttaggacgtcggttcggggttccccgaccgaacggtaaccgttcccgggaagggggtaaccggggtcgttagggtaacggttttccggtacgggacccctaaaacgtaaactaaaaacccgtaaaggtaagttaggggtaaaaaacgggttaaaaaacggtaaaaaaccgtttggtaacggttaacgggtaaccttccgggtttaaggggtaaccgggtaaaccgggggtcccgttaacgtttaccccgaaacccgttactttaccccgttaacccggaaacgggtaaaccggaaacccgtaaaacccggtaaacccgtaaaaagggttaaaccccggttaccgttaaaccggtttaacgtttaaccggttaaccgtaacgtaaaaccgttaaaaaccgggttaccgggaaactaaaccgggttcccgggtaaacggtaaacggggacccgggtaaaccgggaacgggtacccggtaaaaccgggttctttaaacgggttacccgtttaaccgttacgggttacggggtaacgtaaccggggtaaacggtaacgttacccggtttaccggttaaacgttaaccccggttacggttttttcccccggtttaggttttttaccgtaccggtttaccccggg

SEQ ID NO: 46569 - DNA, 748 bp, Homo sapiens
  misc_feature: GYAE6OF02HT6IK.27.57.F02.1.454.CMB.1.raw
  modified_base (551)..(551): a, c, t, g, unknown or other
  misc_feature (551)..(551): n is a, c, g, or t
  modified_base (599)..(599): a, c, t, g, unknown or other
  misc_feature (599)..(599): n is a, c, g, or t
  modified_base (618)..(618): a, c, t, g, unknown or other
  misc_feature (618)..(618): n is a, c, g, or t
  modified_base (626)..(626): a, c, t, g, unknown or other
  misc_feature (626)..(626): n is a, c, g, or t
  modified_base (653)..(653): a, c, t, g, unknown or other
  misc_feature (653)..(653): n is a, c, g, or t
  modified_base (676)..(676): a, c, t, g, unknown or other
  misc_feature (676)..(676): n is a, c, g, or t
  modified_base (737)..(737): a, c, t, g, unknown or other
  misc_feature (737)..(737): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttcctgtgctattttagaggtgtcagtgtgaggtgctaacgtggtagtattcgtagggaggaggtgtggtccaggccgtggaacgaactcccgtagacgtaccttccgtccgttggtcgccgtacggtccctcggttggtacttccgtaaccgttttaaggtagtttacgtggtaatggtacgtccggtcgggtccccaccgtaaggtacccttacggaaggggtaacgggtccgtgggtaaccgtttcgggtccggacccgtaaaacgtaaacgttaaaaccgaagtagggtaaacgggtaaaaggtaaaacgtaaaacgttagtcggtaacgtacgttccgtaggtaaggggaccggtacgtacgttacaaccgtatttcccgaacggtaaanaccggtaaaccaacggtaaccaaaagtacgttacaagttagtttacgnttacggaaacctaaaggtnaaacccgngtccaaggaacgcgaccgaacgggacnccggtgttaactacgtaaccgtnttacggcggacgtagtacgtaaacccttcgggaacttccggtacgtttcccggtagtttanccgtttaccgg

SEQ ID NO: 46570 - DNA, 736 bp, Homo sapiens
  misc_feature: GYAE6OF02H6ZFO.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagctgggtttttccttgttgctattttagaaggtgtccagtgtgaggtgcaactggtggattcgtggaggaggttgtggtccagccgtggaagaactccctagacgtacctctcctgtgcacgtcctcgtggacttccgtacctttaagtacgtttaatggtatgagtccgtcgggtcccgcgtagaccgtccggaaggggagggtcgtagggtacgttcggtcggaacctaaacaacgtaaaaccaaggtaagtagggaaaggtaaaaacgtaaacttagtaggtacggtaacttcgtaggtacgggaacgggtacccgttaattacccgacccgtaagtttcccgaaccgaacggaaacgaaacccgaaaccggtacccgtaaacggtaaacgttaccctaaaggtttcgttaccgttacgtacgtaacgtaaaagtaccggaaaccgtacggtaccgtaaggaaccgtacgggaacccgggttaacgacgtacggtactaggttaactacgttacgtggtacgacgtaagtacgtactttaccgacggttacttaccgtttcccggttacttttgacctttcgg

SEQ ID NO: 46571 - DNA, 728 bp, Homo sapiens
  misc_feature: GYAE6OF02GJCFQ.27.57.F02.1.454.CMB.1.raw
  modified_base (178)..(178): a, c, t, g, unknown or other
  misc_feature (178)..(178): n is a, c, g, or t
  modified_base (316)..(316): a, c, t, g, unknown or other
  misc_feature (316)..(316): n is a, c, g, or t
  modified_base (559)..(559): a, c, t, g, unknown or other
  misc_feature (559)..(559): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggttttccttgtgctatttagaggtntccagtgtgagtgcaacgtggtggattcgtggaggaggtgtcggtccagccgtaggagaactcccgtagagtactcctacctgtgcagccttcgtggtattcctacctttagtagttatggatgagtcgtcgggtccnccagacctccggaggggaacgggtcgtagggtacgttcggtaggacccaaataacgtaaaaccgaagtacgtagggtaaacggtaaaagaaaacttagtacgtaacggacttcggtaggtagggaacgggtcccgtaagttaccgaacctactccaccgaagtacgaacccgaaacgacccgtaaaaggaaccgttcaaacgttcgttaacgttacgtacggaacctaaagtacggaaaccgngtacccggtaggaaggtacccggaccgggtaaacggaccgaaccgggagttaaccggttaacttacgttaccgttacgggtaacgtacccggaagggttaacccttacggtaccgttacgttacccttccgttttaacccggttccgttttttagacccgtttcccggg

SEQ ID NO: 46572 - DNA, 767 bp, Homo sapiens
  misc_feature: GYAE6OF02F2FZ7.27.57.F02.1.454.CMB.1.raw
  modified_base (118)..(118): a, c, t, g, unknown or other
  misc_feature (118)..(118): n is a, c, g, or t
  modified_base (169)..(169): a, c, t, g, unknown or other
  misc_feature (169)..(169): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (683)..(683): a, c, t, g, unknown or other
  misc_feature (683)..(683): n is a, c, g, or t
tcagagcgtcgtctcacgaccggtgctcgatttagctcgatatagttgggtttgaggtctcagagaggagccttagccctggactccaaggcctttccacttggtgatcagcacggancacagaggacccaccatggaactggggctgagcgtgggttttcctgttagntattttagaggtgtcagtgtgngtgnactggngtattcnggagtaggtgtggtccagcctggganaactccgtgacgacttcctcgttgagtcgacgtcctgtaggtctaccgttacctttagttagtttaacgttggtaatggtaacgtggtccggggttcccgaccgtaacgtaccgtaccggaagggggtaaacggggtcccgtaagggttacggtccggttagggaccctaaacgtaaacttaaaaccggaaagtaaggtacgggaaacgggtaaaaagtaaaaacgttagtacggtaacgggacttaacggtagtagggaaacggtcccgtaaattccgaacctaatccgtacggagtaaacaacgtaacccggaacaaagacgtacctacgttaacggtaactacgtaacggaataaacgttaaccgaacgtaacccgaggtacgaaacgacgggtaccgaaccgggaaccttaccgggtacttagggtaaaccttacgtttaaccgngttaccggaacaacgggtaattaccgtaaccgttaccgaacctttcccgggttacttttaaccggtttcgtaaagtttacccgg

SEQ ID NO: 46573 - DNA, 904 bp, Homo sapiens
  misc_feature: GYAE6OF02H7UQ5.27.57.F02.1.454.CMB.1.raw
  modified_base (119)..(119): a, c, t, g, unknown or other
  misc_feature (119)..(119): n is a, c, g, or t
tcagagcgtcgtctcacgaccggtgctcgatttagctcgatatagttgggtttgaggtctcagagaggagccttagccctggactccaaggcctttccacgttggtgatcagcacggancacagaggacccacgatggaactggggctggagcgttgggtttttaccttgttcgcttattttacgaaggttgtaccaggtgttagaggttgctaacgtggtggtattcgtagggaggtaacgggttgtcggtaccctaggcccgtggacgaaccttccgtagacgactcctccgtgtcgacaccgtcctgtacggtactttacctacgtttaagtagttttactggagtagtacgtcgtaccgggtccgtaccacggtaccgtccgggaaggggtaacggggtcgttacggggtacggtttcggtaccggaaccaaaccggtaaaactaaaaccgggaacgttagggttaacggaaaagggtaaaacgttaaaacggtttaggtacggttaacggacctttagtaggggttaacggtaaaacccggggggtccctttaaaccgtttacccgaacccgtaccgttccgtaaacccggtacgaaccgggaaaacccctacggaaacccgtaaagtaacccgtaccgttaaaccggttaccgtacgttaacgtaaaccgtaacgttaacggaacccgttaacggtaccgttaacggaaccggtaccgggaacccggaacgggtaaccgttaacgggtaccctaaaccggtttactaccgtttaaccggttcgggtaacggaacggttacggtaaaccggttaaccgttacccgttaaccggtttaccgtttaaccgttttcccgtttaccgtttttacggtaacccgtttccgggttaaacccgggg

SEQ ID NO: 46574 - DNA, 562 bp, Homo sapiens
  misc_feature: GYAE6OF02GMRH5.27.57.F02.1.454.CMB.1.raw
  modified_base (307)..(307): a, c, t, g, unknown or other
  misc_feature (307)..(307): n is a, c, g, or t
  modified_base (334)..(334): a, c, t, g, unknown or other
  misc_feature (334)..(334): n is a, c, g, or t
  modified_base (420)..(420): a, c, t, g, unknown or other
  misc_feature (420)..(420): n is a, c, g, or t
  modified_base (462)..(462): a, c, t, g, unknown or other
  misc_feature (462)..(462): n is a, c, g, or t
  modified_base (488)..(488): a, c, t, g, unknown or other
  misc_feature (488)..(488): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttcctgttgctattttagaggtgtccagtgtgaggtgcaactggtggattcgtgggaggaggtgtggtccagcctggagaactccctgagactctcctgtcgcagcctctggattctacctttagtagttattggatgagcgtggggtccnccagacctccgaggggaaggggctggngttcgtggaccagataaaccagatagggaagtaaacgaaactagtagtcggaactcgtgtaggaacggccgtattccacctatccncagagacaaccgcaagaagtcatatatcagacaatacgaacncgctagacgaggccgaggaccacggntagttatactacgtgtggaccgtagacggtactaccgttacgttagtacctttccggtcttttaggacttccgg

SEQ ID NO: 46575 - DNA, 862 bp, Homo sapiens
  misc_feature: GYAE6OF02H2DOE.27.57.F02.1.454.CMB.1.raw
  modified_base (183)..(183): a, c, t, g, unknown or other
  misc_feature (183)..(183): n is a, c, g, or t
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
  modified_base (810)..(810): a, c, t, g, unknown or other
  misc_feature (810)..(810): n is a, c, g, or t
tcagagcgtcgtctcacgaccggtgctcgatttagctcgatatagttgggtttgaggtctcagagaggagccttagccctggactccaaggcctttccacttggtgatcagcacggagcacagagacccacatggaactggggctgagtcttgggttttccttgttgcttattttagaggttntcagtgtgaggtncaactggtgacttcgagggaggacggttgtacggtccacgccgtaggagaactcccgtgacgtacctctaccgtgtnacgacgtcccttgtacggtactttaccgtaaccgttttagtaacgttttaagttggtacgttaggtacggtcggttccggggtaccctaccgaaggtaccccgttacgggaacggggggtaacgggtccgttaaggggttacggttaccggtccggtaacccctaaaaagtaaaaccgtaaaaacccggaagtaacggttagggggaaaaaccggttaaaaaaagtaaccgtaaggtttacgggtacgtaaccttccggtttaagggtaacggggtaaacgggtaaccctttaacgtttaccaaaccgtaccgtttacctaaacccccgggaagaaacccggtaaaaccctaaaccggaaccggtaaaaacggtaccgtaaccccggttaatttagggtaaccttacgttaaccgaaagttaaaacgtaccgaaacttaccggccgtaaacggaggaacccggagaaccggttccaaacgggttaccctaagtaccgttacggttcgaaggggctaacgtcgtaattaaccccggtnttaaccgtccggtttaccgtttccttttaggaaccgtttcgtaacccggggg

SEQ ID NO: 46576 - DNA, 759 bp, Homo sapiens
  misc_feature: GYAE6OF02JP8IJ.27.57.F02.1.454.CMB.1.raw
tcagagcgtcgtctcacgaccggtgctcgatttagctcgatatagttgggtttgaggtctcagagaggagccttagccctggactccaaggccttccacttggtgatcagcacggagcacagaggacccacatggaactggggctgagcgtgggttttccttgttgctattttagaaggtgtcagtgtgaggtgcaactggtggattctggaggaggtgtaggtccagcctaggagaatcccgtgacgtactcctcctgtgccagtcctcgtggtacttactaccgtttagtagttagttggagtacggtacgtacggtccggggtccgtaccgtaccggtaccgtacccggaggggtaacgggggtcgtacggggttacgttcgggttaccggaccgtaaaccgtaaacttaaaacccggaaaggtaagtagggaaaacggtaaaagtaaaccgtttaagtaacggtacggtaaccttacggtaggtaaggtaaccggggtcgttacgtacaccgtacgttacctaccgaacggtacgaaaccgtaacgaacgaaaccggtaacgtactaccgtacgttacgttcgtagaaccttaagaacgtacgaacgtaccgtacggaagtaaccggtaccggaacgggtaaccgtaaccggtgtacgttaacgtcgttaccggacgtaacggtccgaacggtcggtacccgttaacgtcgtttaacgtcccgtttacccgtttcgtttaccgttacttcccggg

SEQ ID NO: 46577 - DNA, 678 bp, Homo sapiens
  misc_feature: GYAE6OF02HDWG9.27.57.F02.1.454.CMB.1.raw
  modified_base (264)..(264): a, c, t, g, unknown or other
  misc_feature (264)..(264): n is a, c, g, or t
  modified_base (309)..(309): a, c, t, g, unknown or other
  misc_feature (309)..(309): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctntggtattcctacctttagtagtttatggatgagtcgtcgggtccnccagacctcgaaggggaagggcgtgggagtttcggcggaccaactataaaaccgaagtacgtagggaaggtaaaacgaaaacgttataggtacggtaaccttcgtaggtaggaaacggggtcccgtaagtttaccgaaccctattaccctaacccgaaaggtaaccgaaacccgaaaccggaacccgaaaagggtaacgtaccgtaacgtttacggtaaactccgttagaaactaaagtcggaaacacggtacctaggacgacggaccgacggaacgaccggtctagtaacctacgtacgtggtacgacgaagtacgtacgttcgaagttccgtaactttcccggttacgtttttagaccgtttaccgg

SEQ ID NO: 46578 - DNA, 641 bp, Homo sapiens
  misc_feature: GYAE6OF02JDOUU.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaggtgtccagtgtgaggtgcaacgtggtggattctggaggaggtgtggtccagcctggagaatccctgagactctcctgtgcagcctctggattcacctttagtagttattggattgagcgtggggtccgcgagactccgaaggggaacggggctaggacggttcggtcggaccaaacgtactaaaccgaagaacgtagggaaggtaaaggaaaactagtacggtggactcgtagtggaacggtcgattacgacctatcccgtcaacggagaccgtaacgacccgaaagtaaacgtcgtacgttagtacgttacctgggaacctaaagtacgaaacgacggtacccgtaggaaggacgtaccgggacggaaccgtcgggaactgggttaactacgttaacgtgtacggacggtaaggagtaacgtccgtacgttctacgttacccgtttcgtttagaccgttccgg

SEQ ID NO: 46579 - DNA, 711 bp, Homo sapiens
  misc_feature: GYAE6OF02G16XE.27.57.F02.1.454.CMB.1.raw
  modified_base (178)..(178): a, c, t, g, unknown or other
  misc_feature (178)..(178): n is a, c, g, or t
  modified_base (337)..(337): a, c, t, g, unknown or other
  misc_feature (337)..(337): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
  modified_base (573)..(573): a, c, t, g, unknown or other
  misc_feature (573)..(573): n is a, c, g, or t
  modified_base (649)..(649): a, c, t, g, unknown or other
  misc_feature (649)..(649): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactgggctgagctggtttcctgttgcttatttagaggtntccagtgtgaggtgcaacgtggtggtattcgtggaggaggtgtcggtccacggccgtggagtactcccgtagacgactcgtcctggtcgactacgtccctgtggtacttcctaaccgttttaggtacgtttaagttggactggacgtcggtcgggtccncgacggtacctaccggaggggggaacggtcgtagggtaccgtttggaccgtaccaaaacgtaacgtaaaacccgaaggtaacggtagggtaaaacggtaaaacgtaaaacgtaggtacggtacgtacttacgtacggttagggaaccgggtccgtaaccgttacacccgtactccgtaccgagaacgtaccaaacgacgtaaagtacgtcattacgtactcctntaaanaaacgtnaactcgacctagggacgtaacgccgggtaagaccggtcggaccttagaaccttacgtcgtaggttcggaaggtaanccggttaactacccgttaacgtcccgtttagtcccccgtttaggtttaaccgtccgtacggg

SEQ ID NO: 46580 - DNA, 735 bp, Homo sapiens
  misc_feature: GYAE6OF02HQDYD.27.57.F02.1.454.CMB.1.raw
  modified_base (179)..(179): a, c, t, g, unknown or other
  misc_feature (179)..(179): n is a, c, g, or t
  modified_base (367)..(367): a, c, t, g, unknown or other
  misc_feature (367)..(367): n is a, c, g, or t
  modified_base (609)..(609): a, c, t, g, unknown or other
  misc_feature (609)..(609): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaaccaccatggaactggggctgagctgggttttcctgttgctatttagaggtntccagtgtgaggtgacaacgtgggtggattcgtgggaggtaggtgtacggtccgagtccctagggaggtaactccccgtaggaacgtcctcgttacctggttcgacctacggtccctgtacgggtattcccgtaaccgttttaaggtatttacgtagggtacgttgaacggtcgtcgggggttacccncgtaacggtacccgtaccgaagggggtaacggggcttagggacggtttccggcggaaccctaaagacgttaaaaccgaaggtacgtaggggtaaaggttaaaaacgaaactacggttagggtacggtaaactgttacggggtaaacggtaccggggtacctacgttacctaacgtaccgtccgtacgagaacgtaacgaccgaacgagtaacgtactagttactactacgtataaccgtaanacgaacgaagtccgtacgagtacgtcggaccgtacgaccggtcgtaacgttactacgtgttacggtacgagtagtaagtccgtagttaactcgttacgttcccggttacgtttcggaaccttcggg

SEQ ID NO: 46581 - DNA, 799 bp, Homo sapiens
  misc_feature: GYAE6OF02IUY0D.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcgtgggttttcctgttgcttatttagaggtgtccagtgtgaggtgcatggtgattcgtgggaggaggtgtggtccagtccgtaggagtaactcccgtgacgtacctcgttcctgtcgctacgtccttcgtaggtacttactacctttagtacgttatggtactggtagcgttacgggcctcgacgtactaccggagggtagggcgtaggtacgttcggtacggacctaagaacgtaaacccgaagtagtaagggtaaacggtaaaaacgtaaaacgttagttacgggtaacgtaacgtcggtaggtaaccgggaacgggggtaccttaaccgttaccgaaccttaccgttacccgtaaacggaacgggtaaaccaaacgaaaccccggtaaccgaaaaggtaacgacccgtttaacggttaagtaaccgttccgtagggtaaacctaaaaggtaccggtaaaaccacggggttacccggttaaaaggaccgggaaccggtaacccgggtaaaccggtaaccggtaaccgggttacgtaaccgggtttaactacccgttggtaaccggtcggaacgtacggtaagttacccgttaaccgtacgtttccgtaaccggtttcccttacgggttttacaccggtttaccggg

SEQ ID NO: 46582 - DNA, 873 bp, Homo sapiens
  misc_feature: GYAE6OF02G63KO.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaactccctgagactctcctgtcgcacgtcctcgtggtactttccttacctttaggttaagtttagttggtataggacgtcggttcgggtcccgacctaacggtacccgtaccggaaggggggaacggggtcgttagggtaacggtttcggtacgggaacccaaaaccgtaacgtaaaaacccgaaaggtaacggtaaaggggtaaaacgggtaaaaaaggtaaaaacgttaagttacgggtaacggtaacgttaccgttaggggttaaacggggtaaaccggggtcccgttaacgtttacccgtaaacccgttaacgtttccccttaaccccggaaaaggtaaccgaaacccggtaaaacccggaaaccgtaaaacggtaaaccggttaccctaacggttacggtaaccttacgacgtaaaacgaaagttaaccgaaaccgtaccggtacgtacggtaaacggtaccgaaccgggaagggaacccgtccgggtaacggttaagtacctttaacccgggttaacgttggggtaaccggtaccggtaaacgggtaacgtaccgttttaacccggtaacggtttaccgtttaacccgttccccggtttttaacttttaccgggtaccgttttacccggg

SEQ ID NO: 46583 - DNA, 659 bp, Homo sapiens
  misc_feature: GYAE6OF02G05BL.27.57.F02.1.454.CMB.1.raw
  modified_base (307)..(307): a, c, t, g, unknown or other
  misc_feature (307)..(307): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgagactctcctgtgcagcctctggtattcactttagtagttattggatgagtcgtcgggtccncagacctccgaggggaacgggctgggtagttcgtgggacccaaacgataaaacccgaaggtagtacgggggtaaagtaaaacgtaaacgttgtaggtacgtacttacgtaggtaacgggaccggtacttacgtaccgaacgtcctaccgacgaacgtaaccgaacctaaccgaacgtaaacgtaccacttacgttcgtactacgacaaagtaacgaacgaacgcgtaggaacgaggtaccgaacggacgaccggtacgtattacgtaactacgtagtcggtacggaacggtacgtaacttaccgttacgtacgttccttaaccggttccttttacgttagccgtttaccggg

SEQ ID NO: 46584 - DNA, 887 bp, Homo sapiens
  misc_feature: GYAE6OF02IYQME.27.57.F02.1.454.CMB.1.raw
  modified_base (217)..(217): a, c, t, g, unknown or other
  misc_feature (217)..(217): n is a, c, g, or t
  modified_base (251)..(251): a, c, t, g, unknown or other
  misc_feature (251)..(251): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagctgggttttcccttgttgcttatttttagaaggttgtcctagtgtgaggtgcaacgtggtggattcgngggaggaggtgtggtccagcctggagaactcccngagactcgtcctgtcgacagcctcgtaggtattactaccctttaaggtagtttaagttggaacttggaacgcgttacgggtcccgaccccggtaagtaccgtccggaaggggaaacggggcgttaccgggtaaggtttccgttaccggggaacccctaaaaacgtaacgtttaaaaaacccgaaaggtaacgttaacgggtaaaagggttaaaaaacgtaaaaaaaccgtttaagtacgggtttaagggtaaaccccgttaccgtttaagggttaaccgggggtaaaaaggggtcccccggtaaaattttacccgggaaacccgtaaacggtttcccttaaacccggaacggtaaaccgggtaaccgtaaaaaccggtaaccccgaaaaggtaaaccggtaccgtaaaccgttacggtttaacgtacccgttaagtaaaccgtaaaacgtaacggtaaaaccgttaaccggtacccgttaagggaaacggttaccggaacccggtaaacggggaaccgtaaccggttaccgagttaaacggtaccttaaccggtggtaaccggacggtaataacgaacgttacccgttcgtaaccgttaccgtttaacccggtcgtttttacggaacctttacggg

SEQ ID NO: 46585 - DNA, 723 bp, Homo sapiens
  misc_feature: GYAE6OF02JYVSQ.27.57.F02.1.454.CMB.1.raw
  modified_base (254)..(254): a, c, t, g, unknown or other
  misc_feature (254)..(254): n is a, c, g, or t
tcagagcgtcgtctcacgaccggtgctcgatttagctcgatatagttgggtttgaggtctcagagaggagccttagccctggactccaaggcctttccacgttggtgatcagcacggagcacagaggacccacatggaactgggctgagcgtgggtttccttgtgctattttagaggtgtccagtgtgaggtgcaacgtggtggacttcgtgggaaggtcggtgtaggttccagtccgtggacgtaactcccgngaacgcttctccgtagtgcacgtcctgtgtacttcgtacctttagtagttacgttggactgacgtgttacgggcctcacggtctacggtaaggggaacgggtctggggtacgttcggacggtacccaagtaacgtaaaaccgaggtacgtaagggtaacggtaaaagtaaaaccgtgttacgggtacggaaccttcggtaggttaacgggaaccggggtcttaaccttaccggaacgtacctaccgttaccgaaacggtacggaaccgtaaaccgaccgtaaagggtaaccttaccgaacgttacgtacgttaccggaactaacgtaacgttaaccgaacgttcgaccgtacggtaacgacgcgggaaacgttcgacgggtacctagtacgtacgtcgttacggcgtaagtcgaagttaccgtacttacggtaccgttacgttaccggtttactttagacccgttacgg

SEQ ID NO: 46586 - DNA, 768 bp, Homo sapiens
  misc_feature: GYAE6OF02IMV5B.27.57.F02.1.454.CMB.1.raw
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttccttgttgctattttagaaggtgtccagtgtgaggtgacaacgtggtggattcgtgggaggaggtgtggtcagccgtgganaatcccngagctctccgtgtcgcacgtcctcgtaggtacttcctacctttaaggttagtttagttagggaatggtacgtcgttacggggtcccgaccgtacgtacctaccgggaaggggtaacgggggtcgtaggggtacggtttccgggtacggaacccgtaaacaaaccgtaaaaccgaaggtagtaaggggaaacggttaaaaacgaaaacgttagtacggtacggtaccgttcgtaggtaacgggaacgggtaccgtacgtttaccgaacccgtacgtcccgtaaccgaagggtaaccggaacccgtaaaaccggtaaccgtaaaacgggtaacgttaaccgaccgtttaggttaacctcggtagtaaaccgtaaaagtccgaaacgaccgacggtaagaacgtaccggccggaaggacctcggtacgttagtaactaccgttagtcggtaacgacgacgtaacgttaacgttcccgagtttccgtaaccgtttaccgtttacggtttacgaccctttacggg

SEQ ID NO: 46587 - DNA, 680 bp, Homo sapiens
  misc_feature: GYAE6OF02I63PG.27.57.F02.1.454.CMB.1.raw
tcagagcgtcgtctcacgaccggtgctcgatttagctcgatatagttgggtttgagggtctcagagaggagccttagccctggactccaaggccctttccacttggtgatcagcacggagcacagaggacccaccatggaactggggctgagctgggttttcctgttgctattttagaggtgtccagtgtgaggtgcaactggtggattcgtgggaggaggtgtgggtccagcctggaagtaactccctgacgacctctcctgtgcagcctcgtgtacttctacctttagtagttattggatgacgcgtcgggccgccacgactccggaaggggacgggctaggtcgttcggaggacccaacaactaaaaccgaaggtagtaagggaaacggtaaaacgtaaaactagtaggtaacggtacctcggtaggttacgggaaacgggtccgtaagttcccaaccgtacgtcctaccgaaggaaccgacccgtaaaccggaccgtaaaacgacgtacctaaccgttagtaccttcgtaacgtaaccgtaaagtaccgaaactacggaccgtagaacggacgaccggaacgacgaccggtactacgtaagtaccgttagtcggtaggacggaataggtacctaccgtacgttccgtacgtttccggttactttagacgttcccgg

SEQ ID NO: 46588 - DNA, 675 bp, Homo sapiens
  misc_feature: GYAE6OF02GIKQF.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaactccctgacgacctctcctgtgcacgcctctggattctacctttagtagttatggatgacgcgttgggtccgcaggtacctccgaggggaacgggtctagggacgttcggcggaccaacaactaaaaccgaaggtagtaggggaaaggttaaaacgaaaaacgttagtacggtacggaacttcgtagtagggaaacgggccgtacttaccgacctatcctaccgaaggacgaaaccgaaccgaaccgaaagaacgtctaacgttcgtacttcgtacgtaacaaagtcgaaacgtcggaccgtacggtaacggacggacccggtaaagggaccgtacggaccgtttagtaacttaccgtggttaggtcggtacggaaggtaacgtacgttacccgttacggtccttaccgtttccgttacttttacggactttccggg

SEQ ID NO: 46589 - DNA, 822 bp, Homo sapiens
  misc_feature: GYAE6OF02FUAG1.27.57.F02.1.454.CMB.1.raw
tcagagcgtcgtctcacgaccggtgctcgatttagctcgatatagttgggtttgaggtctcagagaggagctttagccctggactccaaggcctttccacttggtgatcagcacggagcacagaggacccaccatggaactgggctgagcgttgggttttccttgttgcttagttttagaaggtgtccaggtgtgaggtgacgacgtgggtcgatttcgagggaggtggtcgtcggccgacgccgtagggaagaacctccccgtagacgtaccttcctccgttacggcggtacctaccgtcccttagtacggtactttacccttaacgtttaagttagttggttagatggacgtcggtacggtcccgacgtaacgccgtacgggaaggggaacgggtctagggcgtttcggacggaaccccaaataaacctaaaaccggaagtacggtaagggaaaacgttaaaaacgtaaacttgggtacggtacggtactacgtagggtaaccggaacggggttccctaacgtccaacgttaccgtacccgtaacgaggtaaacaaccccggaaagtaccaaaagggtaactaccctaacggtttaacgtacgtaaccgttaacgaaaacttaaaggaacccgttaacggtacctaaccggtaaggaaaccccggtccggaaccgggaaacgggtcccgtaaacggtacctttaaacggtaaaccccgtaagtttacccggtgggttaaaacggacccggtaaaggtacccgttaacttccggttaaggtaccctttaccggttacgtttcgtttaagccgttaaccggg

SEQ ID NO: 46590 - DNA, 692 bp, Homo sapiens
  misc_feature: GYAE6OF02HRTMF.27.57.F02.1.454.CMB.1.raw
  modified_base (264)..(264): a, c, t, g, unknown or other
  misc_feature (264)..(264): n is a, c, g, or t
  modified_base (656)..(656): a, c, t, g, unknown or other
  misc_feature (656)..(656): n is a, c, g, or t
tcagagcgtcgtctcacgaccggtgctcgatttagctcgatataggttgggtttgaggtctcagagaggagccttagccctggactccaaggcctttccacttggtgatcagcacggagcacagaggacccacatggaactggggctgagcttgggttttcctgttgcttattttagaggtgtccagtgtgaggtgcaacgtggtggattcgtgggaggaggtgtggtccagtccgtggagaatccctaggacactctcctgtncacgcctctggattacctactttagtagttagttggatggagtcgttcgggcctacaggtcctccggaaggggtacgggtctagggtacggttccggtcgaacccaaataaaccgtaaaacgaaggtacgtaaggggtaaaacggtaaaacgtaaaacttaggtaggtacgtaccgttagtggtaaacggacggggtacctacgtacctaaccgtattccccaacgaacggaacgaaaccgaccgaacgaaaggtaacgcctttacgtaagttactacggtaacaaacgtaaagtaaccgaacgttacgggactacggggaacaacgggtcccgaaggaacccgttaggaccgttaacgttaactacccgttagccggtaaagcggtaaacncgtacgtctagtctactttcggtacttcgtagtcgg

SEQ ID NO: 46591 - DNA, 593 bp, Homo sapiens
  misc_feature: GYAE6OF02FNQQD.27.57.F02.1.454.CMB.1.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (302)..(302): a, c, t, g, unknown or other
  misc_feature (302)..(302): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
  modified_base (575)..(575): a, c, t, g, unknown or other
  misc_feature (575)..(575): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgtgctatttagaggtgtccagtgtgaggtgcaactggtggattctggaggaggtgtggtccagcctggagaatccctganactctcctgtgcagcctntggatctacctttagtagttattggatgagtctgggtcccncgagcctaccgaggggaagggctgggacgtttcgtggccaaacactaaaccaagatagggaagtaaaagaaaactagtagtggaactgtagtggacgggccgattcaccctatcctaccgaagagaacctaacggccaaaggaacgtcactgtaatcctganaaatgaaacngacccgtagaggtagacccggtagaaccgcgctaccgtaataccgttaactggtacggcgaagggtacgaacgttcctaggttcctaacgttttcccggtntttttaccggatttcccg

SEQ ID NO: 46592 - DNA, 656 bp, Homo sapiens
  misc_feature: GYAE6OF02H2WH0.27.57.F02.1.454.CMB.1.raw
  modified_base (271)..(271): a, c, t, g, unknown or other
  misc_feature (271)..(271): n is a, c, g, or t
  modified_base (335)..(335): a, c, t, g, unknown or other
  misc_feature (335)..(335): n is a, c, g, or t
  modified_base (550)..(550): a, c, t, g, unknown or other
  misc_feature (550)..(550): n is a, c, g, or t
  modified_base (582)..(582): a, c, t, g, unknown or other
  misc_feature (582)..(582): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggactggggctgagcttgggttttctgttgcttattttagaaggtgtccagtgtgaggtgcaacgtgggtggattcgtgggaggaggtgtcggtccagccgtggagaacgtccccgtaggagaccttctcctggtcncgacgtccttcgtggtacttcgtaacgtttagtagtttagtggatgtagcggttcggggtcccncgtagtaccgtaccggagggggacgggtctgggtacgttcggtacggacctaaacgtaactaaaccgagtacggtagggaaaaggtaaaacgtaaactagtggtacgtacttcgtaggtacgggaacggtccgtaatacccgactacgtcctacgaaggaacgaaccaacggaacaaggaactccagttactactcgtaacaacaaactgaaccntacggtagacggtacggaccggagcaacggtntacgttactacgtactggtacgacgaagtaactacgtacgtacgtccttaccgttcgtttacttagtccttcgg

SEQ ID NO: 46593 - DNA, 706 bp, Homo sapiens
  misc_feature: GYAE6OF02HJ4BZ.27.57.F02.1.454.CMB.1.raw
  modified_base (518)..(518): a, c, t, g, unknown or other
  misc_feature (518)..(518): n is a, c, g, or t
  modified_base (588)..(588): a, c, t, g, unknown or other
  misc_feature (588)..(588): n is a, c, g, or t
  modified_base (628)..(628): a, c, t, g, unknown or other
  misc_feature (628)..(628): n is a, c, g, or t
tcagagcgtcgtctcacgaccggtgctcgatttagctcgatatagttgggtttggaggtctcagagaggagccttagccctggactccaaggcctttccacttggtgatcagcacggagcacagagacccacatggaactgggctgagctggttttctgtgctatttagaggtgtccagtgtgaggtgcaactggtcgattctggaggaggtgtggtccagcctggaacgtactcccgtgaacgcttactcctggttcgcacgtccttccgtggtactttcctaacgttttaagttaagtttactttgggaattggaacggtccgttccggggtaccccgttaccgaacggtaacctccggaaagggggtaacggggtccgtagggtacgtttccggcggaacccaaacgtaacgtaaaaccaaacggtaagtaggggtaaaggtaaaacaaaaacgttagtgtagggaccctgttaggagtaacgggtaccgtacttaccaaccgtactcgtaaccngaaaccgacaaaccgtacgaaacgtacgtaccaacgttagacgtttacgacaacgtaaacgtaggaaacncgtttacgaggtaaccgacgaacgggtacaaccggtacgngttacaacttcgacggttaggcgtacggagttaacgtcgttacgtacgtactaccgttccgtacgtttagcttaccgg

SEQ ID NO: 46594 - DNA, 776 bp, Homo sapiens
  misc_feature: GYAE6OF02F7KNX.27.57.F02.1.454.CMB.1.raw
  modified_base (715)..(715): a, c, t, g, unknown or other
  misc_feature (715)..(715): n is a, c, g, or t
  modified_base (728)..(728): a, c, t, g, unknown or other
  misc_feature (728)..(728): n is a, c, g, or t
  modified_base (756)..(756): a, c, t, g, unknown or other
  misc_feature (756)..(756): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgctaacgtggtgattctggaggtaggtgtggtcccagccgtgggaacgtaactcccgtgacgtaccttctccgtaggtcgacgacgtccgtaccgtggtacttctacccgtttagtaagtttacgttggattggacgtcgttacggggtcccgacgtacggacccttaccggaagggggaacggggtcgttagggtacggtttccggtacgggtaccctaaaacgaaaccgtaaaacccgaaaggtacggtaggggtaaaaacgggttaaaaaaggtaaaaacccgttaggttacgggtaacggtaacttccgtagggtaacgggaacggggtaacccgtacgtttaacccaccgttaacgttccctacccgaaagaacggttaaacccaaccggaccgaaaacgggtacctaacggtaacttagggttacctcggttaaccgaaacgtaaaacgttgaaaccgtaccggtaccgtaggaaaccggacgtaccccgggaaaggtaaccaccggtacgttanacgttagttacgnggtagacgagttacagtcctgtaccttntccgtttatcggccttacgg

SEQ ID NO: 46595 - DNA, 875 bp, Homo sapiens
  misc_feature: GYAE6OF02H2RQ1.27.57.F02.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccacatggaactggggctgagctgggtttcctgttgctattttagaaggtgtccagtgtgaggtgacaactggtggattcgnggaggaggtcgngggtccaggccgtaggagaacttcccgtagacggactacctccgtggtcgccgaaccggtcctacgtcggtagtttacctaaccgttttaagttaacggtttaatttagggaagtacggtaggtaccggttcgggttaccggacccctaaacggaccgttaccggaacggggggtaacgggtcccgtagggtacggtttcggtacggaaccctaaacgaaacgttaaaaacccgaaagtacggtaagggaaaaggttaaaaagaaaacgtttaacgtagggttacgtaaccgttagttaacgggtagggtaaacggggtaccgttaacgttaaccgtaaacccgttacgtaccgtaacccgtaaggaaccgaaaaccgaacccgaacccggtaaaaagaaccggttacgtaaactttaccggttaaattaccggtaacgttaaacgaaaaccgttaacggaaacccgtaaaggtacccgtacggtaacggggaaaccggtccgggaaacccgggtttaaccaaccgggttaaccgttactaagttaaacccgttacggttaacgacgggtaacggtagtaaccgtacgttaacccggttaccttacggttaaaccccgttttcggtttaccgttttaagaccgtttaccccggg

SEQ ID NO: 46596 - DNA, 858 bp, Homo sapiens
  misc_feature: GYAE6OF02H01NN.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaacgtggggctgagcgttgggttttccttggttgtctattttagaaggttgtccagtgtgaggtcgactaacgtggtaggattcgtgggaggtaggtgtcggtccagtccgtaggacgtaactccccgtggaacgtaccttcgtccgtggtcgcctacggtcccttacgtaggtacttttaccgtaccgttttaaggttaacgttttagttgggtaattccgggtagtccggttaccgggttccccgaccgtaacggtacccgttccgggaaagggggtaacggggtccgttagggtacgtttaccgggtaccggaaacccctaaaacgtaaaaccgttaaaaacccgaaaggtaacggttaaggggtaaaaacggttaaaaaacgtaaaaccgtttaagtcggttacggggtaaccttacgtaggggtaacgggtaacggggtacccgtaactttacccgaactaccgttacctaacgaacggaaaccgtaacccgaacgaaacgtaaggtaactaccgtaccgttaggtacttcggaataaccgtaaagaccgtaacaccggtaccgtaaggaacgaacccggtaccgggaaagcccggtaaacggtccttaagggttaactaccgttaacggtggtaaaccggacgtagggtaaacccgttgtccccgtttaaacgccttttaccgtttaccccgttggtttactacccggtttccggg

SEQ ID NO: 46597 - DNA, 712 bp, Homo sapiens
  misc_feature: GYAE6OF02FU14H.27.57.F02.1.454.CMB.1.raw
  modified_base (224)..(224): a, c, t, g, unknown or other
  misc_feature (224)..(224): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (634)..(634): a, c, t, g, unknown or other
  misc_feature (634)..(634): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccgatagggaacctggggctggagtcgttgggttttccttgtgcttattttaggaggtgtccaggtgtgaggtgactaactggtggattcgngggaggtggtgtggtccagtccgtaggacgaactcccgtgacgtacttctccgtgtcgctagcccttntaggacttcgtaaccgttttagtgtttaagttcgggatcgtacgtcggttcggggtacccnccgaaggtccctaccggaagggggtaacggggcttggggtaacgttcggtcgaacccgtaagaaccgtaaaaccgacgtaggtagggaaacgggttaaagaaaaccttgtacgggttacgacgtccttaggtcggaacgggtcctattacccgactaaccgtcaccgaacggacgtaaacgacccgaacgaaaacgtaactccgaaagtttcgtaactttgtaccgaataaaccgtacggaacaaccgtcgtaaggacgaccgggtaccgacgggtaaccngggttacctacgtacttacgacgtggtacgccgaaggtatactcgttagtcctaagttcccgattttaggcttaccgg

SEQ ID NO: 46598 - DNA, 639 bp, Homo sapiens
  misc_feature: GYAE6OF02IVB7Z.27.57.F02.1.454.CMB.1.raw
  modified_base (176)..(176): a, c, t, g, unknown or other
  misc_feature (176)..(176): n is a, c, g, or t
  modified_base (373)..(373): a, c, t, g, unknown or other
  misc_feature (373)..(373): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctggtttccttgtgctattttagaggtntccagtgtgaggtgcaacgtggtggattcgtggaggaggtgtggtccaggcctaggagaactccctgacgactctcctgtcgcacgcctcgtaggtactttacctaccttttagtagtttattggatgaggtcgtcggggtcccgaccgagtaccgtccggaaggggtacgggctgggtagttcggtggacccaaanaacgtaaaccgaaggagtagggaaaggtaaaagaaacgtagtacggagtactgtaggtaggaacggtccgtattccaacctgtcctaccgaagacgaacaacgacaaagtacgtacacgttgtacttcgagtaacaaagtacgaacgacgccgtaagacgacgaccggaagaaccgacggtcttagtaccttactacgtaggtacgacggaagtactacgttaccgttacgtacgttaccttccggttcttttacgacgtttccgg

SEQ ID NO: 46599 - DNA, 901 bp, Homo sapiens
  misc_feature: GYAE6OF02H8JB0.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctggttttcctgtgctattttagaggtgtcagtgtgaggtgcaacgtgggtggtattccgtgggaggagggttcggtcggtaccacggtccgttagggaacgtaaccgtcccgtaggacttaccttctccgtggtcgcgacgtcctgtaggtccttacgttacgttttaaggttagtttagttggattacggtacgtccgggttcgggtcccaccgacggtaccgtaccggggaacgggggacgggtcgtacgggttacggttcggtaccggaaccgtaaccgtaaacgtaaaccggtaggtaacgggttaacggggtaaaagttaaaaacggtaaactttacggtaggtcggtaccttcgtaagggtaccgggaaacgggtccgtttaaccgtaccgtaccctacgttaccccgtaacggaaacggtaaccgtaaacccgaaacccgaaccggtaaaacggtaccgtttaaccgtaaccgtttaacggttaacttacgtaacgtaaactaaacggtccgaaaccgtaccgggttaaccgagggaaaccggtacgggaaccccgggtaacgggaacccggtaaccggttacgttaacgttaaccgtttaacccgtttacgggtaaccggttggaaacccgggttaaggttaaacccgttaccccgtttaaccggtttaacccgggtttaccgtttaaccccggtttttcccgtttaaacccgggtttttacgacccggtttttaacccgggg

SEQ ID NO: 46600 - DNA, 948 bp, Homo sapiens
  misc_feature: GYAE6OF02H2ORZ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggattctgggaggaggtgtggtccagtccgtaggagaactccctagacgactcctcctgtcgcacgccttcgtggtacttcctaccttttagtagtttagttggtatggtagtccgttcgggtcccgaccgtagacccgtaccggaagggggtaacgggggccgttaggggtaccggtttacgggtaccgggtacccaaaaccgtaaagtaaaaacccgtaaggtaacggttaaaggggtaaaacgggttaaaaaacgtaaaaaccggttagttacggggtaacgggttaaccttacgtttaacggggtaagggtaaaacccggggtacccgtttaacgtttacccgtaacccggttaaccgtttacccgttaacccggaaacggttaacgggaaaaccccgtaaaaccgggtaaccccggtaaaaaacggtaacccggttaacccgtaaccggtttaaacggttaaccgttacccgtttaaaccggaaaaccggttaaaacccgtttaaccgggaaaaaccctaccggggttaaaccccgttaggggtaaacccggggaaccggaccccggggtaaaacggggtaaacccgtacccgggtttaagttaccgttttaaccgtaacccggtttacggtacggtacgggtaacccgggtaaaggtaaccggttaaccgttaacccgttaacggtttaccgtaaccccgtttttccggttaaccgttttttagcccgtttaacccggg

SEQ ID NO: 46601 - DNA, 859 bp, Homo sapiens
  misc_feature: GYAE6OF02H8CE4.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggtttcctgttgctattttagaaggtgtccagtgtgaggtgacaacgtggtaggtatttcgtagggaggggtagggtggtcgggtaccaggccgttagggaagtaaacgttcccctagggaataccttcctccgtaggtcgactaacgtccttacgtacggtaactttacgttaaccgtttaaggttaagttaagtttagggaacgttaaggtaacgtccggttacggggtacccacccggtaacggtaaccgttacccggaaaggggggtaacggggtcgttaacgggtacggtccggtaggaacccctaaaacgaaactaaaacggaaacgtagtaagggaaaagtaaaaacgtaaatacggttagtacggtaccttggtaaggtacgggaacgggtcctaactaccaacccgtagtaccctacgaaaggaacgtaacccgaaacgtaaccgtaaaacggaagttacctaaccgttaggtaacttacggtaacaaacgtaaacgtaagaacccgtaagtacccgtaggaaaccggaccggaaaccgggtaacgaaacccggtccggtaacgttaaggttaaaccttaacccggttacggttaagggtcccgaaacggtaacggtaacgttaacccgtaccgggttttaacctaaccgtttacccgttttaccggtttaaccgtttttaacgacgtttaccccgggg

SEQ ID NO: 46602 - DNA, 754 bp, Homo sapiens
  misc_feature: GYAE6OF02GRRG3.27.57.F02.1.454.CMB.1.raw
  modified_base (738)..(738): a, c, t, g, unknown or other
  misc_feature (738)..(738): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccccaccatggaactggggctgagctgggttttccttgttgctattttagaaggtgtccagtgtgaggtgcaactggtggattctggaggaggtgtggccagcctggagaactccctgacgacctcctccgtgtgcacgcctcgtggtacttcctacgtttagtagttattggatgagtcgtcgggtcccgccgacgaccgtaccggaaggggtagggcgtgggtacggttccggtacggacccaaacgtaacgtaaaacccgaaaggtagtaaggggtaaaacgggtaaaaagtaaaaaaccgttaggtacggtaggtaccttacggttaggtaacggggtaacggggtacccgttaagttacccaacccgttactaccccgttaaccggaaggtaaacccgaaacccgtaaaccggaaacccgtaaaagggtaaccctacggtaaccgtttaggttaacttaccgttagaactaaagtacaaaccggcgtaccgagaacgggtaccgaaccgggacggaaccgtacggtacttagtaaccgttaccgtaggttcggacgggaacggaaggtacgttacctagttacgttacgttcgtttacccggtttnttttacgagtttccgg

SEQ ID NO: 46603 - DNA, 611 bp, Homo sapiens
  misc_feature: GYAE6OF02IT18G.27.57.F02.1.454.CMB.1.raw
  modified_base (126)..(126): a, c, t, g, unknown or other
  misc_feature (126)..(126): n is a, c, g, or t
  modified_base (152)..(152): a, c, t, g, unknown or other
  misc_feature (152)..(152): n is a, c, g, or t
  modified_base (157)..(157): a, c, t, g, unknown or other
  misc_feature (157)..(157): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (545)..(545): a, c, t, g, unknown or other
  misc_feature (545)..(545): n is a, c, g, or t
  modified_base (551)..(551): a, c, t, g, unknown or other
  misc_feature (551)..(551): n is a, c, g, or t
tcagagcgtcgtctcacgaccggtgctcgattttagctcgatatagtttggggtttggagggtctcgagagaggagccttaggccctggactccaaggcctttccacttggtcgatcagccacggngcacagacgacccacatgaactgggntgagntggtttctgttgctatttagagtacgtcagtgtgaggtcgacaacgtggtcggtattgtggacggaggttggtcgtcctagcctaggagacgtcccgtgacgactctcctgtcgctcgtctcgtgtacttaccgtacgttagtagttgttgtagtggacgtcggtacggtaccgtacgacgtaccgacgggaaggggtacggcgtcggtcgtcggtaccgacaactaacgtaacgaagtacgaacggtaaacggtaaacgtaaacgttagtcgtaggtacttcgaggtacggacggtctactacacnctacanaagacacacgacagactcatatatcgacataacgacaagcagagacgcgacgagacacggtactacgtctacgtntacggngaggtactaacgtcttaccgtacgttacgtaccgtttacgttaccgttacggtagtccgg

SEQ ID NO: 46604 - DNA, 841 bp, Homo sapiens
  misc_feature: GYAE6OF02HO8GR.27.57.F02.1.454.CMB.1.raw
  modified_base (615)..(615): a, c, t, g, unknown or other
  misc_feature (615)..(615): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaactggtggtattcgtgggaggtaggtgtggtccagtcctgggaagaacttccccgtagacgaccttcgtcctagtcgcgacgtcctcgtgggtactttccttaaccgttttaaggttaaggtttagttcggtaagttcggtacggttccggtacggggtccccgtaccgtaaggtacccgttacccggaaggggggaacggggtcgttcggggtacgtttcgggtacgggtaccctaaaacgtaaacgtaaaacccgaaaaggtacggtaaggggtaaaagggttaaaaacgaaaacgtttagtacgggtacggtacttcgtagggtacgggaacggtaccgtagttaccaacgtaacttcccgtaaccgaaggaccgtaaccgaaacgaccctaaaggtaaccgttcgaaacgtttntaaacgtccgtaacgaacgtaaacgtccggggaaacacgggttcccgaagggaaccgtaccggtaaccgggaaccgggtaccggtaaccggtcttttaaacggtaaccgtttacttaccggttcgggggaaccggtaacccggaagggtaagtttaacccgtccccgtttaaagggtaccctttcccggttttaacccgttttcggtttacggtaccttcccgggg

SEQ ID NO: 46605 - DNA, 759 bp, Homo sapiens
  misc_feature: GYAE6OF02JPIZF.27.57.F02.1.454.CMB.1.raw
  modified_base (288)..(288): a, c, t, g, unknown or other
  misc_feature (288)..(288): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgttgggttttccttgttgcttattttagaggtgtccagtgtgaggtgcaacgtggtgtattcgtgggagggtaggttggtcgggtacccaggtccgttgggagtaacttcccgtggacgtaccttcctccgtaggttnacctacgtcccttcgtggtacctttactaccgtttaggtagtttaagttgggaactggtaacgttcggtccggggtccctccggaacgtacccggtaccgggaagggggaacgggtccggttgggtacggttttcggccggaacccaaacgtaacgtaaaaccgaggtacgaagggtaaacgtaaagtaaaactgtacggtaggtactgtacggtagggaacggaccgttactaccaacgtacgtactaccgaaggtaacgaccgaaaccgacgaaacggtaacgtacctacggttaacttacgttacgacgtaaagtataaaccggaactcggaaccgttacgggacgaaccggtaccggaaccggacctacgggtaacttacgtacgttacgtacggtgtacccggaagacggtacgtacccgtacttacggtacttaccgttacccgttggtttaccacggttcccgg

SEQ ID NO: 46606 - DNA, 724 bp, Homo sapiens
  misc_feature: GYAE6OF02FWVZ2.27.57.F02.1.454.CMB.1.raw
  modified_base (182)..(182): a, c, t, g, unknown or other
  misc_feature (182)..(182): n is a, c, g, or t
  modified_base (705)..(705): a, c, t, g, unknown or other
  misc_feature (705)..(705): n is a, c, g, or t
tcagagcgtcgtctcacgaccggtgctcgatttagctcgatatagttgggtttgaggtatcagagaggagccttagccctggactccaaggcctttccacttggtgatcagcaccggagcacagaggacccaccatggaactggggctgagctgggttttccttgttgctatttagaaggtntccagtgtgaggtgcaactggtggattctggaggacggtgtggtccagccgtgggagaactcccgtagagacctcgttacctgtagccaggccctcgtggattacctaccgtttagtaagtttagttggtatgacgtcgtacggggttcccgctaaggacctaccggagggggaacgggtcctgggtagttacggtccggacaaacgtaacgtaaaacccgaagagttaggggaaaggtaaaacaaaaccgttagtacgggttacgacgttaccgtaggttacggaaacggggtacccgtaagttacccaaccgacttacccgtaccgaaggaacggaaccaaaccggtacccgaaagaaccgttaccgaacgttacgtactaacgtacggacaaagtacggaaactacggccgtagaaaggtccggaaccgtaacgggaaccacgggtactacgggtactacgtcgtacggtgaacggtagtaaccgtagttaccgtcttaccggtaaccttttcccgggtntttttacggacttacccgg

SEQ ID NO: 46607 - DNA, 595 bp, Homo sapiens
  misc_feature: GYAE6OF02F5OJE.27.57.F02.1.454.CMB.1.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
  modified_base (396)..(396): a, c, t, g, unknown or other
  misc_feature (396)..(396): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaggtgtccagtgtgaggtgcaactggtggattctggaggaggtgtggtccagcctggagatccctgagactcgtcctgtncagcctntggattctacctttagtagttatggatganctgggtccncagactcgaaggggacgggtctgggagttcgtcggactaacgataaaccaagatagggaacgtaaaacgaaaacgtatcggtaggaactcgtggnggaaacgggcctattccactatccctcgagacgacaaacgtccaaagaacgtcacttgtactctagacaaatgaacaaggtcctagacgacgccgtaacgggaccacggtcgtagttaccgtacttacgtagtgggaccgtaggtaacgtacttacccgtaggtttctacgtttcccgttgtttttagacttacccggg

SEQ ID NO: 46608 - DNA, 690 bp, Homo sapiens
  misc_feature: GYAE6OF02H75T3.27.57.F02.1.454.CMB.1.raw
  modified_base (309)..(309): a, c, t, g, unknown or other
  misc_feature (309)..(309): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttccttgttgctattttagaaggtgtccagtgtgaggtgcaactggtggattctgggaggaggtgtggtccagcctggagaactccctgagacctctccctgtcgcagcctctggattctacctttagtagttattggatgagcgtgggcccncagacctccgaggggaaggggctagggagttcggtaggacccaaacgaataaaacccaaggacgtagggaaggtaaaaagaaaacctataggtacggacttctaggtggaacgggtcctaattaccaaccgtatcccgtaccaaggaacgtaaccaaacgacccaaaaggtacgtacaaccttagtaactcgtagaacctaaagtacgaaacctagtacgagtaacggaacggtaccgaaacgggtacccgaacgggtaccttagttaaccgttaaccgttacgttacgggtcggaacccggtaaggtaacccggttaattaccccgttagggttaaccccttagttttacccccggtttatttttaccgacgtttcccgg

SEQ ID NO: 46609 - DNA, 667 bp, Homo sapiens
  misc_feature: GYAE6OF02GIY2N.27.57.F02.1.454.CMB.1.raw
  modified_base (182)..(182): a, c, t, g, unknown or other
  misc_feature (182)..(182): n is a, c, g, or t
  modified_base (575)..(575): a, c, t, g, unknown or other
  misc_feature (575)..(575): n is a, c, g, or t
  modified_base (608)..(608): a, c, t, g, unknown or other
  misc_feature (608)..(608): n is a, c, g, or t
  modified_base (620)..(620): a, c, t, g, unknown or other
  misc_feature (620)..(620): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttccttgttgctatttagaaggtntccagtgtgaggtgcaactggtggtattcgtggaggaggtgtggtccagccgtaggagtaatcccgtgacgacttctcctgtcgcacgcctcgtgatttacctaccgttttagtagttacgttggacttggaagcggttcgggtacccggtacctaggtaccgtaccggaagggggtaacgggccgttagggtacgtttccggtacggacccgtaaactaaacgtaaaaccgtaagaacgggtaggtaaacgggtaaaaacgtaaaaccgtttaggtaaggttacgggaaccttacgtagggttacggaaacggggtacccgtattaccgaccgtaactccgtaccgaagtaacgacaaacggaccaaaagtacgtacaacgttgtactgtanaacaaagtcaacgtgccgtagacgcgcgagacncgtctagacttnacgtgtcgctacggataccgttcacgtctacttccgtatttagctcg

SEQ ID NO: 46610 - DNA, 650 bp, Homo sapiens
  misc_feature: GYAE6OF02FTDRT.27.57.F02.1.454.CMB.1.raw
  modified_base (250)..(250): a, c, t, g, unknown or other
  misc_feature (250)..(250): n is a, c, g, or t
  modified_base (594)..(594): a, c, t, g, unknown or other
  misc_feature (594)..(594): n is a, c, g, or t
  modified_base (644)..(644): a, c, t, g, unknown or other
  misc_feature (644)..(644): n is a, c, g, or t
tcagagcgtcgtctcacgaccggtgctcgatttagctcgatatagttgggtttgaggtctcagagaggagccttagccctggactccaaggcctttccacttggtgatcagcacggagcaacagaggacccacatggaactggggctgagctgggttttccttgttgctattttagaaggtgtccagtgtgaggtgcaactggtggattctgggaggaggtgtggtccagccgtggagaactccctgganacctctccttgtgccacgcctctgggtattcctaaccttttaggtagttattggattagacgtcgtcgggtcccgcgaacgacctaccggaaggggaacggggctagggtaggttcggtacggaccgaaaacaactaaaacccgaaaggacgtaaggggtaaaggtaaaaacgtaaaactagtaggtcgggtaactcgtaggtaaggacgggaccgtattaccaacctactctaccgtaagaacgaaccgtaaaccgaccgaaaagaacgtactaacgttagtatactagtaacaatacgaacagacctggaagacggaccgaaggacacggtcttataactanctggtgacgtagaacgtactaccgtagtctaccttacggtcttttacggntaccgg

SEQ ID NO: 46611 - DNA, 696 bp, Homo sapiens
  misc_feature: GYAE6OF02HHT5G.27.57.F02.1.454.CMB.1.raw
  modified_base (176)..(176): a, c, t, g, unknown or other
  misc_feature (176)..(176): n is a, c, g, or t
  modified_base (190)..(190): a, c, t, g, unknown or other
  misc_feature (190)..(190): n is a, c, g, or t
  modified_base (265)..(265): a, c, t, g, unknown or other
  misc_feature (265)..(265): n is a, c, g, or t
  modified_base (321)..(321): a, c, t, g, unknown or other
  misc_feature (321)..(321): n is a, c, g, or t
  modified_base (365)..(365): a, c, t, g, unknown or other
  misc_feature (365)..(365): n is a, c, g, or t
  modified_base (400)..(400): a, c, t, g, unknown or other
  misc_feature (400)..(400): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctggttttcctgttgctatttggaggtntccagtgtgaggtncaacgtggtggattcgtggagggaggttgtgggtcccagcccgtaggacgaactcccgtgagacctctcctgtcnctacgccttctggtacttcctaacctttagtagttattggatgagtcgtcgggccnccgagactaccggaggggacgggctggtacgttcgcggaccaanaactaaaccgaagtagtacgggtaaaggtaaaaanaaaacgttgtacggtacggacttacgtagtacgggaaacgggtcctatcccaacgtctaccgtaccgaaggtaaccgaaccgtaaacgacgtaaacgtaacgtcctaaatttcggtaacttcgtaacgaaccgtaaagtcgaaacgacgtaccgtaggaaccgtacggaaccggaaggaaccggtacgtcgttaacgtaacgttaccgttaaggttacggggtacaacgggtaagtaccgtactttaccggaacgttccgttaactttcccggttacggtttttcgagttacccgg

SEQ ID NO: 46612 - DNA, 783 bp, Homo sapiens
  misc_feature: GYAE6OF02IM2GD.27.57.F02.1.454.CMB.1.raw
  modified_base (196)..(196): a, c, t, g, unknown or other
  misc_feature (196)..(196): n is a, c, g, or t
  modified_base (278)..(278): a, c, t, g, unknown or other
  misc_feature (278)..(278): n is a, c, g, or t
  modified_base (550)..(550): a, c, t, g, unknown or other
  misc_feature (550)..(550): n is a, c, g, or t
  modified_base (565)..(565): a, c, t, g, unknown or other
  misc_feature (565)..(565): n is a, c, g, or t
  modified_base (613)..(613): a, c, t, g, unknown or other
  misc_feature (613)..(613): n is a, c, g, or t
  modified_base (619)..(619): a, c, t, g, unknown or other
  misc_feature (619)..(619): n is a, c, g, or t
  modified_base (639)..(639): a, c, t, g, unknown or other
  misc_feature (639)..(639): n is a, c, g, or t
tcagagcgtcgtctcacgaccggtgctcgatttagctcgatatagttgggtttgaggtctcagagaggagccttagccctggactccaaggcctttccgacttggtgatcagcgacggagcacagacggacccacatggaactgggctgagcgttgggttttcctgttgctatttagaggtgtccagtgtgaggtncaacgtggtgattcgtagggaggaggtgtcggtccagtccgtagggaactaacgtcccgtagacgtaccttctccgtggtcnccacgtcctcgtaggtacttacctaacgttttaggtaagttttacgttaggtattacgacggtccgttacgggtcccaccgtaaggaacccgttacggaacgggggtaacggggtccgttagggtacgtttacggaccggtaacccgtaaaagtaaacgtaaaaccggtaggtaaccgtaggggtaaaacgggttaaaactaaacggttacgtacggtacggtaccttaagtaggtaacgggtaaaccgggtccttaacgtccaaaccggtnttaacccgggaaacngggaaacctaccgaaaccgtaccgaaaagtacgtactacgttattacncgtaanaaaccctaagtacggaaccncgggttactacgggaaagtccggaaccgtaggtaacccacggttacttaagtaccgttaacccgttgtgggaacctaacggagttacccgtaatttcccgtaaggttccctacccggttttagtcgttttacggcttacccggg

SEQ ID NO: 46613 - DNA, 717 bp, Homo sapiens
  misc_feature: GYAE6OF02JPIV6.27.57.F02.1.454.CMB.1.raw
tcagagcgtcgtctcacgaccggtgctcgatttagctcgatatagttgggtttgaggtctcagagaggagccttagccctggactccaaggcctttccacttggtgactcagcacggagcacagaggacccacatggaactggggctagagcgttgggttttccttgttgcttagttttaggaaggttcgtccaggttgtgagggttcgacaacgttggtaggtatttcgtagggagggtaggtggtcggtaccgaggtccgtagggagaacttcccgtaggacgtactcctccgtgtcgacgacgtcctagtacggtacttccgtaaccgtttagttacgtttagttggtaatcggtagtcggtcggtacccgaccgtacgtaccggtaccggaaggggtacgggtctaggggttacgttcggtaccggaacctaaacgtaaccgttaaaaccgaaggtacggtaacggggtaaaagtaaaacggtaaaacttaggtacgtaacggtaccttacgtacggtaagggaacggtaccgtactaccgtaaccgtactacctacgaaggaacctacgaaccgaacgtaagactacgtattagtacagtcaaacaagtacgaacgtcgacctaggaacggcgacggagccgagtcgtattaccgactgagtaacggacagaacttcctcgtacttcgacgtttacgtcgtttagcttacgg

SEQ ID NO: 46614 - DNA, 894 bp, Homo sapiens
  misc_feature: GYAE6OF02HJ7BT.27.57.F02.1.454.CMB.1.raw
  modified_base (196)..(196): a, c, t, g, unknown or other
  misc_feature (196)..(196): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatgggaactggggctgagcgttgggttttccttgtgctattttagagtgtccagtgtgaggtnactaacgtggtgtacttcgtgggacggtaggtgtggtacccaggtccgttggaaactaacgtcccctagggactaccgttcctctggtacgtcgacgtcccgttcggtacggtactttaccgtaaccgtttaaggttaacgttaggttacgggtaacttaggtacggtcggtccggggttaccgaccctaacggtccgtacccggaagggggtaaccggggtccttaagggttcggtttaaccggtggaaccccctaaagtaaaaccgtaaacgtaaggtaacgtagggggtaaaacgtaaaaacggtaacgtttagtacggtacggtaaccgtttggtacgggtagggaaccgggtaccctacgttaccacccggttaatcccgtaaccggtaagtaaccggtaaccgtaaacccgaaccggtaaacggttaacccgtacctaaccgggtttacgtaacgttaccggtaacgtaaaccttaaaggtaaccgaacggttaaccgaccggttaaagggaccgtacccgggtaaccgggtaacggtacccgggtaacccggttagttaaccccgggttaaccttacgggttaaccggttaggttaacccggtaacgggtacgtaaccgtccgttttaaaccccgggtgttaccccgttaaccggttttccctttaacggtttaccgtaccttacccgggg

SEQ ID NO: 46615 - DNA, 767 bp, Homo sapiens
  misc_feature: GYAE6OF02JAMY4.27.57.F02.1.454.CMB.1.raw
  modified_base (583)..(583): a, c, t, g, unknown or other
  misc_feature (583)..(583): n is a, c, g, or t
tcagagcgtcgtctcacgaccggtgctcgatttagctcgatatagttgggtttgaggtctcagagaggagccttagccccggactccaaggccctttccacttggtgatcagcacggagcacagaggacccaccatggaactggggctaagctgggttttccttgttgctattttagaaggtgtccagtgtgaggtgcaactggtggattctggaggaggtgtcggtccagccttggagaatccctgacgactctcctgtgcagcctcgtggtactccacctttagtagttattggattgagtcgtggggtacccgcctacggaccgtaccggaggggggtaacggggcgttagggtacggtttcgggtgggacccaaacgaacgttaaaacccaaaggtacgtacgggaaagggttaaaaaacgaaaaaccgttagttacgggttacgggtactttacggttaggttaaggaaacgggggtacccggtaactttacccaaccctaacgttccgttaacccgaaggtaacgaaaccgaaaccggtacccaaaaggtaaacgtcctaagttacgtattccgtanacgtaaaagtcgaaacacggtcccgtaggacggacgaacccggagggaaccgaccgggtactacggtttaactaaccttacggttacggtggtacggaacggtagtaccgtaaccgtttacggtacgttaccgttttcccggtttccttttttaaggccgtttacggttcccgtaacggggggg

SEQ ID NO: 46616 - DNA, 879 bp, Homo sapiens
  misc_feature: GYAE6OF02JGTQ8.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgtgggttttccttgtgctatttagaggtgtccagtgtgaggtgctaatggtggattcgtgggaggaggtggtgggtccagccgtaggagtaactcccgtgacgactctccgtgtgacacggcctcgtggacttcctaccgtttaagttagttagttaggtatggaacgtcggtcgggtcccgaccaaggtaccgtaccggtaagggggaacgggtccgttacggggtaacgttttccgggtacggaccccgtaaaacgtaacgtaaaaaccctaaagggaacgtaagggggtaaaagggttaaaaaccgtaaaaaacgttacgttaggggttaacggtaaccgttagttacgggttaaacggaacgggttaccgtaacgtttaccgaaaccctaacgttacccgtacccgaaacggtaacccggtaaaaccgtaaacccggtaacccgtaaaaagggtaaacccgttaaccgaaaccgtttacggtttaacctaacggttaaccggtaaacctaaaaacggttaacgggtaaaacccgaacggttaacccgtaagggaaaccgggaaccggacccgggaacgggaaaccggaaccgggttaacgttaacgtaaccgttaacggtaccggttaacggtccgggaaggtaaacggtaagtacccgttttaaccggtaaccgttacggtaaccttttacccggtttacggttttaccgaacggttttcccggg

SEQ ID NO: 46617 - DNA, 872 bp, Homo sapiens
  misc_feature: GYAE6OF02ISC7P.27.57.F02.1.454.CMB.1.raw
  modified_base (288)..(288): a, c, t, g, unknown or other
  misc_feature (288)..(288): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaagtgtccagtgtgaggtgacaactggtaggtattcgtggaagggtacggtggttcgggaccaggcctgggaacgtaacttcccctggaacgtccttcctccgttaggtcncgaacgcccgttcgtcgggtacttttaccgttaccgttttaaggttaacggttttaagtttacgggtaagtgtacgggtacggttcgggttccccggacccgacggtaaccgtacccggaaggggggaaccgggggtcggttacgggtacggttttacggtcgggtaaccccgaaacgaaaccgttaaaacccgaaaggtaaggttaaaggggaaaacgggttaaaaaacggtaaaaaccttaaggtacggttaacggtaacgttacgttacgggtaaagggtaacccggggtaaccgttaaccggtttaacctaacccgtaaccgttacccttaacccggaaaacgtacggaaacctaaaacccggtaacccgaaaaaggtaaccggtaacctaacggttaattaacgttcgtacgtaaactaaacgtaaccaaacgcgttaaccgttagaaccgtacggacggtaacgaaccggtaccggtaagttacgtacttacggtacttcggtaacggtcggtaaggtatacccgttagttacgtttacgttaaccgtttccgttacggttttccgtagttacccggg

SEQ ID NO: 46618 - DNA, 691 bp, Homo sapiens
  misc_feature: GYAE6OF02HZFVI.27.57.F02.1.454.CMB.1.raw
  modified_base (151)..(151): a, c, t, g, unknown or other
  misc_feature (151)..(151): n is a, c, g, or t
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (548)..(548): a, c, t, g, unknown or other
  misc_feature (548)..(548): n is a, c, g, or t
  modified_base (557)..(557): a, c, t, g, unknown or other
  misc_feature (557)..(557): n is a, c, g, or t
  modified_base (622)..(622): a, c, t, g, unknown or other
  misc_feature (622)..(622): n is a, c, g, or t
tcagagcgtcgtctcacgaccggtgctcgatttagctcgatatagttgggtttgaggtctcagagaggagccttagccctggactccaaaggcctttccacttggtgatcagcacggagcacagacggacccacatggaactgggctgagntggttttcctgtgctatttagaggtgtcagtgtgnggnacaacgtggtggattcgngggagaggtgtggccagcctggagaacncccgtgacgtactctccgtgtagcagtcctcgtagatttcaccgtttaagtagttataggtatgaatcggtcgggtccgaccagacccgtaccggaggggacgggtcgtaggtacggttcgtccgaccgtaaccgtaaacttaaaaccgaagtaacggtaggtaaaagggaaaaacgtaaaaacgttgtaggaacggtaactcgttcggaaacggaagggtccccgtaatcctaacctactccgtaaccgaaggaccgaacgaaaacgccgtaaaaagccgtaacgtagttcgaattctaagaaccgtaaaanacgtaaacncggtaacctaggagacccggtacgaacgggtaacctgggactttaagggaacttaccgttacggngtaaccgaaggcgtaaaggtcccgttaacgtacggttcctaacgtttccgtttaagtttcgattccggg

SEQ ID NO: 46619 - DNA, 693 bp, Homo sapiens
  misc_feature: GYAE6OF02HUGXQ.27.57.F02.1.454.CMB.1.raw
  modified_base (304)..(304): a, c, t, g, unknown or other
  misc_feature (304)..(304): n is a, c, g, or t
  modified_base (532)..(532): a, c, t, g, unknown or other
  misc_feature (532)..(532): n is a, c, g, or t
tcagagcgtcgtctcacgaccggtgctcgatttagctcgatataggttggggtttgaggtctcagagaggagccttagccctggactccaaggcctttccacttggtgaatcagcacggagcacagaggacccaccatggaactgggcctgagctgggttttccttgttgctattttagaagtgtccagtgtgagtgcaactggtggattctggagaggtgtggtccagcctggagaatccctgagactctcctgtgcagcctctggattcacctttagtagttattggatgagcgtcgggtcnccgagacctccgagggaagggctggtacgttcgtcggaccctaaacgaactaaaaccgaaggtagtaacgggaaagggttaaaaagaaaaacgttagtacggttacgggtaacttaccgttaggtaaggaaccggggtacctacgtttaccaaccgtaactcccgtaccgaagtaaccggaacctaaaccgacccaaaggtaaacgtccaacgttacgtataccgtanaaacgtaaatccggaaacaccggtaaccgtacgaacggtaaccggaccggaaggaacccgtacgggtaccttggtaaacttacgtacgtacggttcggacgtacgaagttaccgtaccgttacgaccttacgttacccgttacgttttagatttacccggg

SEQ ID NO: 46620 - DNA, 690 bp, Homo sapiens
  misc_feature: GYAE6OF02I0X91.27.57.F02.1.454.CMB.1.raw
  modified_base (320)..(320): a, c, t, g, unknown or other
  misc_feature (320)..(320): n is a, c, g, or t
  modified_base (542)..(542): a, c, t, g, unknown or other
  misc_feature (542)..(542): n is a, c, g, or t
  modified_base (559)..(559): a, c, t, g, unknown or other
  misc_feature (559)..(559): n is a, c, g, or t
  modified_base (614)..(614): a, c, t, g, unknown or other
  misc_feature (614)..(614): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgttgctattttagaaggtgtccagtgtgaggtgcaactggtggattcgtgggaggaggtgtggtccagcctggagaactccctgacgactctcctgtgcgacgcctcgtggtacttctaacctttagtagtttagttggatggagtcgtcggggtcccnccgtagacccgtccggaagggggaacggggtcgtagggtacggttccggtacggaccctaaacgtaacgtaaaaacccgaagtaagtaagggaaacggtaaaaagaaaacttagtcggtaggtacttacgtaggtacgggaacggtcccgtaattaccgaccctattccgccgtaaaggacgaaccaaacggaaccaaaggacgtcaacgtgttaactccgnaaactaagtacgaaacncgtactaggacgacggaccgaagtaccgaggttctaaggttaacctacgttacgnggtacgaacggtataaccggtactttacccgtagtccttaccggtttccgtttacgtttacgtacgtttacccggg

SEQ ID NO: 46621 - DNA, 693 bp, Homo sapiens
  misc_feature: GYAE6OF02G7986.27.57.F02.1.454.CMB.1.raw
  modified_base (355)..(355): a, c, t, g, unknown or other
  misc_feature (355)..(355): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttggaggtgtccagtgtgaggtgcaactggtggattcgtggaggaggtgtggtccagcctgggagaactccctgacgactctcctgtcgcagcctcgtaggacttcctacctttagtagttattgggatgagtcgtgggtccgcagtacctccggaggggtacggggcttagggacgtttcggnggacccaaacgaaactaaaccgaaggtaacgtaggggaaagggttaaaaacgtaaaacgttagtagggtacggtaaccttacgttagggtagggaaacgggtcccgttaacgttaccaaccgtaacttccgtacccgtaaggaacgtaacccgaacgtaccgaaaggtaactactaacgttagtactcgtacgaacgtaaagtacgaacacggtacctaggacgtaccgaccgggaacgacgaacggctagttaaccgtacgttacgtggtacgaccggtaaggaacgtacttcggttaacttaccgtacgtttacccggttcttttacggacttcgg

SEQ ID NO: 46622 - DNA, 606 bp, Homo sapiens
  misc_feature: GYAE6OF02IMFCN.27.57.F02.1.454.CMB.1.raw
  modified_base (298)..(298): a, c, t, g, unknown or other
  misc_feature (298)..(298): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctgggaggaggtggtggtccaggcctggagaactccctgacgactctcctgtgcagcctctggattcactttagtagttattggatgancgtgggtccgcagcgtccgaggggaagggtcgtggtagttcgtcggaccaaacgaactaaaccgaagacgtaggaaaggtaaaagaaaactagtggtagtactagtggtaggacgggaccgtattaccgacctactcctaccgagaacgaccgaaacgaccgaaaggaacgtacgaacgttagttactacgttacgacgtaaatacgaacgacgccgtagaagacggaccgacggaccgacggtactagtacttactacgtgtggacgagactacgtctacgtactacgttccgtacttttgcttcgg

SEQ ID NO: 46623 - DNA, 975 bp, Homo sapiens
  misc_feature: GYAE6OF02HQVFP.27.57.F02.1.454.CMB.1.raw
tcagagcgtcgtctcacgaccggtgctcgatttagctcgatatagttgggtttgaggtctcagagaggagccttagcccctggactccaaggtcctttccacttggtgatcagcacggagcacagaggaccccacagtcggaacgtggggctgagcgttgggtttttcctgttgcttaattttagaaggttgtccagtgtgaggtgctaacgtggtggtacttcgtagggagggtaggtggtcggtcctacggccgttaggaacggtaacttccccgtggaacgtaccttccgtccttggtcggtccgtacgtcccgttacggttgggtaacctttacccttaaccgtttttaaggttaagtttaaggttgggtattacgggaacgttcccgggttaccggggaccccgccgtaacgggtaccccgttaccgggaaagggggggggtaacggtccggtttacgggtttaaccggggtttacgggtaccggaaacccccgttaaacgtaaaaccccgttaaaaaaccggggtaaggtaacgggtttaaaacggggaaaaaacgggttaaaaaacggtaaaacttttagggttacggggtaaccggttaacccggtttacgttacgggggttaaaccggggaacggggttacccgttaacttttaacccgaaacccgttaaccgtacccgttacccgggaaaggtaaccggaaacccgaaaacccggtaaccgaaaggaaacccggttccgtaaacgtttacgaactttaccgaccggtaaacgtaaaccttaacggaaccggtaccggtaacccgttaggaaaccgggtcccggaaccgggtaaccggaacccggttacgtaacccgttaaggttaaccgttacgttaaccggtacgggtacgtaccgggtaagcccgttaacgttacgtacgttacccttaccggtttccgtttaaccgttttctacggttccgg

SEQ ID NO: 46624 - DNA, 758 bp, Homo sapiens
  misc_feature: GYAE6OF02IVPU5.27.57.F02.1.454.CMB.1.raw
  modified_base (147)..(147): a, c, t, g, unknown or other
  misc_feature (147)..(147): n is a, c, g, or t
  modified_base (176)..(176): a, c, t, g, unknown or other
  misc_feature (176)..(176): n is a, c, g, or t
  modified_base (677)..(677): a, c, t, g, unknown or other
  misc_feature (677)..(677): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccacatggactgggctgagntgggttttcctgttgcttatttagaggtntcagtgtgaggttgcagtggtgattcgtggaggaggtgtacgggtccagcctggacgaactcccgtagacgtacctcgtaccttggcgtctacgtcccgtctaggtactttaccgtaacgttttacgtaagtttacgttaggaagttgacgtaccggttggggttacccgaccgttagtacccgtacggtaagggggaacgggtgtagggtacggtttcggtaccggaccgtaaacaacgtaaaccgaaaggtagtaacgggtaaaggtaaaacgaaaactttagtacggtaaggtacgttacgtaggaacgggtaacggggtaccgtaagtttacccgacccgttaacgtttaccgaaccgttaacggaacgtaaacccgaaaccgtacccgaaagtaaaccggttactacgttaagtacttcgtacgaaataccgaagtaacacgtacctaggaccgacgtaccgaggaaccgacgtacgtgttaacgtacgttacggnggttaacgtaccgggaagttaacgtaccgttaccgttaattaccgttaacggtttcccggtttatttacgtacgttaccgg

SEQ ID NO: 46625 - DNA, 771 bp, Homo sapiens
  misc_feature: GYAE6OF02FI44H.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtgggctgagcttggtttcttgttgctattttagaagtgtccagtgtgaggtgcaacgtggtgattcgtggaggtaggtgtggtccagtccgtaggacgtaactcccgtagacgacttcctcgtgtcgcgacgtcctgtcggtattcgtaaccgtttaggttatttagtggattggacgtcgttcggggtcccgacgtacgtaccgccgtaaggggaagggtccgagggttacggttccggtcgggtaacccaattaaccgtaaaaccgaagtaagtagggtaaacggttaaaactaaaacgttcgagggttaccgacttaggttggtaaggaaaccgggttccgaactttacacccgtactaccggtccgtaaacggacgaacccaaacggaccaaaggtaaccgtaccttacgtagttaaaccgttccgtaaagaccgttaaaggtaaccgtaaccgaaccgttacgttacggaaaccgagggtaaccccggaagttaaacggaccgggttcgtaacgtttagtaacccgtaggttacgtccgggaaccgtgaaccggttaccgttaaccggttcgtttacccggtaacgttttccccgggtacgttttaaggtaccgtttccccgggg

SEQ ID NO: 46626 - DNA, 868 bp, Homo sapiens
  misc_feature: GYAE6OF02GJVY5.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatcggaactggggctgagcgtcgggtttctgttgcttatttagaacggtgtccagtcgtgacggtgcaactggtgacttcgtggaggacggtgtcggtaccagtccctagggacaactcccgtgacggaccttcgtaccgtgcgtcacgtccctgtcggtattaccgtaccgtttaagtaggtttaacttagggactttacggaacgtccggttccggggttacccgccgtaaaggttacccgttacccggggaaagggggtaaacgggggtccgttaagggggtaaccgttttccgggttacgggaaccccttaaaaccgtaaacgttaaaaacccgtaaacggtaacggttaaccgggggtaaaaaggttaaaaaaccggtaaaaacgtttccggtaaggggtttaaccggacctttaacggttgggaacgggaaccggggtcctaacgttccgtaccctaacgtccgtaccgtaaggaccgtaaacccgaaacgacccgtaaaggaaccggttccaaaggttcgtaaacttccgtaactcgtaaacgtacgaacccgttacgaacgttcggaacggttaccgaaccggggaacgttaaccggtacggtcccgttaaggttacccgtaccgtaacggtttccggaaggtaaacccggcgttaaccgggtaccttaccgtaacggtttcgaaacccgttttcccggtttcggtttaacggccttttacccgggg

SEQ ID NO: 46627 - DNA, 655 bp, Homo sapiens
  misc_feature: GYAE6OF02GZCUJ.27.57.F02.1.454.CMB.1.raw
  modified_base (310)..(310): a, c, t, g, unknown or other
  misc_feature (310)..(310): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtggttttctgtgctattttagaaggtgtccagtgtgaggtgcaactggtggattctggaggaggtgtggtccagccgtggagaacttcccctgagacctctccgtgtgcagcctctggattccacctttagtagttattgggatgagccgtgggtccncagaccgtccgaaggggagggctggtacgttcgtggaccaaacactaaaccagactagggaagtaaagaaacgtatggtagtaactcgtaggtggaaacggccgtatcctacgactctaccagtaacgaccgaaacgtaccaaagaacgtctaacgttacgtactcgtacgaactaaactacgtaaacgacggtacccgtaagtacggaacgggacccggaacggtaaccgaaccgggtacgttaggttaacctacgtttaccggttaggtacggaccggtaagggaacgttaacctaccgtttacggaccttacgtttcccgttacgttttcgtaacgttccgg

SEQ ID NO: 46628 - DNA, 739 bp, Homo sapiens
  misc_feature: GYAE6OF02JFMRE.27.57.F02.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagagcgtcgtctcacgaccggtgctcgatttagctcgatatagttgggtttggaggtctcagagaggagccttagccctggactccaaggcctttccgacttggtgatcagcacggagcacagaggacccacatggaactgggctgagctggtttctgtgctatttagagtgtccagtgtgagtgcaacgtggtgattcgnggaggaggtgtggtccaggcctggagaactcctgacgctctctgtgcagcctgtggtacttactactttagtagttatgatgacgcgtacgggtccncgacgtaccgtccgaggggacgggtctagggtagttcggacggtaccaaactaactaaaaccgaaggtacgtagggtaaaggtaaaaacgtaaacttggtaggtacggtaacttacgtaggttaaccgggaacggggtccctaagtttacccaacccgtattacccgaaccgtaaggaacgtaacccaaacggtaacccgaaaggtaaccgtctaaacgttagtaacttccgaagtaacctaaacgtacggaaaccgtacgtacccgtaggaaacggtacggaacccgggtaaacgggaaccgtaaccgggtactacgttaaaccgttaccgttaacggtaccggttcgggaaaccggttaaggtaacgttacccgtttaacgtaccgttccgttaaaccgtttcccgtttacggttttttacggaccctttacccggg

SEQ ID NO: 46629 - DNA, 686 bp, Homo sapiens
  misc_feature: GYAE6OF02HP10Z.27.57.F02.1.454.CMB.1.raw
  modified_base (554)..(554): a, c, t, g, unknown or other
  misc_feature (554)..(554): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctggagctgggttttccttgttgctattttagaaggtgtcagtgtgaggtgcaactgggtggattctggagggaggtgtggtccgagctgggagaatcccgtgagactctccgtgtgcagcctctggacttcacctttaggttagttattgggatgagtcgtgggtcctaccgagaaccttccgagggtaacggggctggtaacggtttcgtgggtacccaaacgtaagtaaaaacccaaggacgttaggaaaggtaaaaagaaaacgttagaggttaacgggactaccgtaggtgaaacggggccggtaattccgaaacacttactaccgaacgagaaacgtaacgaccgaaacggtaaagtacggacgttaacgtagacttacggtactaaaatacggaaacgtacncccgttaaggagaacggtaaccggaacgggaaccaacgggtaccgtagtactaccgggtacttacgggagttaccggaagtacgtaataccgttacggattacccgttaacgttccggttttatccttacgg

SEQ ID NO: 46630 - DNA, 722 bp, Homo sapiens
  misc_feature: GYAE6OF02GRWFB.27.57.F02.1.454.CMB.1.raw
  modified_base (188)..(188): a, c, t, g, unknown or other
  misc_feature (188)..(188): n is a, c, g, or t
  modified_base (213)..(213): a, c, t, g, unknown or other
  misc_feature (213)..(213): n is a, c, g, or t
  modified_base (331)..(331): a, c, t, g, unknown or other
  misc_feature (331)..(331): n is a, c, g, or t
  modified_base (356)..(356): a, c, t, g, unknown or other
  misc_feature (356)..(356): n is a, c, g, or t
  modified_base (682)..(682): a, c, t, g, unknown or other
  misc_feature (682)..(682): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcgtggtttctgtgcttatttagagtgtcagtgtgaggtcnctaacgtggtcgattcgtagggagnggtgtcggtaccagtccgtagggagaaccttcccagggtacgcctccttgtcgtgccacgcctcgtagtacttcgttaccgtttagttagtattggacgttggagtcgtcgggtaccncagtaccgtcgaggggtaaccgggngtacgggcgtttccggacggtaccaaagtaacgtaaacctaaggacgtaaggtaacggtaaaaaactaacgttcgtaaggttcgacgtttacgaggttaacggaacgggtaccttaacgtacgacctacgtccacgtaaagaacgacgtaaaccgaccgtaaaggaacgtaaccgtctaaggttacgttacgacgaaacccgtaagtaaccgaacgtacgtacccgttagaccggtacggaaccggtacggaaccgacgttacggttaacacccgttagttaccgttggaacggttacgaacgttaaccgttacaccgggttaacncggttttaccgttccgtttaattccggaccgtttacgggg

SEQ ID NO: 46631 - DNA, 700 bp, Homo sapiens
  misc_feature: GYAE6OF02JYBM8.27.57.F02.1.454.CMB.1.raw
  modified_base (200)..(200): a, c, t, g, unknown or other
  misc_feature (200)..(200): n is a, c, g, or t
tcagagcgtcgtctcacgaccggtgctcgatttagctcgatatagttgggtttgaggtctcagagaggagccttagccctggactccaaggcctttccacttggtgatcagcacggagcacgagaggacccacatggactggggctgagcgttgggttttccttgttgcttagttttagaggtcgtccgagtgtgaggtnacgaacgttggtggtacttgtgggaggaggtgtggtccagccgtaggagaactccctgaacgtctctcctgtgaccgagtccctggtattaccttacgttacgtttaacgttagttaggttaaggcgtaggaccggtcgggttaccggacccgtaaccgtacggtaaccggtaccggggaaagggggttcggtaccggtttagggacggtttcgggacccaacctaaaaggttaaaccaaacggaggtaggtaacggtaaagtaactaagcgtaggcttacgtgtagggaacgtaggtcccttaaccgtactacgtacacggacgaacacgacacgtaacgtacgtatacgttaataccgtacgacgaattaggacctaaggaccgtagaccggagaccgacgtaacggtaccgaggttaccgagttacgacgtaggtacgaggtacggataaccgttacgcggttactacggttccttacgttacgttgaaccgttcgg

SEQ ID NO: 46632 - DNA, 722 bp, Homo sapiens
  misc_feature: GYAE6OF02JED1S.27.57.F02.1.454.CMB.1.raw
  modified_base (238)..(238): a, c, t, g, unknown or other
  misc_feature (238)..(238): n is a, c, g, or t
  modified_base (268)..(268): a, c, t, g, unknown or other
  misc_feature (268)..(268): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaacgtggtggattcgtgggaggaggtgtggtccagcctgganaatccctagagactctccgtgtgcagcctntggattccacctttagtagttattgggatggacgcgttacgggtcccgtaccagaccgtccggagggggaagggtcgtgggtagttcggtcggaccaacgaattaaacccgaagtagtagggaagtaaaagaaaactgtagtggtaactcgtaggtacgggaagggtaccgtattaccaaccgtacttaccgtaccgtaacgaacgtaaccgaaacgtacccgaaaaaggtaccgtaaccgtaacttacggttaacttcgtaacggaacctaaagtaacggaacctacggtacccgtagaaccggtagggaacccggtaacgaaccgtaccgggtacgtaacgttaaccggttaccttacggtacggtacggaacggtaacggtacggtaacgtttacccgttacgggttaccttaacccggtttccggttactttttacgggactttcccggg

SEQ ID NO: 46633 - DNA, 633 bp, Homo sapiens
  misc_feature: GYAE6OF02GV6X2.27.57.F02.1.454.CMB.1.raw
  modified_base (346)..(346): a, c, t, g, unknown or other
  misc_feature (346)..(346): n is a, c, g, or t
  modified_base (614)..(614): a, c, t, g, unknown or other
  misc_feature (614)..(614): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaactccctgagactctcctgtgcagcctctggattctacctttagtagttattggatgagcgtcgggtccgcagactccgaggggagggcgtggagttcgtggaccaanataaaccaagagtaggaaagtaaagaaactgtaggtaggactgtggtaggaacgggtcctattccacctactcctaccgagaacgaacgaaccgacgaaagaacgtccaacttcgtactcgtacgaactaaagtacgaaccgtagaccgtaggaacggaccggaccggaacgggaccgacgggtacgttagtaacgttaccgttaacgtggtacggccggtaaggtacgtaccgttaccgtacgttaccgttaccgtttacccggttntttttacggactttccggg

SEQ ID NO: 46634 - DNA, 705 bp, Homo sapiens
  misc_feature: GYAE6OF02HL4WS.27.57.F02.1.454.CMB.1.raw
  modified_base (338)..(338): a, c, t, g, unknown or other
  misc_feature (338)..(338): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcctgtgctattttagaagtgtccagtgtgaggtgacaacgtggtggattcgtgggaggaggtgtggtccagccgtggaacgtaactcccgtagacgtaccgttctcctgtcgcacgtcctcgtggtacttactaccgttttagtacgtttagttggactggtagtacggtcggggtcccncgtaacgaccgtaccggaagggggaagggtcgtagggtagtttcggtacggacctaaacgaacgtaaaaccgaagagtacgggaaacgggtaaaagtaaaacgtgttaggtacggtactacgtaggtacggaaacgggtcctaacgttcgaaccgtacttcctaacgtaaggaacgtaaccaaccggtaacaaacgtaacggtctaacgttagtactcgtacgactaaagcgtaacgcgtaccgtaggaacgacggtaccgaagggtaccgacggtacttagtacctacgttcgttagggtacgacggtagtaacgtacttaccgtacggttacttacggtttcccgtttagtttacggacttccgg

SEQ ID NO: 46635 - DNA, 514 bp, Homo sapiens
  misc_feature: GYAE6OF02FPVAB.27.57.F02.1.454.CMB.1.raw
  modified_base (380)..(380): a, c, t, g, unknown or other
  misc_feature (380)..(380): n is a, c, g, or t
  modified_base (404)..(404): a, c, t, g, unknown or other
  misc_feature (404)..(404): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaagggctggagtttcggtggccaaacataaaccaagatggagtaaagaaaactatagtggactntgtgaagggccattcacatctcanagacaacgcaagaagtcactgtatctgcaaatgaaacagcctagagagcgagacacggctgtatactactgtgcgagagatccgtagtcaacttccgtcttttgattccg

SEQ ID NO: 46636 - DNA, 883 bp, Homo sapiens
  misc_feature: GYAE6OF02GTS9L.27.57.F02.1.454.CMB.1.raw
tcagagcgtcgtctcacgaccggtgctcgatttagctcgatatagttgggtttgaggtctcagagaggagccttagccctggactccaaaggcctttccacttggtgatcagcacggagcacagacggacccaccatggaactggggctgagcgttgggttttccttgttgcttattttagaggtgtcagtgtgaggtgcaactggtggattcgagggtaggaggtgtggtccgagtccgtaggacgaacgtcccgtgacgacctcctctgtcgcacgtcctcgtaggtacttccgtaaccgtttagttacgttagttggtagtagaggtcgtcgggtacccgtaccgacgtaccgtaccggaagggggtaacgggtcgttacggggtcggttaccggttacgggaaccctaaaacgtaaaccgtaaaacccggaaaggttaacggtaacgggggtaaaacggttaaaaacgtaaaacgtttacgttaacgggtacgggtaaccgttacgggttacggtaagggtaaaccggggaccttaacgtttacccgaacccttacgtttacccctaacggaacggaaaccgtaaccggtaaacccggaaacgtaaacgggttaaccgtaccgtaacggtttggttaaccggttacctaaggtaaacctaaagtaacgggaaacccgttaccgacgggttaacggaacggttacccggaaaccgggacccgggtaacccgtacgggtttaaacctcgggtttaaacgttaccgtttaaccgtcggggttaacgtaacggtaaacggtaacggttacccgttacccgttaacggttacccggtttaccgttttaccggttttaccgttttaacggtcctttaaccggggg

SEQ ID NO: 46637 - DNA, 731 bp, Homo sapiens
  misc_feature: GYAE6OF02F7T3Q.27.57.F02.1.454.CMB.1.raw
  modified_base (289)..(289): a, c, t, g, unknown or other
  misc_feature (289)..(289): n is a, c, g, or t
  modified_base (345)..(345): a, c, t, g, unknown or other
  misc_feature (345)..(345): n is a, c, g, or t
  modified_base (668)..(668): a, c, t, g, unknown or other
  misc_feature (668)..(668): n is a, c, g, or t
  modified_base (674)..(674): a, c, t, g, unknown or other
  misc_feature (674)..(674): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgacgcgttgggttttccttgttgcttattttagaggtgtccgagtgtgaggtgacaacgtggtggtattcgtggaggtaggtgtcgggtaccaggccgtaggacgaaactcccgtagacgtaccttcctcctggtcgaccncgtcctgtggtacttacctactttagtaagttattggatacggagcgtcgggtccnccgagtaccgtacggaaggggacgggcgttgggtacgttcgggtaccgaacctaaactaacgtaaaacgtaaggtaaggtaacgggtaaaagggtaaaaacgtaaagtcggttacggtacgtaacgttcgtaacgggaggtaaccgggtaccctattaaccaccttaatcccgtaaacgaggtaaaccggaaacccgtaaacggaacccgtaaaaggtacctcgttaacgttacgtaaccgtcgtaagaaactaacggtaaccgaactaccggcgtacgaagggtccgaaccggagtaccgtacggattaccgtagttaccgngtaggngaaccgtaggtacttacttacgtacttaccggtcctttcgtagttccaggttcccgg

SEQ ID NO: 46638 - DNA, 814 bp, Homo sapiens
  misc_feature: GYAE6OF02FW1C2.27.57.F02.1.454.CMB.1.raw
tcagagcgtcgtctcacgaccggtgctcgatttagctcgatatagttgggtttgaggtctcagagaggagccttagccctggactccaaggccctttccacttggtgatcagcacggagcacagaggaccccaccatggaactggggctgagctgggttttccttgttgcttattttagaaggtgtccagtgtgaggtgcaactggtggattctggaggaggtgtggtccagcccgttggagaatccctagacgtactcctccgtgtcgcgacgtccctgtggtacttcctaaccgtttagtagtttattggtagtggaagtccgttcggggtcccgtaccgacggaccgttacccggaaggggggaacgggtcgtagggtacggtttcggcgggacccaaacgtaagtaaaacccgaagtacgtaggggaaagggtaaaagaaaacttacggtagtacgggtactccgttaggtacgggaacggggtcccgtaagttacccgtaccgtaacgttaccctaccgtaaacgaacgaaaccgtaaacccggtaaccgaaaacggtaaccgtaccgtacgtttaaagttacgttaaccgtacgtaacgtaaacgtacggaaaccgtacggaccgttaacgggacgaaaccgggaccgggaaacgtaacccggacgggttaacgttaacgttaccttaacccggtttacgcgggttaacggaccgggtaaacgggtaacgtaaccggtttaccccgttaagggtccctttaacccggtttacccggtttcgttttttacggtacccgtttacccgggg

SEQ ID NO: 46639 - DNA, 891 bp, Homo sapiens
  misc_feature: GYAE6OF02HUO4Y.27.57.F02.1.454.CMB.1.raw
  modified_base (73)..(73): a, c, t, g, unknown or other
  misc_feature (73)..(73): n is a, c, g, or t
  modified_base (184)..(184): a, c, t, g, unknown or other
  misc_feature (184)..(184): n is a, c, g, or t
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
tcagagcgtcgtctcacgaccggtgctcgatttagctcgatatagttgggtttgaggtctcagagaaaaaggngccttagccctggactccaaggcctttccacttggtgatcagcacggagcacagaggacccaccatggaactggggctgagtctgggttttcctgtgctattttagaagtntccagtgtcgaggtncaacgtggtggattcgtggaggtaggtntggtccagcctggagatccngganactntacctgtgactagcctacgtggactttacacctttagtacggttatttcggaattacgaggtcgttgggtacccgtccgaagtaccctaccggaggggtaacggggtctgggtaacggttcggtagaaccccgtaaactaacgttaaaaacccgaaaggtaacgtaggggttaaacgggtaaaaacgaaaaactttaacggtacggttagggtaaccttcgggtaacttgggggtaaaaccggtccggttaaacgtttcccgtaacccgtaaaccggtttaccgtttacccccgaaaagggtaaaccgtaacccgtaaaaccgtaaaccccggtaaacggtaaaaccgggtttacccgttaaacgtttaaccggtttaaccgttaaccgtttaccgggtaaaacgtaaaacccggttaaacgggtaaaaccgttaaacccggtaacccgttaaaccgggttaccgggaaaccgggttaaccgggaaaccggggtaaccgtaccgggtaaccgtttacggttaacgttaaccgttaacgttacggtacggtaaccggttaagggtacgtaacgtttaccgtaacggttaccgttaaccgtttacccggttacgtttttacgaaccttttaacccggg

SEQ ID NO: 46640 - DNA, 809 bp, Homo sapiens
  misc_feature: GYAE6OF02G3H3B.27.57.F02.1.454.CMB.1.raw
  modified_base (291)..(291): a, c, t, g, unknown or other
  misc_feature (291)..(291): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagcttgggttttccttgttgctattttagaggtgtccagtgtgaggtgcaactggtggatttcgtagggaggtaggtggtcggtccagccgtggaacgtaactccccgtagacgtaccttcctcctgtcgctacgtcctcgnggtacttcctacgtttagttagtttagttggatggtacgtcggtcgggtccgctacgaccgtacggaagggggacgggtcgttagggtcgttcggtacggaacccaaacgtaaacttaaaaccgaaggtaacgtaaggggtaaaacgggtaaaaagtaaaacgttaacgtaggttacggtaacttcggtaaggttaacgggaaccggggtccgtaactttaccccgtaaccgtaacccttacccgttaaccgacggtaaaaccgtaaacccgaaaaccggaacccgtaaaaggtaacctaaccgtaaccgttagttaccgttacgtaacggaaacttaaacgacgtaaaccgacggtaccgtaaggaaccggacgggaaccggtaccggaacgaccggtacgttaacgttacgttaccgtttacggtacggtacgggaccggtaacggtaacccgttacgtttaccgtaacggttccttacggtttaccggtttacgttttacgtaccgtttacccgg

SEQ ID NO: 46641 - DNA, 759 bp, Homo sapiens
  misc_feature: GYAE6OF02IEPXI.27.57.F02.1.454.CMB.1.raw
  modified_base (190)..(190): a, c, t, g, unknown or other
  misc_feature (190)..(190): n is a, c, g, or t
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (677)..(677): a, c, t, g, unknown or other
  misc_feature (677)..(677): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgttgggtttcctgtgctatttagagtgtcagtgtgagtncagtggtagattcgtggagngtgtgtcagcgtgganactccagacgactctccgttgcgcgctcctcgtaggtacttccttacgtttagttagttagttggatggacgtcgtcggttccgccgtagacgttccggaggggtaacgggtcgtaggtacggttccggtggaaccctaacgtaaactaaacccgaaggttagtaaggggaaaacggttaaaacgtaaacgtagttacggtacggtaacgttacgtaacggtacgggtaacggggtaaccctagttacccgtaaacctcgttacccaaccggtaacgaaaccggtaaccaaaccgggaaactaaacgggtaacctaccttaaacgggttccttaacgttacgtaaccgtaaaccgtaaagttaaacgaaccgtacggtaacccgtagggtaaaccggaccggcggaaacgggtccaccggttaagttcgaacgttaccgacgtttaacggnggtaccgtaaggtaacgtacccgttacggttacgttaccgttaaccgtttccggtttaccttaccggttaatttcccggggg

SEQ ID NO: 46642 - DNA, 1045 bp, Homo sapiens
  misc_feature: GYAE6OF02HTDHZ.27.57.F02.1.454.CMB.1.raw
  modified_base (107)..(107): a, c, t, g, unknown or other
  misc_feature (107)..(107): n is a, c, g, or t
  modified_base (155)..(155): a, c, t, g, unknown or other
  misc_feature (155)..(155): n is a, c, g, or t
  modified_base (177)..(177): a, c, t, g, unknown or other
  misc_feature (177)..(177): n is a, c, g, or t
  modified_base (922)..(922): a, c, t, g, unknown or other
  misc_feature (922)..(922): n is a, c, g, or t
tcagagcgtcgtctcacgaccggtgctcgatttagctcgatatagttgggtttgaggtctcagagaggagccttagccctggactccaaggccctttccacttggtnatcagcacggagcaacagaggaccccacatacggaactggggctgagnttcgggttttcctgtagacttntttaagaaggtcgtaccaggtgtgaggtgacaaccgtggtggtaacgttcgtagggaggtcgggttgtacgggtacctaggcccgttagggaacgtaaactccccgtagggaactacgttccttccggtaggtcgcccggtaagtcccccttgtacgggtaacctttaacccggtaacctttaaaaggggttttaccggtttaaggttcggggtaaccctttaggaacgggtcccggttaccggggttaaccccaccggggtaaacgggaacccgtaaccggggtacggggggaaaacggggtttcggttacggggggtaaccggttttcgggtacccgggaaaccccctaaaacgaaaaaccggttaaaaccggaaaacgggtttaccgggaaagggggttaaaaaacccgggttaaaaaagtaaacccggtaaatttagggggtaaaccggtacccttaggggtggggtaaaacccggggtaacgggttaaccacgttacccgaaccggtttaaccgttcaaaccccggttacgggtaaaaaccggacccctaaaccgggaaaaacccgttaaaacgggaaaccttttacgggaaacgttaaacccgtttaagaacccgtttaaagggaacccgtttaaaaaggtccggaaaaccttcgggtaaaaccgttccggaacggttaccgggaaacccggaacggttacccggtaacgaaacccgttttgtaacgttttaaccccgngtttaaacggggttccgaaaaccggggtataaaccccgtaaacgttcccgtttaaaacgggttcccttttaccccggggtttaaaccttacgggtttaaccccgttttggtaaacccccgggg

SEQ ID NO: 46643 - DNA, 652 bp, Homo sapiens
  misc_feature: GYAE6OF02FGLKQ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggtttccttgttgctatttggaaggtgtccagtgtgaggtgcaacgtgggtggattcgtgggaggaggtgtggtccagcctggagaatccctaggacgacctcctccgtgtcgcagcctgtggattcctacctttagtagttacgtggatgacgtcgtcgggtccacctagaccttccggaaggggagggcgtggtacggttcgcggaccaataacgtaaaaccgaagtacgtaggggaaaggtaaaacgaaaacgtgtaggtagacctcgtaggtacggaacggggtacctagttacccgacctacgtcctaacccgaggacgtaaccgaaccgtacgaaacggacgtccaattacgtactcgtacgactaaagtcgaaactcgaccgtggaacgaacggtccggaaacgacgtacggcgttagtaaccgttagtacgtacgggtatacggagtattacccgtagtaccgtcttaccgttcgttccgttgtaccttcgg

SEQ ID NO: 46644 - DNA, 835 bp, Homo sapiens
  misc_feature: GYAE6OF02HNLMH.27.57.F02.1.454.CMB.1.raw
  modified_base (213)..(213): a, c, t, g, unknown or other
  misc_feature (213)..(213): n is a, c, g, or t
  modified_base (772)..(772): a, c, t, g, unknown or other
  misc_feature (772)..(772): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacagtggaagttgggctggagcgttggttttcctgttgcttatttagaggtgtcagtgtgaggtgacacgtggtggattcgngggaggtacggtggtacggtccgacgtccgtagggacgtactcccgtaggaacgtccttcgttccgttggtacgccgtacgtcccctcggttacggttacgtttaccgttaaccgttttaaggttagtttaggttacggtagttaggacggttccggttagggtccccggtaacgtacgtaacccggttcgggaaacgggggtaggggtaccgttacgggtacgggttaccggtaccggaacccgttaaaacggtaacgtaaaaccgtaaaggtaggttaaacggggaaaacggtaaaaacgttaaaccgtagggtacggtacggtaccgttaacgttaaggggacgggtaaaccgggtccgtaacttaccgtaacccgttatacccggttaacgaacggaaaccggaacccgaaaaccgggacgtaaacggtaaccgttaccgtaaggttaacgttaacgtaccgtagaaacttaacggaaactaaacggtaccgtacgtaacgggacgtaccgggacgaacgggaccgtacggtaccgtagtaactaccgttacggnggtcgacggtataccgtaagtcgtaacgtccttacgttcggttactttggtacctttaccggg

SEQ ID NO: 46645 - DNA, 644 bp, Homo sapiens
  misc_feature: GYAE6OF02GHTHB.27.57.F02.1.454.CMB.1.raw
  modified_base (178)..(178): a, c, t, g, unknown or other
  misc_feature (178)..(178): n is a, c, g, or t
  modified_base (184)..(184): a, c, t, g, unknown or other
  misc_feature (184)..(184): n is a, c, g, or t
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (324)..(324): a, c, t, g, unknown or other
  misc_feature (324)..(324): n is a, c, g, or t
  modified_base (348)..(348): a, c, t, g, unknown or other
  misc_feature (348)..(348): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaacgtggggctgagcggtggtttcgtgtagctattagaggtntcagtntgagtagcagtggtgattnaggaggaggtgtggtccagtccgtaggacgtaactcccgtagacgtctctcgtgacgcncgtcctcgtaggatttaccgttacgtttagtagtttagttggatggacgtcgttcgggaccncgacgtaccgacggagggacgggngtcgggtacgtttcggacgaacaacgaacgtaaaaccgaggtaagacgggtaaagtaaaacgtaaatgttggaccgtatcgtaggtaggaacggcgtaactccgaactcaccgtacgaagtaaccgaccaacggtaacaacggactaccgatagtactttcacgaacaaagttagacgatctagagacgtacggacgcgaacgttcgaattagttacctggaacgtcgggtacgtaaggtccaacccggttataccgttaacttccgttaccggtttatttaccggacttaccggg

SEQ ID NO: 46646 - DNA, 640 bp, Homo sapiens
  misc_feature: GYAE6OF02F4JG4.27.57.F02.1.454.CMB.1.raw
  modified_base (266)..(266): a, c, t, g, unknown or other
  misc_feature (266)..(266): n is a, c, g, or t
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaactccctgagactctcctgtgcagcctntgattcacctttagtagttattgggatgagtcgtcgggtccncagaccgtaccggagggaacgggctagggtacgttcggtaggacccaanaactaaaccaagaagtaggaaggtaaaagaaaactagtagtaggactcgtaggtaggaagggccgtattaccacctacgtcctaccgaaagacgaacgaaccgaccgaaaagacgtactacgttacggtataccgtagaccgtaaaatccgaaaactacgaccgtaagacgtacggacccggaagggaaccgacggcgttaacgtacctacgttacgtaggtcgaacggtagaaggtacttacccgtacgtaccttacgtttaccgtcgttttagactcccgg

SEQ ID NO: 46647 - DNA, 675 bp, Homo sapiens
  misc_feature: GYAE6OF02GB9D6.27.57.F02.1.454.CMB.1.raw
  modified_base (659)..(659): a, c, t, g, unknown or other
  misc_feature (659)..(659): n is a, c, g, or t
tcagagcgtcgtctcacgaccggtgctcgatttagctcgatatagttggggtttgaggtctcagagaggagccttagccctggactccaaggcctttccacttggtgatcagcacggagcacagaggacccaccatggaactggggctgagctgggtttccttgttgcttatttagaggtgtccagtgtgaggtgcaactggtggattcgtggaggtaggtgtggtccagtccgtggagaactcccgtgacgactcctccgtgtcgcacgcctcgtggtacttcctaacgtttagtagtttattggattaggacgtcgttcgggtccgacctaggaccgtccggaaggggaacgggtcgtgggtacgtttcggtcggaccaacgaactaaaaccgagaagtaggaaacggtaaaataaaacgtgtaggtggtactcgtaggtacggtaacgggcctaacttccaaccgtatcccgtacgaaggtacgaaaccaaaccgaccgaaaggtaactcccaaggtttataacttccgttagaaccttaaacgtcgaactcgtaccgagggaacgcgggaccgtaagacccgtacgggtacttaagtaccgttactacggtggaaccgtacggatacggattccggtagtacctagtttccgttntttacggattcccggg

SEQ ID NO: 46648 - DNA, 744 bp, Homo sapiens
  misc_feature: GYAE6OF02GYQ2Y.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctggtttctgtgctatttagagtgtccagtgtgaggtgcaacgtggtggattcgtggagaggtgtggtccagccgtggagtaacgtcccgtgaacgtctccgtcctgtcgccacgtcctcgtaggtactttaccgtaaccgtttaagttaggttacgttacggagttaggtaccggtcggttccgggttacccgaccgtaacggtaacccgttacccgggaagggggtaaacggggtccgttacgggtaacggttttaccggaccgggtaccccgaaaaccgtaaacgtaaaaaccggtacggtaagttacggggaaaggttaaaacgtaaaaacgttgtacgggtacggtaccttaggtacggtagggaacggtaccgtattacccgaactattcccgaagtaacggaacacgaaaccgtaccgaaaggtaacgtccttaacggtagtacttacgaggtaaaccaagttaacggaactcgtacgtacggaacgtacggccaaaggacccgtagtccgtagtaacctctaggtagcggaacgtacgtacgtacctacgtacggtcctacgtttccgttaacgtttcgaacttccgg

SEQ ID NO: 46649 - DNA, 810 bp, Homo sapiens
  misc_feature: GYAE6OF02F8YSB.27.57.F02.1.454.CMB.1.raw
  modified_base (237)..(237): a, c, t, g, unknown or other
  misc_feature (237)..(237): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgtgctattttagaaggtgtccagtgtgaggtgcaacgtggtggattcgtgggaggaggtgtggtccagcctgganaactccctgacgactcctcctggtcgcgagcctcgtggtactctacctttagtagttattggatggtagcgtcgggtccgccgaggtccttaccggaggggaaggggtcgtagggtacggtttcggcggaccctaaacgtaacgtaaaaccgaggtaacgtaggggtaaaggtaaaaaggtaaacgtaagtacggtaggtactacggtaggtacgggtaacgggccgtattaccgacctaacgtataccccccccccgtaaggtaaccgaaaccgaaaccggtaaaccgtaaacggtaaacgtaccgtaacgttaacgttacgtaccgttaacgtaacgtaaacgtaaacgtaaacgtaacggtaaccgtaacgggaacggtaaccgggaacccgggtaacgggaaccggtaaacccgggtaacggttacgttaaccgttaccgttaacggtaccgggttaacgggtaaccgggtaacggtaaccggtaaccgtttaacccggttaaccggtttaccgttaacccgttttaccggttttaacccggtttttacggttaaccgtttacccgggg

SEQ ID NO: 46650 - DNA, 612 bp, Homo sapiens
  misc_feature: GYAE6OF02HGVH9.27.57.F02.1.454.CMB.1.raw
  modified_base (513)..(513): a, c, t, g, unknown or other
  misc_feature (513)..(513): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattctgggaggaggtgtggtccagcctggagaactccctgagactctccgtgtgctagcctcgtggtacttctacctttagtagttattggatggagctcgggtccgccgagacctccgaaggggaacggggcgttggaggttcggtcggaccaaacgtaaacgtaaaaccgaagaacgtagggaaacgggtaaaagtaaaaacgttagtaggtaggtactcgtagtacgggaacgggtaccgtattaccacctactctaccgagacaacacgacaagtagacacgtatatctagactaaagcgaacngtacctgacgacgaccgaaggaccacggtctagtactacgtcgtcggtgacgagtagaccttacgtacgtctactttaccggtcttttacgacttccgg

SEQ ID NO: 46651 - DNA, 836 bp, Homo sapiens
  misc_feature: GYAE6OF02GO66N.27.57.F02.1.454.CMB.1.raw
  modified_base (183)..(183): a, c, t, g, unknown or other
  misc_feature (183)..(183): n is a, c, g, or t
  modified_base (245)..(245): a, c, t, g, unknown or other
  misc_feature (245)..(245): n is a, c, g, or t
  modified_base (692)..(692): a, c, t, g, unknown or other
  misc_feature (692)..(692): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaacgtggggctgagcttgggttttccttgttgcttatttagaaggtntcagtgtgagtgacaagtggtggattcgagggaggaggtgtggtccgaagtccgtagggaanaacgtccctagaacgtacctaccttccgtagtcgaccgtaacgtcccgttacggtaggtactttacccgttaaaccgttttaaggtttaacgtttaaggtttacgggaacgttagggtaaccggtccggggtttccggggtaacccggtccccgtaaacggtacccggtacccgggtaaagggggggaaacggggttcctagggggtaacggtttccgggaaccggtaaccgaaaaccgtaaaacgttaaaaaaccgaaggtaacgttaaaggggaaaaacggttaaaaataaaaccggtaggtaggtaacggtaacttaggtacggttaaacgggaaccgggtacctacgttaaccaacccgtacttaacccgtaccgaaaggtaccgtaaaccgaaaccggaaccgtaaaagacccgtacgtaactaagttaacctgaacgtaanaagtaacaacgtcgaacgtcggaaagtaccgaacggaacggtacacggttaccgtaagttaacgtacgtccggtaggtaacgaagtaaggtaaccgtcttacgttagtaccgttacggttacccgtttgttactacggtcccgg

SEQ ID NO: 46652 - DNA, 766 bp, Homo sapiens
  misc_feature: GYAE6OF02FMG65.27.57.F02.1.454.CMB.1.raw
  modified_base (186)..(186): a, c, t, g, unknown or other
  misc_feature (186)..(186): n is a, c, g, or t
  modified_base (219)..(219): a, c, t, g, unknown or other
  misc_feature (219)..(219): n is a, c, g, or t
  modified_base (614)..(614): a, c, t, g, unknown or other
  misc_feature (614)..(614): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcttgggttttccttgttcgcttattttagaaggtntccagtgtgagtgcaacgtggtgattcgtaggnggaggtgtcggtccacgtcctggagtaactcccgtagacgtaccttctcctggtctcacgtcccctgtacggtaacttccgttaaccgttttaggttaacgttttagttagggtaagtaggtaccggtccggttaggggtccccgacgacggtaccctaccggaagggggaagggtcgtacgggtacggtttcgtacggacctaaacgaaacgttaaaaccgaagtaacggtagggaaaaggttaaaaacgtaaaaagtcgttaaggtcggtacgttgtaggtacgggaaccggtccttaagtcccaaacgttcttacccgtacgaaagtacgaaacctaaccgggaccaaaaggtaccgtcctaacgttagttactcgttaacgaactaaacgngaaacgccgtaacgtgaacgggtacgaccccgggagtaaccccggtagtgttaaccgtaacgttacgtacgtgggacctacgggagtacctacttttaccgtaacggtcctttaaaccggtttcccggtttattttacggtccgttaaccgg

SEQ ID NO: 46653 - DNA, 819 bp, Homo sapiens
  misc_feature: GYAE6OF02GR804.27.57.F02.1.454.CMB.1.raw
  modified_base (341)..(341): a, c, t, g, unknown or other
  misc_feature (341)..(341): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacgacccacagtggaacgtgggctgagtcgttggttttcctgttgtcttagtttacgaggtcgtccagtcgtggaggtgactaacgtggtaggtacttcgtgggaggtaggtgtcggtacgacggtccgtgggactaactccgtgtaacggtccttccgtcgtggtacgcctcgtccttcgtagtactttcgttaacctttaggtagttacgtaggtnggtacgtcggtcggacccgtacaccggtacgtacggaaggggtaacgggttcgtaggttacggttcggaccgaacccgtaaagaaacgtaaaaccgtgtaaccgggtaaagggtaaacgttaaaaacaagttcggtttacggagttactacggtaaggttcggaaccggtcgtaactccgaaaccttctaccgtaacgaaggtacaacccggaaaccgtacgaaacgttaggaaacccttcggtacgtagtttaccgaactaaacgttaacgggacctaaaggtcccggacccgttaggaaccggtaccggaaaccggggaacgtaaccccgggttacggtaacgttacggttaacggtttacccgtacggacgggttaacggacccgttaagggtaaaccccttcggtttaacgttaccggttaccgtttaccggggtaacctttttcgggttaacccgttaacgggtttcccgggg

SEQ ID NO: 46654 - DNA, 718 bp, Homo sapiens
  misc_feature: GYAE6OF02ISO1D.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctatttagaggtgtccagtgtgaggtgcaacgtggtggattcgtgggaggtaggtgtggtccaggcctgggagaatccctagacgtactctcctggtgcacgtcctcgtggtacttcctaaccgtttagttagtttagtacggatgagtcgtcgggtccacagacctcggaggggacgggctggtacgttcggacggaccaagaactaaacgagtagtagggaaagtaaacgaatagtacggagtagtctaggaggtacggacctgtacactacgtacctacgagacgaacgaccgaacgaacgtacgtacgtacgtacgtactccgtacgaacgtaacgtacgaaccgtaccgtacgtacgggaacgtaaccgggaccggtaacggaacccggtacggtaaccgttagttaaccgttaccgttaccggttacgggtaacggtaccgggtaaacggtaccggttaaccggttacccgttaacggtttccccggttaaaccggtttttcccccgggttaaacggttttttccgggaacccttttacccggggg

SEQ ID NO: 46655 - DNA, 776 bp, Homo sapiens
  misc_feature: GYAE6OF02JHVMF.27.57.F02.1.454.CMB.1.raw
  modified_base (118)..(118): a, c, t, g, unknown or other
  misc_feature (118)..(118): n is a, c, g, or t
tcagagcgtcgtctcacgaccggtgctcgatttagctcgatatagttgggtttgaggtctcagagaggagccttagccctggactccaaggcctttccacttggtgatcagcacggancacagacggacccaccatggaacgtgggctagagcgttgggttttcctgttgcttatttagaggtgtcagtgtgagtgcaatggtgtattcgtagggaggtaggtgtcggcccaggtcccgtaggtaagaacctcccgtaggacgtacctccgtccgtgtcgctaccggtccttgacgtactttcctaaccgtttaaggtacgtttagttacggtataggtacgtccggttcgggtaccccgtacgtaaggtaccgtaccggaaggggtaacgggtcgtacggtcgttaccggtacgaacctaaacgtaagtaaaccgaagtacggtaaggaaaacggtaaaacgaaacgttacgtggaaccgtactacggtacggttaacgggaacggtacctaacgttaccgaaccttacgtaccgacgtaaaggacctaaaccgaaccgaacctaaacggtaactcaaacgttggtacttaacggtacggaacgtaaacttaacgggaacctacggtacctaggggaaacgttacccgacgggaaacggaccgtaaacggtcgttaacgttaacgttaccccgtggtaaccggtcggaaacgtaggtaaccttaccgttacgtaaccttcgtacccgttttaccgttagttaccttacgtccggg

SEQ ID NO: 46656 - DNA, 796 bp, Homo sapiens
  misc_feature: GYAE6OF02JL7XK.27.57.F02.1.454.CMB.1.raw
  modified_base (207)..(207): a, c, t, g, unknown or other
  misc_feature (207)..(207): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (326)..(326): a, c, t, g, unknown or other
  misc_feature (326)..(326): n is a, c, g, or t
  modified_base (781)..(781): a, c, t, g, unknown or other
  misc_feature (781)..(781): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttcctgtgctatttagaaggtgtcagtgtgaggtgcaacgtggtggattcgngggaggaggtgtggccaggcctggagaactccctggagactcncgtgngcacgcctgtaggattccgacctttaggtagtttaacgttaggattaggacgtaccggttcggggtacccnccgtacggaccgtaccggaaggggaacgggtcgtagggtacgttccggtacggacctaaaagaacgtaaaacccgaggaagtacggggtaaacgtaaaaccgaaaattaggtcggtaagggtaccttacggttacggtacggggaaaccggtaccggtacttacccgtaacgtacgttaccctacccgggaaagtaaccgggaacccgaaaaccggttgaaaaccggtaacgttccgtaaacggttccggtaaacttacccgtaaggtaacctaaaaacgtgtaaaccgaacggttccggaagtacgggaaccggtacccggaaacgggtaaccctaacgggtaccggtaacttaaaccgttaccgtaccggttagggtaaccggacggttaacgaaggttaacccgttacccgttagttaaccccgttccggtttacccgtttacggttttaanacccggttacccggg

SEQ ID NO: 46657 - DNA, 681 bp, Homo sapiens
  misc_feature: GYAE6OF02I7MLR.27.57.F02.1.454.CMB.1.raw
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgttgggttttcctgttgcttattttagaaggtgtccagtgtgaggtgcaacgtggtggattcgnggaggnggtgtggtccagcctggagaactcccgtgacgactctcctgtgcacgcctgtgtacttctactttagtagttagtgatgacgtcgtcgggtccgccgacgaccgtaccggaaggggacgggtcgtgggtagttcggtcggaacctaacgaactaaaaccgaagtaagtaaggggtaaacggtaaaacgaaaactagtaggtacggtactcgtaggtacgggaacggtaccgtattccgaacctatcctacgaaggaacgaacctaacgacgaaagtacgtacacgttagtactacgtacgaactaaagtaccgaaacacggtacctaggacggaacgaccgggaaggacccgtaacggtacgttagtaacttccgtaacggtaggtacggaacgagttacggtaccttacggtacgttaccgttacgtttccccgtttagttttacgacccgtttccggg

SEQ ID NO: 46658 - DNA, 708 bp, Homo sapiens
  misc_feature: GYAE6OF02GQGA1.27.57.F02.1.454.CMB.1.raw
  modified_base (194)..(194): a, c, t, g, unknown or other
  misc_feature (194)..(194): n is a, c, g, or t
  modified_base (324)..(324): a, c, t, g, unknown or other
  misc_feature (324)..(324): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggtttccttgttgcttattttagagtgtccagtgtgaggtgnaacgtggtggattcgtggaggaggtgtggtccagccgtggaagaatcccgtgacgactcctcctggtgcacgcctcgtaggtacttcctaaccttttagtagttagttggtatgagtcgttcggggtccnccgacgtaccgtaccggaagggggtacggggcgtagggtacggttcggtacgggaacccctaaaacgtaaacgtaaaacaagggaagtaaggggtaaaaggtaaaaagaaaaacttagtacggtacggtactcgtaggtacggaaacgggggtcctaactaccgtaacctacgtttccctaacgaaggtaaacaccgaaacgtaccgaaagtaacgtcaaacgttgtaacttcgaacgtaactaaagacgaacgtacggtaccgtaggaacgaccggacggaaacggccaacggttccgagttaactacgttccggtagtccggtaacagggtaacctacgtccgttaagtaccttacctttcggtttctttacgcttcccggg

SEQ ID NO: 46659 - DNA, 748 bp, Homo sapiens
  misc_feature: GYAE6OF02I8TPC.27.57.F02.1.454.CMB.1.raw
  modified_base (185)..(185): a, c, t, g, unknown or other
  misc_feature (185)..(185): n is a, c, g, or t
  modified_base (199)..(200): a, c, t, g, unknown or other
  misc_feature (199)..(200): n is a, c, g, or t
  modified_base (342)..(342): a, c, t, g, unknown or other
  misc_feature (342)..(342): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggttttccttgtagcctattttaggaaggtntccagtgtgaggtnntaactggtggtattcgtggaggtaggtgtcggtaccagtccgtgggacaacttccccgtaggacgtcgtccgtccgtggttcgacacggcttcgtaggtcttcctacgtttagtagttagttgacgtgacggtcgtggtccncgataccgtccggaagggcgggtacttcggtaggttcgtggtacccaaacggtaacaaaccgtagtagttagggaaacgttaaaacgaaacttaggtaacggttcgtaacgttcggtagggtaccggtaaacggggtcctaacgtttacccgaccgtaacctttccggtacctaacggacgaaccgtaacggacccgaaacgtaacgttcgtaacgttacgtacccgtagtaccggtaacttaacgaacggaaccgtaagttaccccggtaggaaccgggaccgaaccggggaacgttaacccggacggtccgttacggtaactaccggttaaggtcgtacggtcgtaatacggtaccgttagttacgtctccggttaactttcccggtttattcggttaacccgg

SEQ ID NO: 46660 - DNA, 681 bp, Homo sapiens
  misc_feature: GYAE6OF02JQYX4.27.57.F02.1.454.CMB.1.raw
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (616)..(616): a, c, t, g, unknown or other
  misc_feature (616)..(616): n is a, c, g, or t
  modified_base (627)..(627): a, c, t, g, unknown or other
  misc_feature (627)..(627): n is a, c, g, or t
  modified_base (678)..(678): a, c, t, g, unknown or other
  misc_feature (678)..(678): n is a, c, g, or t
tcagagcgtcgtctcacgaccggtgctcgatttagctcgatatagttgggtttgtaggtctcagagaggagccttagccctggactccaaggccttcctaccttggtgtactcagcacggaggcgacagaggacccacctactggaacgtagggcgtgagcgtgggttttccttgttgctattttagtaaggtgtccagtgtgaggtgcaactgtggattctgggagaggtgcggtcagctgaggaatccctgagacttactcctgtgcncaccgtctaggnttacacctttagtatttagttggctagtatcggtcggccggtcaagaccgttcacgggaggggctgtaggtcgtcggacaaccagtaaaaccgaagtacgtagggtaaagggtaaaacaaaaaccgtttaatacggttaggtccgtttaccgtaaaggttcggggaaagggtaccccgggtaatttaccctaaccggactttaccgttacccggaacggaacgtaaaccgaaccgtaaacccgaaaggtaaaccgttacgacttacgttacggtacctgaaaccgtaaactagaacccggtagccctagtaggaaccgcgaacggaccggaacngtaccgtttanaccgttagtgaggacgaggacagttcctagtctcttccggtacttttacgntcc

SEQ ID NO: 46661 - DNA, 796 bp, Homo sapiens
  misc_feature: GYAE6OF02HWJ48.27.57.F02.1.454.CMB.1.raw
  modified_base (349)..(349): a, c, t, g, unknown or other
  misc_feature (349)..(349): n is a, c, g, or t
  modified_base (669)..(669): a, c, t, g, unknown or other
  misc_feature (669)..(669): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctgagcgttgggttttccttgttgcttattttagaaggtgtccagtgtgaggtgacactggtggattcgtggaggaggttgtggtccagccgtagggagaaacttccccgtagacgaccttcgtccctaggttcgcacgtccgttcgtggtactttcctaccgtttagtagttttagttggtatgtaacgtcgttcggggccccnccgtagaccgttccggaagggggacgggtctagggtacggtttcgtacggacccaagaaacgttaaaaccgaagacgttagggaaacggtaaaactaaaacgttacttgggacggtactacggttagaagggtaacggtacgtacttaccgaacgtaccttcgacccgaaaggaaccgaaccgtaaaaccggaaccaaaagggtaaccttccgtaaaccgttaagttccgtaccgtaagtaaaccgaaaattacccgggaaactccggttaaaccgtacgggaacgtaaccgggccccgggaaagtaacccgggtaacgngtttttaaacgaaccgtaccggttttaacggtagggtcccgggaaagtcggaaaacgtttccctaccggtttaaaggtccccttaaacggttttcccgtttactttttcgggtaactttccccgggg

SEQ ID NO: 46662 - DNA, 764 bp, Homo sapiens
  misc_feature: GYAE6OF02JY7OO.27.57.F02.1.454.CMB.1.raw
  modified_base (192)..(192): a, c, t, g, unknown or other
  misc_feature (192)..(192): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (679)..(679): a, c, t, g, unknown or other
  misc_feature (679)..(679): n is a, c, g, or t
  modified_base (687)..(687): a, c, t, g, unknown or other
  misc_feature (687)..(687): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggaccacatggaactgggctgagctgggtttccttgtagcttatttagaagtgtccagtgtgaggtgnaacgtggtaggattcgtggaggaggtggtaggtccagccgtagggacactccctaggacacgtntcctagtcncgcggtcctgtaggtacttccaccggtttagtacgttagttggattggagtcggttcggtcctacgacgtaccgtaccgaaggggaaccggttctagggtaacggttcgtacgggttaactaaacgacgttaaaacccgaggttgaaaacgggttaacgtaaaagaaaaccgtttagttgggtaagtacccgtaggtacgttacggggaaacccggtcggtaaccttacggtaacctgggttaaccctacgtaaggaaccggttaaccaaaccgtaacccggaaagggtaacccgtacgtaacctttcggtaaaacgtccgtacgggtaaactaagtacggtaactaagggaccgtaaggttaacggaccgtaccggaagtttccgaacggaccgtttgtaacccttacgggtnttaacggngggacccgttaacggtaggtaacccttacggtaacgtccgttaaccgttttccgtacgtttaacgttcgttcccggg

SEQ ID NO: 46663 - DNA, 742 bp, Homo sapiens
  misc_feature: GYAE6OF02JGTYO.27.57.F02.1.454.CMB.1.raw
  modified_base (190)..(190): a, c, t, g, unknown or other
  misc_feature (190)..(190): n is a, c, g, or t
  modified_base (265)..(265): a, c, t, g, unknown or other
  misc_feature (265)..(265): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggtttcctgtgctattttagaggtgtccagtgtgaggtncaactggtggattctgggaggtaggtggtggtaccagccgtaggagaacttcccgtgagacctctccgtgcgacncgcccgtctaggacttctaccgtttagtagtttagttggtaattggtacgtcggttgggttccgaccgagtaccgtaccggagggggaacgggtcggtacgggaacgtttcggaccggaccaaacgtaacttaaaaccgaaggtaacgtcgggtaaaggtaaacgaaaacgttagtacggtagtaccgtcgtaggtacgggtaaccggtacgtagtttaccgaaccgatttaccgacctagaaccggaaacaaccggtaacccgaaaggtaacggtaccttagtaacggttactaccgtacggtaactaaaagttaccggaaacgtacgtaccgttaacggtacggtaacggaccgggaagggttaacccgacggttaaaccgtagtaacttaacggtctacggtaacggtacgtaggaaccggtactcccgttaacgtccgttaccgtttaacgtcggttttactaccgttcccgg

SEQ ID NO: 46664 - DNA, 784 bp, Homo sapiens
  misc_feature: GYAE6OF02INUYI.27.57.F02.1.454.CMB.1.raw
  modified_base (428)..(428): a, c, t, g, unknown or other
  misc_feature (428)..(428): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaactggggctgagcgttggtttcctgttgcttatttagagtgtccagtgtgaggtgctacgtggtggattcgtgggaggtaggtggttggtccaggtcccgtaggggaactaacgttcccaggaacgtcgtcttccgtgtcggactacggtccctgttaggtactttaccgtaaccgtttagttaggttacgtggagtgtaagtccgttcgggtaccaccgtaagtaccgtcggaagggggtacggcgttaggtcgtttaccggcggaacctaaactaaacgtaaaaccgnggtaacggtaaggggtaaaacgtaaaacggtaaacctgttacggtacggtaacctggttggaaaggggaccggtctaacttacgacctacgtcctaaccggaagaacgtaacccaacggaacttaaaaggcgtaacccttggtacgtttacgaccgtaaagtaacggtaaataccggtaacgtaaccgtccggttaaggaacgggaccgtacccggggaaacggtaccgggaaaccggttttcgtaacgttaaccgtacgtttaacggtcgggaagaccgggttaaggtaaaccccgttctttaaccgtcgggttaactccccggttttaaggttctttaccggaggttacccggg

SEQ ID NO: 46665 - DNA, 723 bp, Homo sapiens
  misc_feature: GYAE6OF02H073Y.27.57.F02.1.454.CMB.1.raw
  modified_base (589)..(589): a, c, t, g, unknown or other
  misc_feature (589)..(589): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagcttggttttccttgtgctattttagagtgtcagtgtgagtgcaacgtggtggattctggaggaggtgtggtaccaggctaggagaatccctagacgtctactccgtgtgcacgcctcgtgtacttctaccgtttagtagttacgtaggtactaggtcgtcgtggggttcccgaccgtaacgtaccgtcccggaagggggaacgggtccgtagggttacggttccgtacgggacccttaaaacgaactaaaaacggacgtaaaggtcgggtaaaacgggtaaaaagaaaacgtttagtacgggtagtaccgttagttaggtaaccggggaaccgggtctaacggttacctaccgtacgtaccgtaccgtaacgacgaaacgaaccgtaacgtaacgttaacgacgtacgttagtaacgtacgtagtaacgaaagtcgaaacnccgtacgtagaaccgggtcgacccggaagaccggtaacggtgtaccgttataccgttacgtacggtacgtacggtagacggttaacctaccggtacgttacgtacgtttccgtacgttttaggacctttcccgg

SEQ ID NO: 46666 - DNA, 574 bp, Homo sapiens
  misc_feature: GYAE6OF02IR0F5.27.57.F02.1.454.CMB.1.raw
  modified_base (446)..(446): a, c, t, g, unknown or other
  misc_feature (446)..(446): n is a, c, g, or t
  modified_base (504)..(504): a, c, t, g, unknown or other
  misc_feature (504)..(504): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtcagcctggagaatccctgagactctcctgtgcagcctctggattcacctttagtagttattggatgagcgtgggtccgccagacctccaggggaacgggctggagttcgtggccaaacataaaaccaagaagtggaaaggtaaagaaaaactataggtagactctgtagaagggccgtattcaaccatctccagagacaaacgaccaaagaagtcaacgtntaatctagacaaaatcgaaacagacctaggagagcccgaaggaccgacggctagttanacttactggtcgacggtaagaagtactaccgttagtactaaccgtttccggttcttttacgactttccgg

SEQ ID NO: 46667 - DNA, 730 bp, Homo sapiens
  misc_feature: GYAE6OF02I3X5O.27.57.F02.1.454.CMB.1.raw
  modified_base (313)..(313): a, c, t, g, unknown or other
  misc_feature (313)..(313): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgtgggtttcctgttgctattttagaggtgtccagtgtgaggtgcaacgtggtggattcgtggaggaggtgtggtccagcctggagaactccctgacgactctcctgtgcagcctctggattccacctttagttagttagttggtatgacgtcgtcgggtccnccgagtactccggaaggggaagggtctagggtacgttcggtacggaccaaagaactaaaaccgaaagtacgtaaggggaaagtaaaaacgtaaaacgttagtaggtacggtaactcgttagggtaacgggtaacgggaccgttactaacccgaccgtaactcccgtaacgaacggaacgtaaaccgaaacccggaaccgtaaaagaacggtacctaacgttcgtacttacgtaacaactaaagttaaccgaaactacggtaccgtaggaacggaccggtaccgggaaagaaccggaccggttcgttaaagtaccgttacgtacggtcgggtaacggtaccggtaaaggtaccgttaaccgttaccgttacgttaacctaccggttttaccgttacgttttacgacctttaaccgggg

SEQ ID NO: 46668 - DNA, 790 bp, Homo sapiens
  misc_feature: GYAE6OF02IWXUX.27.57.F02.1.454.CMB.1.raw
  modified_base (246)..(246): a, c, t, g, unknown or other
  misc_feature (246)..(246): n is a, c, g, or t
  modified_base (613)..(613): a, c, t, g, unknown or other
  misc_feature (613)..(613): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggttttccttgttgctatttagagtgtccagtgtgaggtgctaacgtggtggacttcgtggaggaggtgtggtccagccgtggagaactcccgngagtactcgtcctggtcgcacgcctcgtggtactttaccgtaaccttttaggttaggtttagtttaggacgttgtaacgtcggttggggtccccgaccggacgacccgttaccgggaaggggggaacgggtcggtagggtacggtttccggtacgggtaccaaacgtaactaaaaacccgagtaaacgtaggggtaaaggtaaaacgaaaaaccttagtacggtagggtaaccttacgttacggtagggaacgggtaccttacgttaccaaaccgtacttccctaaccgaacgacgaaccaaccggaaccgaaacggtaaacggtcccttaaacgtggtttaaaccttcgtacgaaccgtttaaaanaccgggaaactacggtaacccgtagggtaaaacggaccgaccgggtaacggaacccgtaacggtaaccgtacggtttactaacccgttaccggttggtacgaacggaggtaacgaccgttttaaccgtaacggttacttaccggtttacccgtttagtttacgtaccctttaccggg

SEQ ID NO: 46669 - DNA, 742 bp, Homo sapiens
  misc_feature: GYAE6OF02GPIVP.27.57.F02.1.454.CMB.1.raw
  modified_base (197)..(197): a, c, t, g, unknown or other
  misc_feature (197)..(197): n is a, c, g, or t
  modified_base (732)..(732): a, c, t, g, unknown or other
  misc_feature (732)..(732): n is a, c, g, or t
tcagagcgtcgtctcacgaccggtgctcgatttagctcgatatagtttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtncaacgtggtggattctgggaggtagggtgtcggtaccagtcctgggaagtaactccctgacgacctcctcctgtgcacgcctcgtggtacttccgtacctttaggtacgtttagttgggaatggagtcggtcggggtccgaccgagaccgtccggaagggggtaacggggtcctagggtacggtttcgggacggtacccgaaactaaacttaaaacccgaaggtagtaaggggtaaaggtaaaaacgaaaaacttacgttaggtaggtaacctcgttgggtaacgggaaacgggggtacccgtaagtttacccaaccgtacttccctaccggaaggtaacgaaaccgtaacccggaccgtaaagaaccgtaccactttagtacttcgagaactaaagtacgaaacgtcgtcgacggacgtacgggaccgaacggacgtacggtcctagttaacttaccgttaggtaccggttgaccggtaacgtacgtaccttaccgtacgtttcctaacccggttttaccggttcttttacggntttacccggg

SEQ ID NO: 46670 - DNA, 673 bp, Homo sapiens
  misc_feature: GYAE6OF02HF5S5.27.57.F02.1.454.CMB.1.raw
  modified_base (177)..(177): a, c, t, g, unknown or other
  misc_feature (177)..(177): n is a, c, g, or t
  modified_base (276)..(276): a, c, t, g, unknown or other
  misc_feature (276)..(276): n is a, c, g, or t
  modified_base (522)..(522): a, c, t, g, unknown or other
  misc_feature (522)..(522): n is a, c, g, or t
  modified_base (536)..(536): a, c, t, g, unknown or other
  misc_feature (536)..(536): n is a, c, g, or t
  modified_base (658)..(658): a, c, t, g, unknown or other
  misc_feature (658)..(658): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggactggggctgagctgggttttcctgttgctatttagagtntccagtgtgaggtgcaacgtggtggtattcgtgggaggtaggtggtcggtccagccgtaggacgaacttccccgtagacgtacctcctcctggtacgcncgtcctgtgtacttctacgtttagtagtttatggagtggacgtcggtcgggtaccgccacggacgtaccggaagggggacgggtcgttgggtacggtttccggacggacctaaacaacgttaaaaccaaggagtaagggtaaaggtaaaataaacttgtaggtacggtactcgtagggtacggacggtacctactccgactactccctacgaagaccgaacgaacgacgaaagtacgtcctagttntactgagaactaanaccgaactacgacgtagggacacgggttcggaacgtactcggtaccttagtccgtacttaggtccgtaaaggccgtaaagtacttacgccggttagtaaccccgtttgttaacccggttttnttacgtaccggttcg

SEQ ID NO: 46671 - DNA, 787 bp, Homo sapiens
  misc_feature: GYAE6OF02IH8H6.27.57.F02.1.454.CMB.1.raw
  modified_base (645)..(645): a, c, t, g, unknown or other
  misc_feature (645)..(645): n is a, c, g, or t
  modified_base (740)..(740): a, c, t, g, unknown or other
  misc_feature (740)..(740): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcgttgggtttttccttgttgcttattttagaaggtgtccagtgtgaggtgcaacgttggtaggtattcgtagggaggtaggtggtggtccgacggtccgtagggagtaactcccgtagaggtaaccttctccgttgtacgccgcggtccgttcgttacgggtactttcccgtaaccgttttaggttaacgtttagttgggtaatggtaggtccgtcggggtcccacgtaaccggtaccgtaccggaaggggaacggggtctcggggtaaggtttcccggacggtaccaaactaaacgttaaaaaccgaaggtaagttaaggggaaaagttaaaaacggtaaaatccgtaaggtaccgggtaactacgttagggtaacggacgggtaccgtaacgtttaccgaacttacgtcccgaacgtaaacggaaccgaacgaaaccggaacctaaacggtaacgttaccgtaacgttaaaggtccttaagtaacccgggtaanaaacggttaccgaaacgtaccgtacgtaaggacgaccgaacggttaccgggaacgtaggtacctagtaactaccggttctagggcgtacgaacgngttaaaccctgtaacggttccttagttcccttctttaggcgtaccgg

SEQ ID NO: 46672 - DNA, 879 bp, Homo sapiens
  misc_feature: GYAE6OF02HXG0S.27.57.F02.1.454.CMB.1.raw
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
tcagagcgtcgtctcacgaccggtgctcgatttagctcgatatagttgggtttgaggtctcagagaggagccttagccctggactcccaaggccctttccacttgggtgatcagcaacggagcacaggacggaccccacaatggaactggggctgagcttggttttcctgttgctatttagaaggtntccagttgtgaggtnacaatggtggtattctgggaggtaggtgtggtccagcctggagaactcccgtgagtacctctcctggtcgcgtaggccctctggtacttcctaacctttacggttaatttaattggtagtagtaacgtccgttaggggtcccgtaccgaaggacccttacccggaaggggtaacgggggtaccgttggggtaaccggtttacgggttaccgggaaaccctaaaccaaaccgtaaaaacccaaaggtacgttaagggggaaaacggttaaaaacggaaaaactttaggtacggtaaacgggttacgttacgttaggtaacgggaaacggggtacctttaacgtaccgttaaaacccgacgttaaccctaccccgtaacgggtaaacgaacccgaaaacccggtaaacccggaaaacggtaaacggttaacccgtacgttaacggttattaccgttaacgtaaactaaaacgttaaccgaacgtaaccgtaaccgttacgggtaaaccggacggtacccgggaaacgggtacccggtaaacggccggtttaacgtaaacggtttaccttaacccggttagggtaaccggtcgggaaacgttaacgggtaccgttcccgttaaacggttaccttaacccgttttcccggtttaaccgttttacggttaacctttcccggg

SEQ ID NO: 46673 - DNA, 776 bp, Homo sapiens
  misc_feature: GYAE6OF02G3P5L.27.57.F02.1.454.CMB.1.raw
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttccttgttgcttatttaggaggtgtcagtgtgaggtgcaactgggtgattcgtgggaggaggtgtggtccagccgtgganactccagacgactctccgtggngcagcctgtggtacttctaccgtttaggtagtttataggtatcggagtcggtgggtcccgacgacgtccgtacggagggggaacggggcgtagggtacggttcggtacggaacccaaacgtaacgtaaaaccgaaggaacggtaggggtaaaacggtaaaaacgaaaacgttacgtacgggttacggtacctacgttaggtacggtaacggggtaccgtaacttacccggtaacctacgttcccgtaaccgtaacgggaccggtaaacccgaaaccgtaaccgaaaagtacccgtactaacgttacgttaaccgttacgtagaaaccttaaaagtacggaaactacccgggtacctaacggaacgtaacggacccgaaaggggaccgtaaccgggccttaaggttaccgtttaacgtacggtaggttccggaacggtaacggtaacggtaaccgtaccgttacgtaacggtttcccgttttacccggtttacttttacccggttacgttaaccggg

SEQ ID NO: 46674 - DNA, 724 bp, Homo sapiens
  misc_feature: GYAE6OF02FI3A6.27.57.F02.1.454.CMB.1.raw
  modified_base (335)..(335): a, c, t, g, unknown or other
  misc_feature (335)..(335): n is a, c, g, or t
  modified_base (383)..(383): a, c, t, g, unknown or other
  misc_feature (383)..(383): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaacgtggtgtattctggaggaggtgtggtcccaggccgtggagaactcccctgacgtacctctcccttggtcgacacgccctcgtggacttcctaaccgttttagttagtttattggagtgagtcgttcggggtacccnccgtaagacctccggaaggggaacggggtctagggtacggtttccggnggaccctaaactaacgtaaaaccaggtaagtaggggaaaggtaaaaagtaaaaccgtagttacggtacggtacttcgttggtaacgggaaacggggtccctattaccgacctatacccgtccgaaagacggaacccgaaaccggtacccaaaaggtaacgtacccgtaattggtaaccttcgtaacgaactaaagttacgaaaccgtacgtaacctaggaacgaccggtaccgggaacgaccgtaacgggtcttacgttaaccgttactacgggtagtacggtacgaaggactacgttacccgtaagtccgttaccgtttccgttcgttttacgcttacgg

SEQ ID NO: 46675 - DNA, 700 bp, Homo sapiens
  misc_feature: GYAE6OF02JASNV.27.57.F02.1.454.CMB.1.raw
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
  modified_base (259)..(259): a, c, t, g, unknown or other
  misc_feature (259)..(259): n is a, c, g, or t
  modified_base (345)..(345): a, c, t, g, unknown or other
  misc_feature (345)..(345): n is a, c, g, or t
  modified_base (484)..(484): a, c, t, g, unknown or other
  misc_feature (484)..(484): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacgacccacatggactgggctgagcttggtttcttgttgcttagtttagagtgtaccagtgtgaggtgcaacttggngattcgnggaggagtgtgtcagccgtaggaactatcccgtgatactcgtacctgacgcngtcctgtggtacttccgtactttagtagttactggataggtagccgttggcccacgtacgtaccgacccggtaggggaaccgggtntggtaacggttccggagaccaaaacgaacgtaaaacagtacggtaaggtaaaagtaaaacgtaaacgttgtacgggtgtaactaagttgggaccggtaaggtaccggtcttaacgaccggtacttaccggaccgtaaanacgggtaaaccgacgaaccgtaaacgtaacggaccctattaacacgttcaaacggactaaagtacgaaacccggtaacgtactacggtaccgggaaaggacccggaaccggtaaccgtaacggtactaaggtaacccttagtcggttacggaccggaagttccgaagtaccgttacttacggctttaaccgggtcctacggtttgtcccgttacgg

SEQ ID NO: 46676 - DNA, 782 bp, Homo sapiens
  misc_feature: GYAE6OF02J1A25.27.57.F02.1.454.CMB.1.raw
  modified_base (600)..(600): a, c, t, g, unknown or other
  misc_feature (600)..(600): n is a, c, g, or t
  modified_base (636)..(636): a, c, t, g, unknown or other
  misc_feature (636)..(636): n is a, c, g, or t
tcagagcgtcgtctcacgaccggtgctcgatttagctcgatatagttggggtttgaggtctcagagaggagccttagccctggactccaaggcctttccacttggtgatcagcacggagcacagaggacccacatggaactgggctgagcgtgggttttcctgtgcttagttttagaaggttctccgagtgtaggaggtgacaacgtggtaggacttcgtagggacggtaggtggtacggtcctacggtccgtagggaacgtaaccgtccccgtaggacgtacctccgttccgtaggtcggtaccacgtcccgtcgttacggtacctttaccgtaaccgttttagtaacggtttagttacgggacttggacggttccggtacgggtcccgaccctaggtaccgtacgggaacgggggtaacgggtcgttacggggtaacggttcgggtacgaaccgtaaaccgtaaacgtaaacccgaaaggtacgtagggaaacggttaaaacgtaaagtcgtaggtacgtcgtacgtacgggtaacgacgggtactagttaccgacgtatccgtacgaacgacgtaccacgactaaacggtataccgntaagtctaagacgtaactagtacaacgtcgtaaccngggaaccaccggtgggacgtaccggtacggtacctagttaaccgaccgtgggtaacgccggggtaacgtaacggtaacgtttcccggtacgtaccgttaacggttccccgttttagggtttaaccctttcggaacggttccccggg

SEQ ID NO: 46677 - DNA, 714 bp, Homo sapiens
  misc_feature: GYAE6OF02F63QZ.27.57.F02.1.454.CMB.1.raw
tcagagcgtcgtctcacgaccggtgctcgatttagctcgatatagttgggtttgaggtctcagagaggagccttagccctggactccaaggcctttcacttggtgatcagcacggagcacagaggacccaccatggaactgggctgagcgtggttttccttgttgctattttagaaggtgtccagtgtgaggtgcaacgtggtggattcgtggaggtaggtggtggtccagccgtaggagaactcccgtgacgtactccgtcctgtacgccacgccttcgtggtacttctaaccgtttaggttagttacgttagggactggactcggttcgggtcccacgacgtaccgtcggaaggggtaacgggtctgggttacgtcggtaggacctaacgaacgtaaaccgaaggagtacggggtaaagtaaaacgaaaacgttacgtaggtacggacttcgtaggtacgaacggggtcctacgttaccgaacgtacgtacccgtacgaacgacgtaacccgaacgtaaccgtaaaggactaaccgttacttagtaacgttcgtagaaccttaaagaccgtaacgcgtaccgtgtaaccggacgaccggaacggtaccacgggttactacggtactacgtacggtcgtaacggaacgtaccgtaagtcctttacggtacttacccgtttaggtttacccggttactttcggtacgttcccgg

SEQ ID NO: 46678 - DNA, 786 bp, Homo sapiens
  misc_feature: GYAE6OF02JJG8M.27.57.F02.1.454.CMB.1.raw
  modified_base (222)..(222): a, c, t, g, unknown or other
  misc_feature (222)..(222): n is a, c, g, or t
  modified_base (266)..(266): a, c, t, g, unknown or other
  misc_feature (266)..(266): n is a, c, g, or t
tcagagcgtcgtctcacgaccggtgctcgatttagctcgatatagttgggtttgaggtctcagagaggagccttagcccctggactccaaggcctttccacttggtgatcagcacggagcacagaggacccaccatggaactggggctgagcgttgggttttccttgttgcttatttagaaggtgtccagtgtgaggtgcaacgtggtgtattcgtggaggnggtgtgccagtcgtggacgactcctagacactctccgtgtcgcncgtcctgtgtaacttcgtaaccgtttagtaacgtttagtcggagtagtacggtcggtcgggtccctcgaacgtaccgtaccggtagggggaacgggtctacggggttacggttccggtacggaaccctaacgtaaacgtaaaccggaacggtagttaacggggaaaaggtaaaaaccgtaaaactagttacggtacggtaacctttaggtacggtaaacgggtaaccgggtaacctaacgttccccgaaaccgttaccttcccggaaaccgtaacgtaacgaaacccgtacggaaaccgtaaacgtaaccgtcgtaacttaacgttaacggttacctaacggaactaaaacgtacggaacgtaccgtacggtacggaaacggtaccggaacgggacgtaaccggtacggttccgttaagttacgttaccgtaacggttacggcggttaacggaactaacggtaccgttacgttccggtttaactacccgtttcccggtttattacggccgttaacccggg

SEQ ID NO: 46679 - DNA, 787 bp, Homo sapiens
  misc_feature: GYAE6OF02IA27Q.27.57.F02.1.454.CMB.1.raw
  modified_base (530)..(530): a, c, t, g, unknown or other
  misc_feature (530)..(530): n is a, c, g, or t
  modified_base (631)..(631): a, c, t, g, unknown or other
  misc_feature (631)..(631): n is a, c, g, or t
  modified_base (712)..(712): a, c, t, g, unknown or other
  misc_feature (712)..(712): n is a, c, g, or t
tcagagcgtcgtctcacgaccggtgctcgatttagctcgatatagttgggtttgaggtctcagagagggagccttagccctggactccaaggcctttccacttggtgatcagcacggagcacagaggacccacatggaactggggctgagcgttgggtttttccttgttgcttattttaggaaggttgtccagtgtggaggtgactaacgttggtaggtattcgaggggaggtaggttgttacgggtccaaggcccgttaggaagtaaaccttaccccgtgggtaacgtaccttcctccgtagtcggctaaccggtccttacgtcggtactttccgttaaccgttttagtaaggtttagtgggtaattggtagtcccgggttcggtaccccggtaccaggtaccgtaccggaagggggacgggcgttagggtacgtccggtcggaacaaccgtaaagaaaccgtaaagtagggttacggaaaaaggtaaaaacttaaaagtaacgttaggaccgttacgtacgttagggngggtaaccggccgtaaactttccgaacgttaccttaccgtaccgaaggaacgtaaacgaaacgaaccgtaaaacgacgttacgtacgttgtaattcgtaanaagaactaacgtacgacgtacgtacggagaccggaaccgtaacggaccgacggtacgttacgtaacgttaccgtagtacgngggtaacgtacggaagaccgttacgttaacgtttaccgaacggttttcccgttcggtttaccgttagttacccgg

SEQ ID NO: 46680 - DNA, 723 bp, Homo sapiens
  misc_feature: GYAE6OF02GMD2U.27.57.F02.1.454.CMB.1.raw
  modified_base (706)..(706): a, c, t, g, unknown or other
  misc_feature (706)..(706): n is a, c, g, or t
tcagagcgtcgtctcacgaccggtgctcgatttagctcgatatagttgggtttgaggtctcagagaggagccttagccctggactccgaaggcctttccacttggtgatcagcacggagcacagaggacccacatcggaacgtgggctgagcttgggttttcctgttgctattttagagtgtccagtgtgaggtgactaacgtggtggtattcgtgggaggtacggtggtcggtaccaggccgtagggtaacgtaactcccgtagaacgtaccttccgtccgtagtcgtacgacgtccctgtgtacttccgtactttagtagttagtggtatcggtacgtcgtcggggtcccacggtaacgtaccggtacggaggggggacgggtctacgggtaggtttccggtacggaaccccaaataaccgtaaaacgaaggtacgtaagggtaaacgtaaaagtaaacttagtcggtacgacgttacgtggtacgggacggtacctatccgaactacttccgacgaaggtaccaacgtaaaccgctaaaggtaccacggttactacgtacgttacaagtactaaactaacgcgaacgtacgtaccggagaaccggaccggaaccgacgtacgttgttaactaccttagtacccggtaggtacgaacgttaaggtccttaacgttacgtacgttccgtttaccgtttaccggtntttaccggattcccggg

SEQ ID NO: 46681 - DNA, 729 bp, Homo sapiens
  misc_feature: GYAE6OF02GRQW7.27.57.F02.1.454.CMB.1.raw
  modified_base (193)..(193): a, c, t, g, unknown or other
  misc_feature (193)..(193): n is a, c, g, or t
  modified_base (520)..(520): a, c, t, g, unknown or other
  misc_feature (520)..(520): n is a, c, g, or t
  modified_base (633)..(633): a, c, t, g, unknown or other
  misc_feature (633)..(633): n is a, c, g, or t
  modified_base (654)..(654): a, c, t, g, unknown or other
  misc_feature (654)..(654): n is a, c, g, or t
tcagagcgtcgtctcacgaccggtgctcgatttagctcgatatagttgggtttgaggtctcagagaggagccttagccctggactccaaggcctttccacttggtgatcagcacggagcacgagaggacccaccatggaacgtggggctgagcgttgggttttcctgttgcttatttagagtgtccagtgtgngtgacactggtcggattcgtgggaggtaggtgtcggtaccaggtcctaggagtaacctccccgtgaacgtaccttccgtccgttggttcgactcgtccctcgttacggtcttaccgttaacgtttagtttaactttaccggttaaggacttaggtacgtccggtacgggttcccgaccgaacggtacccgtccggggaagggggtaaccgggtcgtaggggttcgttacgggtccggaactaacgaactaaaccgagtacggtaagggaacgggttaaaacgaaagtttagcggggtaagcgtttacgaggtacgtacggggccttntaaccgctaacgtcctaccgaaaggacgtaccaaaccgtacgaaaacgtcgtaactccgttatacgttacgtcaaagtaatccgaaagtcggaccctaggtcacgggtaccgngaaccgtaccgagtacttacncgtttacggtcgaacggtctacggaatcggttttacgacgtacgttacctttcccggtatttaggacccttcggg

SEQ ID NO: 46682 - DNA, 667 bp, Homo sapiens
  misc_feature: GYAE6OF02GVTJI.27.57.F02.1.454.CMB.1.raw
  modified_base (409)..(409): a, c, t, g, unknown or other
  misc_feature (409)..(409): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtgtccagtgtgaggtgcaacgtggtggattctggagggaggtgtggtccagccgtggagaactcccgtgactactctctgtgcacgtcctctggtacttctacctttagtagttatggtatagagtcgtggtccgcacgtactccgaaggggaacgggcgtagggtaggttcgtcggaccaacaacgtaaaccgaagagtagggaaagtaaaagtaaaactagtaggngtaactgtaggtaggaacgggcctagttaccaacccgtactccgtacctaaggaacggaaaccaaccggaacccgaaacgtaacgtaccgtaacgttacgtaacgttactacgtaaacgtaaacgtacgaaaccaggttacccgtaggaagaaccggaccgaagggtaaccgacggtacgtaacgttactacgtacgttggtacggacggtagaacgtactacgtacgtctaccgtttccgtacgtttagcttaccgg

SEQ ID NO: 46683 - DNA, 760 bp, Homo sapiens
  misc_feature: GYAE6OF02FL50A.27.57.F02.1.454.CMB.1.raw
  modified_base (254)..(254): a, c, t, g, unknown or other
  misc_feature (254)..(254): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagaggtgtccagtgtgaggtgcaactggtggattctggaggaggtgtggtccagcctggagaatccctgagactctcctgncagcctctggattctacctttagtattagttggatggagcgtgggtccgccgagactccgaggggaaggggctagggagttcgtcggacaactagtaaaaccaagagtaggtaaggtaaaagaaaacgtagtaggtacgggtaactcgtaggtacggaaacggggtccgtaagttaccctaaccgatacccgtcccgaacgtaaacggaaacccgaaaacccggtaaccccaaaagggaaacttacccgtaaacgttacgggttaacttacctacggtaacgtaaaaacgttaggaaaccctaacgggtacccgtagggaacgaaccgggtaacccgggaaaggggaaccccgacggggttaccctagggtttaaccctttaaccggttaacgttacgggtacggtaacccgggtaaagggtacgtaaccgtttaccccgttaacgggtttaccgttaaccgttttcccccgggtttactttttttacggacctttttaccccggg

SEQ ID NO: 46684 - DNA, 638 bp, Homo sapiens
  misc_feature: GYAE6OF02F37LZ.27.57.F02.1.454.CMB.1.raw
  modified_base (204)..(204): a, c, t, g, unknown or other
  misc_feature (204)..(204): n is a, c, g, or t
  modified_base (278)..(278): a, c, t, g, unknown or other
  misc_feature (278)..(278): n is a, c, g, or t
  modified_base (368)..(368): a, c, t, g, unknown or other
  misc_feature (368)..(368): n is a, c, g, or t
  modified_base (449)..(449): a, c, t, g, unknown or other
  misc_feature (449)..(449): n is a, c, g, or t
  modified_base (573)..(573): a, c, t, g, unknown or other
  misc_feature (573)..(573): n is a, c, g, or t
  modified_base (589)..(589): a, c, t, g, unknown or other
  misc_feature (589)..(589): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacgacccacagtggaactggggctgagtcgttcgggttttccttgttgcttaattttaggaaggtgtccagtgtagaggtnacaacgtggcgattcgtggagggtaggtgtcggtaccagccgtaggaacaactccgtagactactctctggtcncagcctgtgtattcctacgttagtattgtgatggagtgtacgggtccacgaagctacggaggggaaggtcaggtactcggacgaccaaanactaaacgagagtagaaaagtaaacaatgtagtagcttagacggtacggaggacctaatccgaactcgtactagaacgaanaccgaaacgaccgtaatacgacgtacttaagtctaaggtaccaaatacgaagtaaccaggttcgaacggtacgtacgacggtaacgtaaccgtgtaaccgttagaactaacgtcggacggtaanaaccggaacgtaaacnccggtttacgactttcggttacttaccggttcttacgaccgtttccggg

SEQ ID NO: 46685 - DNA, 849 bp, Homo sapiens
  misc_feature: GYAE6OF02IYEB5.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggtttccttgttgctattttagaaggtgtccagtgtgaggtgcaactggtggattcgtggaggaggtgtggtccaggtccgtggagaactcccgtgagacctctcctgtcgaccacgcctcgtggtacttcctaaccgtttagtaggtttattgggatggagtcggttcgggtacccgtaccgtaggtaccgtacccggaagggggaacgggggtccttaggggtacggtttcggacgggacccctaaaacgtaaacgtaaaaacccgaaaggtacgtaaagggggtaaaacgggttaaaaaacgtaaaaaacgttacggttaaggttacgggtaaccgttaccgtagggtaacgggaaaccggggtaccgtaagtttacccgaaacccgtaatacccgtaaccgaaaggtaacgtaaaccgaaaccgtacgaaacgtaacgtacctaacgttcgtaacgttcgtacggaacaaaacgtcggaaaccgtaacggtacccgttaacgggaacgtaacccgggaaccgggtaaaccggggtaaccgtaaacccgggtcgttaaggttaaacccgttaccgttaaccggttacgggtaaccggaacggtaacgggtaaaccgttaagttacccgggttaacggtttacttaaacccgggttttcccctttaggtttttaaccggaccgtttaccccggg

SEQ ID NO: 46686 - DNA, 777 bp, Homo sapiens
  misc_feature: GYAE6OF02GH1N1.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctatttagaaggtgtccagtgtgaggtgacaacgtggtggtattctgggaggagggttggtggtccagcccgtagggagtaaacttcccctaggacgtaccgttcctcccgtgttacgaccacggtcccttcttcggtactttaccttaacccgttttaaggtttacgtttagttaggtagttaggtacggtccggttcggggtaccccgtaccgaacggtaccgtaccgggaagggggaacggggtcggtagggttacggttccggtacggacccaaaccgtaaactaaaaaccgaaggtaacgtaaggggtaaacggttaaaaggaaaaacttagtaggtacgtacgtacgtggttacgggacgggtacctactaccaacctactacctacgaacgtagaaacccgaaccgaaccaaaggtaaccgtactaaccgttgtaattccgtaacgtactaaacgtaagaaaccgtacgaccgttaagaacgtccggaaccgaacgtaacgaccggtagtacggttacttacggtcgtaacggttcgaacgtaaggtcgtacgttaccgtacttacgttaccgttacgtttacgttttaccgagtttcccgg

SEQ ID NO: 46687 - DNA, 815 bp, Homo sapiens
  misc_feature: GYAE6OF02HQI90.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaacgtggtggattctgggaggaggtgtggtccagcctggagactccctgagactctcctgtcgcacgtccctcgtggtacttcctaacctttagttacgtttagttggtatggagtcggtcgggggtcccgaccgacggaaccgttccgggaagggggaaggggtccgttaggggtacggtttacgggtccgggtaaccccaaaacgtaaaccgtaaaaccgaaaggtaaaggtacggggaaaagggttaaaaaacgtaaaaacggtttacgttagggtaacggtaaccgtttacggttacgggttacgggtaaacgggggtacccgttaactttacccgaaaccttaacctttacccgtaaccccggaaaggtaacggaaaacccgtaaaccggaaaccgtaaaacggtaaaccggttcccaaacggtttcggtaacttcgtaacgaaacttaaaagtacgaaaccgtcggtaaccgtagggaaacgtaccgggaaccgggaacgaaccggtacgggtacttacgtaactaccgttaggttcggaggaccgtaacggtaataccgtttacgttacgttaccttacgtttccccgttattttacggactttacccggg

SEQ ID NO: 46688 - DNA, 985 bp, Homo sapiens
  misc_feature: GYAE6OF02F1OOG.27.57.F02.1.454.CMB.1.raw
  modified_base (543)..(543): a, c, t, g, unknown or other
  misc_feature (543)..(543): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggtttcctgttgctatttagagtgtccagtgtgaggtgcaacgtgggtggtattcgtagggagggtaggttggtgggtacccaggcccgttagggaagtaaactccccgtaggaacgtaccttccttccgttggtcgacctacggtcccttacgtagggtaactttaccgtaacccgttttaaggttaaggttttaacgtttcgggtaacgttagggaaccgttcggttacggggggttaccccgacccgtaaacggtacccgtaccgggaaacgggggggtaaacgggggtccgttacgggtacgggttttccggtacgggtaaccccgaaaacgttaaacgttaaaaacccgaaaggtaacggttaaggggtaaaacggggttaaaaanaaaaaaccggtttagtaacgggttaacggtaacgttccggttaggggtaacgggtaaaccgggggtacccgttaacttacccggaaccttaactaccccgttaaccggaaggaaaccggtaaaccgaaaacccggtaacccgtaaaaaggtaaaccgttaccccgtaagtttaacgtaacgttacccgttaaggaaaccctaaaaggttacccggaaaaactacggtacccggttaagggaaacggtaaccgggacccggggtaaacgtaacccggaaccgggttacgttaaaccggtttaggttaaccctaaccgggtttagggttaaccgggaaccgggttaaagaaacccgggttacgttttaaccccgggttacgtttaacccgttaacggttttacccccggttttaacgttttttacggacggttttaaccccggg

SEQ ID NO: 46689 - DNA, 820 bp, Homo sapiens
  misc_feature: GYAE6OF02GYIKG.27.57.F02.1.454.CMB.1.raw
tcagagcgtcgtctcacgaccggtgctcgatttagctcgatatagttgggtttgaggtctcagagaggagccttagccctggactccaaggcctttcccacttggtgatcagcacggagcacagaggacccaccatggaactggggctgagcgtgggttttccttgttgctagtttggaggtgtccgagtgtgaggtgcaacgtggtggtattcgtgggaggaggtgtcggtaccagtcccgtaggaacgtaacgtccccgtagacgtacctaccttcgtgtgaccgtgtcccttcgtacggtacttaccgtaccgttttaagttacgtttagttacgggtagtacggtaacgtcggtttaccgggttaccccgaccgacgtacccggtaccggaaggggggtaacgggtcgttaggggtccgttcgggtacggacccgtaaaacgtaacgtaaaaccgtaacgtaaggtaagggtaaggttaaaaacgtaaaccgttaggtacggtaacggtacttacgtaggtaaccgggtaacggtaccgttaacttacccgaaccgttacctaccgtacgaaggtaccaaccgtaaaccgtacgaaacggttaaaccgtcgtaacgttaggtaccttaacgtacggtaaactaaaacgttacgaaccgttaggaaccccgtagggaaccggtaacccgacggggtaaccgaacgtaccggtaacgtttacgaaaccgttcgttacgtaggtccggacgtaacgtacgtaccgttaccgttaacgttcgtttaaccgttccggttttactttacggtacttcccggg

SEQ ID NO: 46690 - DNA, 673 bp, Homo sapiens
  misc_feature: GYAE6OF02I35JS.27.57.F02.1.454.CMB.1.raw
  modified_base (238)..(238): a, c, t, g, unknown or other
  misc_feature (238)..(238): n is a, c, g, or t
  modified_base (401)..(401): a, c, t, g, unknown or other
  misc_feature (401)..(401): n is a, c, g, or t
  modified_base (583)..(583): a, c, t, g, unknown or other
  misc_feature (583)..(583): n is a, c, g, or t
  modified_base (612)..(612): a, c, t, g, unknown or other
  misc_feature (612)..(612): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagcttgggttttcctgttgcttatttagaaggttgtccagtgtgaggtgcagtggtgattcgtggaggaggtgtcggtccagtccgtgganaactccctagagtactccgtcctgtcgacacgtcctcgtgactttcctactttagtagttattaggatgagtcgtcggttccgccagtactccggaaggggagggtctggtacgttcggtcgaaccgtaaacaacgtaaccaagtagtaggaaacggtaaaanaaacgtagtacgtagtactcgtaggtaggtaacggccttattaccgactaactccgtaaccaggaaccaactaacggaccaaagtaaccgtacctacgtacgtactacgtacgtaaacgtaactaacgtacaacggtacctaagggaacgaaccggccggtaaacgggaaccgaccgggttntaacgttaacctagttacctcgggtaacncgtaacgtaacgacgttccgtactttccgttaacctttcggtactttaggtacttcccggg

SEQ ID NO: 46691 - DNA, 804 bp, Homo sapiens
  misc_feature: GYAE6OF02IMQ8E.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctggttttctgttgctatttagagtgtccagtgtgaggtgcaactggtgattctggaggaggtgtggtccagccgtggagaactccctgagactctcctgtgcacgcctcgtggtacttcctaccgttttaaggtacgtttagttggtacgtgtacggtccgttcggggtccccgaccgacggtacccgttccggaaagggggtaacggggtcgttggggtaacggtttccggtaccgggaccctaaacgtaaacgtaaaacccgaaaggtaaggtacggggtaaaaggtaaaaacgtaaaaacgttagttacggtaacggtaacttcgtaggttacgggaaacggggtacccgttaacgttaccgaacccgtaacgttccccgtaaccgaacgtaacggaaaaccgaaccggaacccgtaaaaggtaaccggttacctaaaccggtttcggtaaacttaccggttacgtaaacgtaaacgttacggaaaccgacggttaccgttacgaacggtacggtaccggaacgtaaccggacggtaaccgttagttaacgttaccgttacgttcgggacgtacggtaacgtaaccggtacttaccgttaacggttccgtttaccggtttcccgtttaccgttttacgacgtttacccgg

SEQ ID NO: 46692 - DNA, 898 bp, Homo sapiens
  misc_feature: GYAE6OF02HGLE0.27.57.F02.1.454.CMB.1.raw
  modified_base (194)..(194): a, c, t, g, unknown or other
  misc_feature (194)..(194): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttccttgttgcttattttagaggtgtcagtgtgtaggtnctaactggtggtattcgtgggaggtaggtggtacggtcagcctagggagaactcccgagacgtacttctcctgtacgctacgtcctcgtggtactttactaccgtttagttaagtttgttacggtattacgggtaacgttcggtaccgggtccgaccggtacggtaccgtaccggaagggggtaacgggcggttagggtaaccggtttcggacgggtaccctaaagtaaaacctaaaccgtaacggtaagtaaacggggtaaagtaaaaacgtaaaacgtagttacggtaacggtacctaccggtaggtacggtaaccgggtaccgtacgtttaacccgaaccgttacgttacccgtacgtaaccgacggtaaccaaaccgggtaaccaaaacggtaactaccgtacttaaccggttacgtaccgtaccgtaaactaaaggtaacgaaacccgttaagggtacccgttaccgggaaaccgaccgggaacccgggtaaaccggtaacccgggttaaccgggtaacccgtttaaaggttaacccggtttaacccgtttacggttaacccggggttaacggttaaacccggggtaaacgggtaccgggtttaaccccgttaaccggtttaaccggtttacccgttttacccgggttttaaccccgtttaacccggttttttacgtacccgggttttaaccccggggg

SEQ ID NO: 46693 - DNA, 779 bp, Homo sapiens
  misc_feature: GYAE6OF02HHRGW.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctatttagagtgtccagtgtgaggtgcaacgtggtggacttcgtggaggaggttgtggtcccaggcctggacgaactcccgtgacgtaccgtctccgtgcgcacgcctccgtaggtacttaccgttaacctttaaggttagtttaagttggtagttacggtaggtccggttcgggtaccccgtccgaacggtaccgtaccgggtaagggggaaacggggtcggttacgggacggtttccggacggtaccccaaacgtaaacgtaaaaccgaaacgtaacggtaaggggtaaaacggtaaaaaacgtaaaaacgtttagtacggtaggtaaccttcgttaaggggttaaggaaccggggtcctaacgttaccaacgtacttccgaccgagaaaccgtaaccgaaacgaccgtaaagaccgtacgtaaccgttaggtactacgtacgtaaactaaataccggaaacgacggtccctagggtaacggaccggtaacccgaggtaacccgaggttacgtacggtagttaccgtacggtacgtaggacggagtaccggtaacttcggttacgtacccgttaaccgtttccggtttaacgttttccgacggtttccgg

SEQ ID NO: 46694 - DNA, 966 bp, Homo sapiens
  misc_feature: GYAE6OF02H6MYX.27.57.F02.1.454.CMB.1.raw
  modified_base (202)..(202): a, c, t, g, unknown or other
  misc_feature (202)..(202): n is a, c, g, or t
  modified_base (958)..(958): a, c, t, g, unknown or other
  misc_feature (958)..(958): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggaccacatggaactggggctgagcgttgggttttcctgttgtcttattttagaaggttgtccagttcgtgtaggtnacaacgttggtggtattcgtgggaggtagtgtcggtccagtccgtagggaacaacgtcccgtaggtaacgtaccttaccgttccgttacggtcggaccgtaacgtcccgttacgttacggggtaactttttacccgtaacccgttttttaagggttaacgtttttaaacggtttacgggtaacgtttaaccggtacggttaccggggtttacccgggggttaacccccggtacccggttaaaccgggtaaacccggttacccggggaaaacggggggggtaaaccgggggttaccgttaaggggggtttaaccgggttttaccgggtaaccggggtaaccccgtaaaaaccgtaaaaaccgttaaaacccgaaaaggttacggtaaaggggtaaaaacgggtaaaaacgtaaaaaacgttaggttaagggttaacgggtaacccgtttacgttaaggggttaacggggtaaaccggggtaaccgtttaaacgttacccgtaaaccgtaccgtttaaccgttacccggaaacggtaaacggtaaacccgtaaacggtaacccgtaaaacggtaaaccgttaccgtaaccttaaggttaactaccgtaagtaacctaaacgtaacgaaacgtacgtaccgtagaacggacgtaccggaacgaccgtacgtactacgttaacgtaccttacgtaggtacggacggttaagtaacgttaccgttacgtacgttacgttaccgttaccgttcgttttacgngttaacgg

SEQ ID NO: 46695 - DNA, 865 bp, Homo sapiens
  misc_feature: GYAE6OF02IW333.27.57.F02.1.454.CMB.1.raw
tcagagcgtcgtctcacgaccggtgctcgatttagctcgatatagttgggtttgaggtctcagagaggagccttagccctggctccaaggcctttccacttggtgatcagcacggagcacagaggaccccaacgatggaactggggtactgagcgtgggtttttccttgttgcttagttttagaaggtgtcagtgtggaggtgacaacgtggtggattcgtagggaggtagggtgtggtaccagccgtaggataactcccgtagacgtacctctccgtggtcgaccacggtccttacgtcggtaacttttacccgtaaccgtttttaaggttaaagttttacgttagggtaagttacggtcgggccggttaccgggggttacccccgaccggtaacggaaccccggttaccggggaaaggggggtaaacggggtcccggttaaggggttaccggtttcggaaccgggtacctaaaaacgtaccgtaaaaaccgtaaggtaggttaaacggggtaaaaacgggtaaaaaacctaaacggtttaaggtttcggttaacggtaaccttacggtttagggttaaacggtaaccgggggtaccctacttaacccgtaaccgtaacttacccggacgaaacgtaacgtaaaccgaaccggtaaaccgtaaaccggtaaaccggtacctaacgttagtaacgttacgtaacgtaacgtaacgtaacggaacgtaaacgtacgttacgaacggtaaccggaccggaaggaacccgacgttacggttacgtaacgttactacgtacggtacggaggtagtaacgttagtaccgtacggttacttacgttccgtttacgttttcgtacgttccgg

SEQ ID NO: 46696 - DNA, 753 bp, Homo sapiens
  misc_feature: GYAE6OF02H8JRD.27.57.F02.1.454.CMB.1.raw
  modified_base (278)..(278): a, c, t, g, unknown or other
  misc_feature (278)..(278): n is a, c, g, or t
  modified_base (739)..(739): a, c, t, g, unknown or other
  misc_feature (739)..(739): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggcccacatggaactggggctgagcttgggttttccttgttgcttagttttagaggtgtccagtgtgaggtgcaacgtggtagtagttcgtgggaggtaggtgtacgggtccagccgttggaagtaactcccgtgagtaccttcctcctggtcncacggtcctcgtaggtactttacttaccgtttaaggttcgttaggttagagttaggacgtccggttacgggttcccaccgaagtacccggtccgggaaggggggtaaccggggtcttagggtacggttcggtaccggaacaaacgtaactaaaacgagtaacgtagggaaaggtaaaacctaaagtcgtaggtaccggtacttaacgtggggtaacggaaacggggtcccttaattacccggaactacttccgaaccgaaggaacccgtaaccgaaccgaccgtaaagtaccgttactatacggttatcgtaagaacttaagacgaacctggaccgtagaacgtacggaccgtaagaccgtaggtacgtacgtttacgaccgttggtaacgtcggaaacggtggtaaccgttacgtttcgttaaccgtaccgtttaccgttttccctacggttttttaccncggtttacccgggg

SEQ ID NO: 46697 - DNA, 825 bp, Homo sapiens
  misc_feature: GYAE6OF02GU9OD.27.57.F02.1.454.CMB.1.raw
  modified_base (199)..(199): a, c, t, g, unknown or other
  misc_feature (199)..(199): n is a, c, g, or t
  modified_base (814)..(814): a, c, t, g, unknown or other
  misc_feature (814)..(814): n is a, c, g, or t
tcagagcgtcgtctcacgaccggtgctcgatttagctcgatatagttgggtttgaggtctcagagaggagccttagccctggacctccaaggcctttccacttggtgatcagcacggagcacagacggacccaaccatggaactggggctgagcttgggttttccttgttgcttatttagaagtgtccagtgtgaggtncaacgtggtggattcgtggaggtaggtgtggtccacgtccgtggacgtactcccgtagacgtaccttccttccgtgtacgccacgccttcgttaggtacttaccttaccgtttagttagtttagttcggagttggacggtacggttcggggtacccgcgtacgacccgtaccggaagggggtacgggtcgtacgggtacgttccggtacggtaaccccaaacgtaacgtaaaaccggtaaggtacggtaagggtaaaacggttaaaaacggtaaaaacgttacgttagggtaacggttaccgttacggtaggtaacgggtaacggggtcccgttaattacccgaacctaaccgttacccggtaaaccgtaacgggtaaaccgtaaacccggaaaccgtaaaccggaaaacggttaaccgaccgttaacggttacgttacgtaccgtaacgggtaaactaaacggtacgaaacccggccgttaaccgggagaaccggggtaaccgtaccggacgtacccggtacggttacgttaacggtaccttacgttaacgttggaacggtaacgtaacggtactacccgtttagaccgttacttcccggtttcttcgtttacncgtttacccgg

SEQ ID NO: 46698 - DNA, 769 bp, Homo sapiens
  misc_feature: GYAE6OF02I3UEU.27.57.F02.1.454.CMB.1.raw
  modified_base (179)..(179): a, c, t, g, unknown or other
  misc_feature (179)..(179): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagagtntccagtgtgaggtgcactggtggattctggaggaggtgtggtcagcctggagactcctgagctctcctgtgcagcctacgtggacttccgactttagtgtttatggactgagtcgtcgggtccaccgacggtaccgtccggaagggggaacggggtctagggtacgttcgggtacggacctaaactaacgtaaaacccgaagtacggtaacgggtaaaggtaaaaacgaaaaacgttacgttagggtaacggtaaccttacgtaagggtacgggtaaaaccgggggtcctaacgttccgtaaacccgtaacgttaccgttacccggaagtaacgggaaacccgtaaaccgaacccggtaaaagtaaccgaccgttaacggtgttaacctacgtacgtaacgtaaaacgtcggaaaacgtcggtaaccgtcgggaacggaacgggtacccggaaacgggtaaaccgtacgggaacttaggtaaccttaacccggtacggttacggtacggtaacgggaaccgtaaggtttaacccgtcgtaaccgttaccggttaaacgttcccgtttacgtttacggtaacccttccggg

SEQ ID NO: 46699 - DNA, 986 bp, Homo sapiens
  misc_feature: GYAE6OF02HIWUP.27.57.F02.1.454.CMB.1.raw
  modified_base (439)..(439): a, c, t, g, unknown or other
  misc_feature (439)..(439): n is a, c, g, or t
tcagagcgtcgtctcacgaccggtgctcgatttagctcgatatagttgggtttgaggtctcagagaggagccttagccctggactccaaggcctttccactttggtgatcagcacggagcacagacggacccaccatagggaactggggctgagtcgttgggttttccttggttgacttattttagaaggttcgtcagtggtagaggtgctacgtggtagtattcgtaggaggaggtgtcggtccagtccgtagggaacgtaacttcccgtagacgtaccgttctacccttggtacactacggaccttcggttaaggtactttccgttaacccttttaagggtaagtttacgttaaggggtattcgggagtaccggttccggggacccgaccgttacggaacccgttaccgggaaggggggtacgggcgtaacggggtntttaccgggtcggacccctaaaaccgttaactaaaacccgaacgtagggtaaacggggtaaaacggttaaaaacgaaaacttaacggttgggtaacggtttaacccgttaggttacggggtaacgggaaaccgggtacggtttaaccttaccgaaccttaaccgtaccgtaaccgtaaaacggggtaacctaaaccgggaaacccgtttaaacgaaaccgggtttaaaaccggttcccgttaaacgttacgtttaaaccgtttacccggtaacttaaaaacccgaaaggtttacccgaaaacggttaaaccccgggtaccggtttaaacgggaacccggttaaaccgggacccggggtaaaaaccggggtttaacccggaaaccccggggtttagtttaacccggggttttaaaacctacccggggttaaagggtttaccgggtaaaccgggtacccggttaacggtaaccggttaacccgttaccggtaacgtttaacccgttcccggttttaacggttttacgtttaccggtaccgttaaccggg

SEQ ID NO: 46700 - DNA, 698 bp, Homo sapiens
  misc_feature: GYAE6OF02GATTL.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaggtgtccagtgtgaggtgcaactggtggattcgtggaggaggtgtggtccagccgtggagaactcccgtgacgactctcctgtgcacgtcctgtggtattcctaccttttaggtacgttagttcggtatgagtcggtcgggtcccgacctagaccgtccggaaggggaagggtcgtgggtagtttccgggcggtaccaaacgactaaaacgaagtacgtaaggggaaacggtaaaagtaaaacttgtaggtacggaaccgttacgttacggtaagggaaacgggggtccctaacgttacccgaaccgtacgtttaccaaccccgtaaggtaaccgaaacccgaaacccgtaacgaaacggtaccgtacctacgttagtacttcgtacgaactaacacgaacgacgtacgtacgaaggacgacgaacggacgacgtcgttagtaacttacgtacgtggtacggacggtagtaccgtagttaccgtacgttacctaccgtttcgtacttttacgcgtttccgg

SEQ ID NO: 46701 - DNA, 686 bp, Homo sapiens
  misc_feature: GYAE6OF02JLE5W.27.57.F02.1.454.CMB.1.raw
  modified_base (679)..(679): a, c, t, g, unknown or other
  misc_feature (679)..(679): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactggggctgagctgggttttcttgttgctatttagagtgtcagtgtgaggtgctaacgtggtggattcgtggaggaggtgtggccagcctggagaacttcccgagacgtactcctccgtgtcgcgacgtccgtcgtggtactttccgtaacctttagtagtttagttggatggacgtcgtcgggtccaccgagaccgtaccggaaggggaacgggtcgtagggtacgtttcggtacggaccctaaacaacgtaaaccgaaggtacgtagggtaaaggtaaaacgtaaacgttagtacggtaggtacctcgtacggtaggaaaccgggtcgtaacgttaccaaccgtacgtacctaccgtaagaaccaaccggaacgtacaaaaggtacgtaccaagttacgttaacgtcgttacgaactaaacgtacgtaacgacgtactaggaacgccggaacggacgtaacgacgtgtacgtagtacgtacgtggtacgacgtacgacgtacgttacgtacgttacgttccgtacgtttacgtttacgnttaccgg

SEQ ID NO: 46702 - DNA, 791 bp, Homo sapiens
  misc_feature: GYAE6OF02FZFNW.27.57.F02.1.454.CMB.1.raw
  modified_base (187)..(187): a, c, t, g, unknown or other
  misc_feature (187)..(187): n is a, c, g, or t
  modified_base (633)..(633): a, c, t, g, unknown or other
  misc_feature (633)..(633): n is a, c, g, or t
  modified_base (712)..(712): a, c, t, g, unknown or other
  misc_feature (712)..(712): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtggggctgagtcgttgggttttccttgtgcttatttaggaaggtntcgagtgtagaggtacctaagtgggtagtattcgtagggaacggaggtgtcgtaccacggtccgtggaacgaacctccgtagacgaccttccgtaccttggcgaccgtacgcccttggtacgttaccgttaccttaccggtttagttaacggtttaattcgggtaacgtggtaacgtccgggttacggggtccccgtaccaacggtacccgtaacggggaaggggggtaacgggtctaggggttccggtttaccggaacgggaacccctaaaagtaaaccgttaaaaacccggaaggtaacggtaaggggtaaaacggtaaaaacgtaaacgttggtacggtaacgtacgttagtacgggtacgggaaacgggtaccctagttacccgacttaacgtcggtaaccaaggtaacccgaaaccaccggtaacgtaaaggtacccgttntaaaccggttgttaacccgttaggaccaaaaggtactacggaaaccgtaccgtgtacgggaagtccgggaaccggtaanacccggaggtcctaggttactcgagtggaactccgaatcccggtaatccgtataccgttactacgtcttagtcccgtgg

SEQ ID NO: 46703 - DNA, 836 bp, Homo sapiens
  misc_feature: GYAE6OF02JUP64.27.57.F02.1.454.CMB.1.raw
  modified_base (668)..(668): a, c, t, g, unknown or other
  misc_feature (668)..(668): n is a, c, g, or t
  modified_base (716)..(716): a, c, t, g, unknown or other
  misc_feature (716)..(716): n is a, c, g, or t
tcagagcgtcgtctcacgaccggtgctcgatttagctcgatatagttgggtttgaggtctcagagaggacgccttagcccctggactccaaggcctttccacttggtgatcagcacggagcacagacgacccacatggaactgggctgagcttagggttttccttgtcgcttattttagaggttgtacctaggttggtagtaaggtgacctaacgtgggtgtacttcgtagggaggtggtggtggtaccacgtccgtagggaacgaacgttccccgaggtcgtaaccgttccgtacccgttggacgtccgtaccgtccgtttcgtacggtacttttccctaacccggttttagttaggtttaacgttggggattacggggttacgaccggtttccggggaccgttaccccggtaagtacccggttaacccgggaagggggtaaacggggtccgttagggtacgtttcgggtaccaccgaaacgtaacgtaaaccgaagtcgtaaggaaacgtaaaagaaaccttggtagtaggaccttcgtaggtaggacgggtactaacttccaacccgtacgttaccctccgaaacgtaccgggtaaacaacggtaacctaaaggtaccgtacgtacttacggttacttaccgacgtaaactaacgattaaaccgngaccgtacggacgtacggaaccgtaaacgggtaccgaacccggttaanaccggtttaacgtacgttacccggtgtaacccggtaacggtaagtaccggtttaaactccgtttaaccggttactaccccggtttttaacggtttctttaaaccgggtccctttaacggg

SEQ ID NO: 46704 - DNA, 892 bp, Homo sapiens
  misc_feature: GYAE6OF02GQKWZ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctggagcgttgggttttccttgtgcttattttagaaggtgtccagtgtgaggtgcaacgtggtggtattcgtgggacggtagggttcgtgggtccaggtcccgttagggaacgtaacttcccgtccgacgtacctccgtccgtggtcgccacggtcctcgtggtacttaccgttaacccttttaggttaacgttttagttacgggtattacggtacggttccggtttcgggggttaccccgaccgtaaccggtacccgttacccggggaaagggggggtaaccgggtaccggttcgggtaacggtttttccgggtaccggaacctaaaaccgtaaaccgtaaaaccgaaaggtacgtaaggggaaaacggtaaaaacgtaaaactttgtaacgggtcgtaaccgtcgttaacgggtagggtaaccgggtaccacgttaaccctaacctcgttacccgtaccgaaaggtaaccgaaacccggaaaccgtaaccgtaaaaccggtaacgttaccctaacggttaacgttaaccgttacgtaaccggttaaaccgtaaaacggtaccgtaaaaaccgtacggtaccgtaacggggaccgttaacggggaacccggttaaacgggaaccggaccggtttacgtaaccggtttaactaaccggttccgtagggtcggaaccggtaagtaaccgttaaccttccgtaacgtttacctacccgttttacccgttcgttttacggacctttaccggg

SEQ ID NO: 46705 - DNA, 773 bp, Homo sapiens
  misc_feature: GYAE6OF02IC7D8.27.57.F02.1.454.CMB.1.raw
  modified_base (275)..(275): a, c, t, g, unknown or other
  misc_feature (275)..(275): n is a, c, g, or t
tcagagcgtcgtctcacgaccggtgctcgatttagctcgatatagttgggtttgaggtctcagagaggagccttagccctggactccaaggccctttccacttggtgatcagcacggagcacagaggacccacatggaactggggctgagcttgggttttccttgttgctattttagaaggtgtccagtgtgaggtgcaacgtggtgattcgtggaggaggtgtggtcccagccgtaggagaactccctgacgactcgtcctgtgcacgcctcgnggtacttcgtaccttttagtagtttagttggatgacgccggttcggggtacccccgcctaaggtacccgtaccggtaagggggggtaacgggtcgttacggggtacggtttcggacgggtaacccccaaagaaaacgttaaaaacccgaaaggtaaggttaacggggtaaagggttaaaaaacgtaaaaaccgtttagttaggtagggtaacccttgttaggggtaccgggaaaggggcccgttaacttaccgtaaccgtacctcccgtaaccgaaggaaaccgaacccggaaaccgaccaaaggaaccgttcaacgttagtaacgtcttagaacgaaagtcgaacctacgaccgtaggaacgcggaacccggaggaaccggcggtacttacgtaacgttactaccggtgtaccggtacgggtaagtacggttaaccctaccggtttagtacccgtttaacgtttcccggtttaacttttacggacctttacccgggg

SEQ ID NO: 46706 - DNA, 976 bp, Homo sapiens
  misc_feature: GYAE6OF02FUJ5K.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcgttgggttttccttgttgcttattttagaaggtgtccagtgtgaggtgcaacgtggtggtattcgtgggaggtagggtgtcgggtccagtccgttagggaagtaacttccccgtagacgtaccttccttcccgtggtcgtccgtacggccccgttcgttagggtaacttttacccttaaacccgtttttaaggttaaacggttttaacggttttagggtaagttacggtaacggttacccgggtttccgggggttaccccccggtacccgtaaccgggtaaccccggtttacccgggaaaacggggggggaacgggggggttacccggttagggggttaaccgggttttacccgggggtaccgggtaacccccgtaaaaaccgtaaaaaccgttaaaaaaccccgtaaaaggtaacggtaaagggggttaaaaacgggtaaaaaaagttaaaaaaccgttaacggttaggggttaccggtaaacgttaccgttagggttaacggggaaaccggggttaccgtaaccgtttaccaacccgttaacgttacccgtaaaccgtaacggaaccgtaaacccgaaacccgaaccgtaaaaccggtaaaccgtacgtaaccttacggttaacttacctaccgaaacgtaaagtaccgaaaccgtacgacccggttagaacggtaccggaccggtaacgggaaccgtaccggttaccgttaagttaaccgttacgttaccgtcgggttaacggaccggtaacggtaacgtaccgtttaccgttaacggtccttaccggtttacccgttaggtttttacacccggtttaccgg

SEQ ID NO: 46707 - DNA, 815 bp, Homo sapiens
  misc_feature: GYAE6OF02FMV60.27.57.F02.1.454.CMB.1.raw
  modified_base (116)..(116): a, c, t, g, unknown or other
  misc_feature (116)..(116): n is a, c, g, or t
  modified_base (221)..(221): a, c, t, g, unknown or other
  misc_feature (221)..(221): n is a, c, g, or t
tcagagcgtcgtctcacgaccggtgctcgatttagctcgatatagttgggtttgaggtctcagagaggagccttagccctgggactcccgaaggccctttccacttggtgatcagnacggagcacagacggaccccaccagtggaacctgggctgagcgtggtttctgtgctatttagaggtgtaccagtgtgaggtcgctaacgtgggtaggatttccgngggagggtaggttcgtggggttccccaggcccgttagggaactaactcccccgttggaagaccttccctcctgggttcgactacgcccgtcgtgggtaattccccgttaaccgtttaggtttaaggtttaccgttagggtagtacgaccggtcccgttacggggtcccaccgaacggttacacccggaaggggggtaaggggtcccgttagggaggttaccggtaccggaaccaaaaccgtaaccgttaaaaccgaaggtaacggtacgggaaaaggtaaaaccgtaaaacgtggtacggtacggtaaccttaggttacggtacggtaacccggggtacctacgtaacccgtaaccctacgttaccacccgaacgtaaccggaacccgtaaccgaacccgtaacaacggttacctaacgttacgtacgtaccgtagaacgtaacgtaaggaaccctacggacctacggaaccggtacggaaccggtacggacctacgggtctacggtacctacggtactacggtaacgccggaacgtacgttaccgtacccgttagtacccgttaccgttaccggtacctttagccgttaccgg

SEQ ID NO: 46708 - DNA, 704 bp, Homo sapiens
  misc_feature: GYAE6OF02G5RDH.27.57.F02.1.454.CMB.1.raw
  modified_base (555)..(555): a, c, t, g, unknown or other
  misc_feature (555)..(555): n is a, c, g, or t
  modified_base (684)..(684): a, c, t, g, unknown or other
  misc_feature (684)..(684): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgagtgcaactggtgattctggaggaggtgtggtccaggcctggagactcctgagactctctgtgcacgcctctaggtacttactacctttagtagttattggtataggagtcggttcgggtcccgccgaacgtaccgtaccggaaggggacggggcgtagggtacggttcgggtacgaccaaactaacgtaaaccgaaggtacgtagggtaaaggtaaaacgtaaaacgtagttacggtacgtacgttacgtaggtagggaacggtacctagttaccgacctactacctaccgaagtaccggaaccgtaaacggaaccctaaaggtaaccgttaccgtgttaacgtcttacgtacgaacgttaanaacggttaacacgtacggtacgacgggtacgaccgggaacgacggtaccgtagtacgttaactacgtacggtcggtcggagtaacggcttaaccgtaccgtaacttccgtttactttaccccgggtttntttaccggtagttacccggg

SEQ ID NO: 46709 - DNA, 651 bp, Homo sapiens
  misc_feature: GYAE6OF02GBRLO.27.57.F02.1.454.CMB.1.raw
  modified_base (218)..(218): a, c, t, g, unknown or other
  misc_feature (218)..(218): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgcttatttagaggtgtcagtgtgaggtgcaagtggtggattcgtgggaggnggtgtggtccagccgtggagaactccctgacgactctcctgtcgcacgtcctgtgtacttcctactttagtagttagtggtatggagtcggtcgggtacccgccgacgaccgtaccggaagggggaacgggtcgtagggtacggttcgtacggacctaaacaacgtaaaaccgagaagtagggaaaggtaaaagaaactgtacgtacggactgtaggtagggacggacctaatccaacctctcgaccgaagtacaaccgaaccgaaccaaaggtaccgaccttaactagtacttacgacgtaactaaatcgaaaccgtagaccgttagaacggaccgaccgggaacgaccgacggtctaagtattacgtacgagggtcggacgtacgtataccgttacctagtccgttaaccttcgttctttaggcttccggg

SEQ ID NO: 46710 - DNA, 905 bp, Homo sapiens
  misc_feature: GYAE6OF02FPE80.27.57.F02.1.454.CMB.1.raw
  modified_base (179)..(179): a, c, t, g, unknown or other
  misc_feature (179)..(179): n is a, c, g, or t
tcagagcgtcgtctcacgaccggtgctcgatttagctcgatatagttggggtttgaggtctcagagagggagccttagccctggactccaaggcctttccacttggtgatcagcacggagcacagaggaccccacatggaactggggctgagctgggtttcctgttgctatttagagtntccagtgtgaggtgacactgggtgattcgtggaggaggttgtcgggtaccagtcccgtagggaacgtaactcccgtaggacgtacttcctaccgtggtcgacgacgcccttcgtaggtacttaccttaaccgtttaggttacgtttaagttgggtactaggtacggtccgttaccggggttccccgaccgtacggtacccgttaccgggaagggggtaaacggggtccgtaggggttacggtttaccgggtacggtacccgtaaactaaaacgtaaaacccgtaaggtacggttaaaggggaaacggtaaaaaacggtaaaaccttaggttacggttacggtaaccttacggtagggttaaccgggaaaccggggtacccttaagttacccgtaacccgtaacttccccgtaaacccgaaaggaaacccggtaaaccgaaccggtaaaacccggtaaagtaaaccgtcctaacggtttactaacgttacgtacggaactaaacggtacctaaacgtacgtacccggttaaggacggaaccggtacccgggaaacgccgtaaaccgggttccgttaaaggttcgttaaaccccgttacgggttagtaacccgggggaacgtaaaggggttaaaccctaccgggttttaacccgttaaacgggtttccgtttaaaccccgggttttaacccgggttttccttttaccgggtaacccgtttacccgggg

SEQ ID NO: 46711 - DNA, 799 bp, Homo sapiens
  misc_feature: GYAE6OF02F96VW.27.57.F02.1.454.CMB.1.raw
  modified_base (177)..(177): a, c, t, g, unknown or other
  misc_feature (177)..(177): n is a, c, g, or t
  modified_base (210)..(210): a, c, t, g, unknown or other
  misc_feature (210)..(210): n is a, c, g, or t
  modified_base (758)..(758): a, c, t, g, unknown or other
  misc_feature (758)..(758): n is a, c, g, or t
tcagagcgtcgtctcacgaccggtgctcgatttagctcgatatagttgggtttgacggtctcagagaggagccttagccctggactccaaggcctttccacttggtgatcagcacggagcacagaggacccaccatggaactggggctgagctgggtttctgtgctatttagaggtntcagtgtgaggtgcactggtggattctggaggnggtgtggtccagccgtggacgaactcccgtgacgtacctcctcctgtcgcacgcctcgtaggtattcctaaccgttttgtaacgtttagttagggacttaggtacggtaccggttcgggggtccccgaccgaagggttaaccccgtcccggggaaaggggggggtaaacggggggttccgttacgggggttacggttttacccgggtacgggaaccccctaaaaacggtaaacgttaaaaaacccggaaggtaaacgttagggggaaaaaccggtttaaaaaacggtaaaaaaccttttaggttaacggggtacggttaaacgtaccgtttacggggttaacgggaaaccgggtaccgtaacgtttaccaaccgttaacgtcccgtaacgaacgtacgaaaccggaccgtaacgaaacgtaacgtcctaagttacgtacttctagaactaaagtcgaacctacggtacgtacggacgtaaccggacgacgaacggtccggtagttaccaagttacctacgtggtacgtaccggagtacgtacccgttntaacggttcttaccggttcgttccgtttaggtaccttcggg

SEQ ID NO: 46712 - DNA, 742 bp, Homo sapiens
  misc_feature: GYAE6OF02FMBW4.27.57.F02.1.454.CMB.1.raw
  modified_base (180)..(180): a, c, t, g, unknown or other
  misc_feature (180)..(180): n is a, c, g, or t
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (600)..(600): a, c, t, g, unknown or other
  misc_feature (600)..(600): n is a, c, g, or t
  modified_base (696)..(696): a, c, t, g, unknown or other
  misc_feature (696)..(696): n is a, c, g, or t
  modified_base (704)..(704): a, c, t, g, unknown or other
  misc_feature (704)..(704): n is a, c, g, or t
tcagagcgtcgtctcacgaccggtgctcgatttagctcgatatagttgggtttgaggtctcagagaggagccttagccctggactccaaggcctttccacttggtgatcacgcacggagccacagaggacccaccatggaactgggctgagctaggtttcctgttgcttatttagaagtntcagtcgtgagtncaactggtgattctggaggagtgnggtaccagcctagganaactccgtagagctaccgtcctagtcgccagtcctacgtggtaacttctacccgtttagtacgtttattgggatcgagtcgtacgggtccaccgaggtcctaccggaggggtaacgggtcgtaggtacgttccggttcggacctaaaccaacgtaaaaccgtaggaacgtacgggtaaaacgtaaaagtaaaaccgttgttacggtaacggtaaccgttaccgtaggttaacgggtaaacggggtccgtaaacgttcccgaacccggttaactaccccgtttaacccggaacggtaaaccggaacctaaaacccgggtacccgaaaacggaaccggttacccgaagttccggttaacttacggttanaaccggttaaaactcgaacgtacgtaccgtagtaaccggacgtaccgaacgtaaccgacggtaacgtagttaccgtacgtcggtacgtgtaaccgngagttacncgtacgttctacgttcgtaaccgtttagccgttaccgg

SEQ ID NO: 46713 - DNA, 844 bp, Homo sapiens
  misc_feature: GYAE6OF02GQSIU.27.57.F02.1.454.CMB.1.raw
tcagagcgtcgtctcacgaccggtgctcgatttagctcgatatagttgggtttgaggtctcagagaggagccttagccctggactccaaggcctttccacgttggtgactcagcacggagcacaggacgacccactagtacggacgtgggactggagtcgtttcgggttttccttgttgactttagttttaacggaaggttcgtaccgaggttggtacgggtaaggtcgtaaccgttaacggtggggttacgggtaacctttcggttagggggaaaggggtacgggtttcgggttaccggtacccgaacgggtccgttacggggaaactaaacccgtttccccgaaggtacgtacccgttccgtccgttaggccgtaaccgacgtcccgtagttacggacttttaacccgtacttttaagttagtttacggtagtaagtgggaccgttcgggtcggcccgtaacgacgtaccgtaggggaagggtacgggcttagggttcgtacggacaaccgtaaaactaacgtaaacggaaagttaggtaaaggtaaaacgtaaaacgtaagtggtacgacggttacgtcgtacgggtaaagaggttaccctaacttaccgtactaacgtaccaacgacgaacgaccgtaaacaaccggtaaagaaccgttaacgtacgttaacgtaacttacgtaaccgtaagaaaaccgtaacggaccgtacgttacgaacgtaacgaccggaccgggtaacgacggtaccgtaagtaactacttacgtacgttaggacgacgtaggtaaccgtacgttaccgacgttacgttaacgtcctttaagttaccgtactacgg

SEQ ID NO: 46714 - DNA, 693 bp, Homo sapiens
  misc_feature: GYAE6OF02IM5WG.27.57.F02.1.454.CMB.1.raw
  modified_base (211)..(211): a, c, t, g, unknown or other
  misc_feature (211)..(211): n is a, c, g, or t
  modified_base (236)..(236): a, c, t, g, unknown or other
  misc_feature (236)..(236): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttcctgttgctattttagaaggtgtccagtgtgaggtgcaacgtggtggattcngggaggaggtgtggtcagcctgganatccctgagactctcctgtgcagcctcgtggacttctactttagtagttatggatgagntgggtccncagacctccgagggagggctggacgttcgacgacctaacaactaaacgagtagtacgggaagtaaaacgaaactgtacggtaggtaactgtacggtaaggaacggggtcctaacttaccgaacccgtattacccgtaccgaaagtaaacccggtaaccaaaaccgggacctaaaagggtaacgttacctaacggttacgtaactttacgacgtaaaccgtaaaacggtacgaaaaccgtacggtacccttagggaaagggtacccggaaccgggtaagggaaccctacgggctttaacgggttaactaccggtacttagggcggacggacggtaacgtaccgttaccgtagttcccgttacgtttcccgttagttttaccgatttccggg

SEQ ID NO: 46715 - DNA, 780 bp, Homo sapiens
  misc_feature: GYAE6OF02GNIGG.27.57.F02.1.454.CMB.1.raw
  modified_base (502)..(502): a, c, t, g, unknown or other
  misc_feature (502)..(502): n is a, c, g, or t
tcagagcgtcgtctcacgaccggtgctcgatttagctcgatatagttgggtttgtaggtctcagagaggagccttagccctggactccaaggcctttccacttggtgatcagcacggagcacagaggacccaccatggaactgggctgagcttgggttttcttgtgtctatttagaagtgtcagtgtgaggtgcactggtggattcgtggaggaggtgttggtccaggcctggagaactccctaggaacgtctccgtccgttgtcggacacgtcctcgtaggtacttactaccgtttaagttgtttagttaggagttgagtcgtacggggtcccgacctacgtactcggtaacggggaaggggttcgacgggttacggttcgggtcgtaaccgaaataaacgtaaaaccgaacgtaggtaacggtaaagtaaaacggttaaaaagtcgtaggtaggtaccgcgtttaggacgggttaacgggtccgtaattccgaccgtacncgttaccagtaaacggaaccaaaccggaacgaaacgtaacggactaacgttagtacgttacgtcgaacttaaacgaacgtaaacctacggtaccgtacggtaaccgaaccggtaaccgggtaacgggaacccgtaaacgggttacccgtagtttaaccgtaccgttaacgttacgggttaacggacggtaaaccgggaagttaacccggttaacccttacggttacccgttaacgtttacccggtttttaccgttttaaccggttctttaacccgggg

SEQ ID NO: 46716 - DNA, 720 bp, Homo sapiens
  misc_feature: GYAE6OF02G1EWQ.27.57.F02.1.454.CMB.1.raw
  modified_base (677)..(677): a, c, t, g, unknown or other
  misc_feature (677)..(677): n is a, c, g, or t
  modified_base (708)..(708): a, c, t, g, unknown or other
  misc_feature (708)..(708): n is a, c, g, or t
tcagagcgtcgtctcacgaccggtgctcgatttagctcgatatagttgggtttgggggaggtctcagagaggagccttagccctggactccaaggccctttccacttggtgatcagcacggagcacagaggacccacatggaactggggctgagcttgggttttccttgttgctattttagaggtgtccagtgtgaggtgcaacgtggtggattctgggagggaggttgtcgggtccaggtcccgtagggagaaacttccccgtaggacgtacctcctccgttggtcgccgacgtccctcgtaggtactttcctaaccgttttagttagtttagttggatggaggtcggttcggggtccgtaccgacggaccgtaccgggaagggggaacggggtcgtagggtacggttcggtcggaccaacaacgtaaaccgaagtaagtaagggaaaggtaaaacgtaaaagtagtaggtacggtacttcggtaggtacgggaacgggtccgtaacttaccgaaccgtactacccgtacgaacggaaccggaaaccaaccggtaaccgaaaaggtaaccgtacctaacgttacgttacttacgtacgtaaactaaacgtcgaaacgtacgtaccgtaggacgacggaccggaagaccgacggtactagtactactagtcgtacgngaagtactacgtctacgtactcgttccgttntttacgagttcg

SEQ ID NO: 46717 - DNA, 886 bp, Homo sapiens
  misc_feature: GYAE6OF02FOYV7.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggacccacagtggaactggggctgagcgttgggttttcctgttgcttattttagaggtgtccagtggtgaggtgacaacgtggtggtattcgtagggaggaggttggtcgggttccaggtccgttgggaaacgtaacttccccgtaggaacggtaccttccttccgtaggtggtacctacggtcccgttacggtacggttacctttaccgtttaaaccgttttaggttaaggttttagttagggtacgttagggacggttcggttaccgggtacccgaccgtacggtaccgtaccggggaagggggtacgggtcgttagggttacggttccggtacggtaaccgtaaaccgtaaacgtaaaaccgaggtaacggttaaggggtaaaagttaaaaacggtaaacgttaggtacggtaacgttcgttacgtaacgggtacgggaaccggttaccgtacttaccgtaacctacgttaccgtaaccggaacgtaaaccgaaccgtaaaccggtaaccgaaaggtaccgtacgttaacgttaagtaccgttacgtaacggtaactaacggtaacgtaaccgtacgggtacgtaacgggtacggaccgggtaaccgggtaaccgggaaccgtaggttaaccgtttaacgttaacccgtacggtttacgacgggtaacggtacggtaaccggttacgttacccgttaaccgttacggttacccgttttaccggtttaccgttttacggtttaccgaccgtttacccggg

SEQ ID NO: 46718 - DNA, 795 bp, Homo sapiens
  misc_feature: GYAE6OF02HIC2U.27.57.F02.1.454.CMB.1.raw
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
tcagagcgtcgtctcacgaccggtgctcgatttagctcgatataggttgggtttgaggtctcagagaggagccttagccctggactccaaggcctttccacttggtgatcagcacggagcacagaggacccaccatggaactgggctgagctgggttccttgttgtctatttagtaggtgtcgatgtgaggngnactagtggatntggaggaggtggtggtcgacgcgtcggagaacgtacctcgagactccttccgtcgtcgacgcctcgtcgtagttcgtactttacgtttacgtttaggttagttagttggtacgtaggtcggggtccggtccggtaccggaccgtaccggtaacggggaacggggtaacggggtagggtacgttaggtacggttaccgaacgaaactaaaacgaaacggtaaacgtagggtaaacggtaaaacgggtaaaaacgtaaaacgtaaggttaggtacgtacgtacggtaggtacggggtaaccggtaacgttaccgtaacctacgtaacccttacgaacgtaccgaaacggaaccaaaccgtaaacgggaaaccgtaacgtaaccttacgtaacgttacgtacgtaaacgtaaacgtaaaccggtaaacgacgtaaccgaacggtcgaaaaccgggaccgggtaacgaaccgggaaggtacccttaagggttacctttacggtaacgttacggtcgggaacgaacgggttaactaacggttacctttacgtaaccgttgtttcccggttaacccgttttgttacgtcccgtcgg

SEQ ID NO: 46719 - DNA, 694 bp, Homo sapiens
  misc_feature: GYAE6OF02GRR76.27.57.F02.1.454.CMB.1.raw
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
  modified_base (526)..(526): a, c, t, g, unknown or other
  misc_feature (526)..(526): n is a, c, g, or t
tcagagcgtcgtctcacgaccggtgctcgatttagctcgatatagttgggtttgaggtctcagagaggagccttagccctggactccaaggcctttcacttggtgatcagcacggagcacagacggacccaacataggaacgtggggctgtagcgttgggtttttccttgttgcttaatttttagaggttgtccgagttgtagaggtgactaagttggtgtattcgtaggaggaggtgtggtaccacggccgtaggganacctaccgtgaagtcctcctccgtgtcgctacggcctacgnggtaccttctaccgtttagttacgtttagttacggtattacgtacggtcggttccggggtaccaccgtaacgtccgtaccggaaggggtacggtctaggtacggtcggtacgaactacgaacgtaaccagagtaggaaagttaaaacactagttggtacggtactacggtgtaagggtaaccggcctaagtccacctacgtcgtacgtaggaacaccgaacgtaanacgtaactactacgtataccgtactagtaactaagtaacgaacgtacgacgtacggaacgaccggacggtaaccgacggtaccgttcgttaacgtacttacgtcgtaggagttacgaacggtattaccgtaccgtagtccttaaccgtttcgtatttcgggattccgg

SEQ ID NO: 46720 - DNA, 793 bp, Homo sapiens
  misc_feature: GYAE6OF02JLKOO.27.57.F02.1.454.CMB.1.raw
  modified_base (245)..(245): a, c, t, g, unknown or other
  misc_feature (245)..(245): n is a, c, g, or t
tcagagcgtcgtctcacgaccggtgctcgatttagctcgatatagttgggtttgaggtctcagagaggagccttagccctggactcccaaaggcctttccacttggtgatcagccacggagcacagaggaccccaccatggaaccgtggggctgagcttgggttttcctgttgcttattttagaaggtgtccagtgtgaggtgacaacgtgggtgtatttcgtgggaggtagggtgtcggtaccnggtcctaggacgtaactcccgtgacgtacttccgtcctggtacgcacgtcctgtacgtactttacctaccgtttaagttagtttagttacggtattacggacgttcggtcggtcccgaccgtacgaccgttacggaacggggaacgggtcgtacggtacggttaccgggtcggaaccgtaaacctaacgttaaaaccggaagttacggtaaaggggtaaacgtaaaacggtaaaaacgtttggtacggtacggtaaccttggttacggtacggtaacggccttaacgttccaacgtcgtacgtcgaaagtacgtaaaccgacgtaaaccgacgtaacttactacgttaacgtacgttacctacgtaactaaagtaccgaactcggtaacccgaggtaaacgtaccggaccggtaaccggaccggtacgtaaccgttaacgtacgttaccgtaggttacggtaccgggtagtaaacgtaccgtaaccgttaaccggtaccttaacggttcccgtttacccgtttacggtttccgtaacccggttacggg

SEQ ID NO: 46721 - DNA, 739 bp, Homo sapiens
  misc_feature: GYAE6OF02F4NU9.27.57.F02.1.454.CMB.1.raw
  modified_base (183)..(183): a, c, t, g, unknown or other
  misc_feature (183)..(183): n is a, c, g, or t
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
  modified_base (615)..(615): a, c, t, g, unknown or other
  misc_feature (615)..(615): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagcttgggttttccttgttgctattttagaaggtntccagtgtgaggtgcaactggtgattcgnggaggaggtgtggtccagcctggagaactcctgagactctcctgtncagcctcgtggtacttacctacctttaggtagtttattaggattaggacgttcggtaccggggtcccaccgtaacggtacccgttccggaagggggaaacgggggtccttaggggtacggttttcggaccgggaccctaaaacgtaacctaaaaacccgaaaggtagtaacggggtaaaagggtaaaaactaaaaaccgtagttacggtaggtaaacccttggttacggtaacgggtaacgggacccgtaagtttacccaacctaattccccgtaacgaagtaccgaaacaaccggtaaccaaaggaactccaacgttgtacttacctagaacctaaagtacgaaactcggtaaccnggtaacggcgaaccggaggtaaccgacggttctaagttacgttactacgttggccggtacgaagggtccttaccgttaccgtagtaccttacggtttacccgtacgtttttagaccgttaccgg

SEQ ID NO: 46722 - DNA, 948 bp, Homo sapiens
  misc_feature: GYAE6OF02JCZCJ.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagaggaccccacatggaactggggctgagcgttgggttttccttgttgctattttagagtgtccagtgtgaggtgcaacgtggtggattcgtggaggaggtgtggtccagccgtggagactccctgagtactctcgtgtcgcgacgtcctcgtacggtatttccgtaaccgttttagtaacggtttattagggtagttacgacggtccgttcggggtccccgtaccgtaacggtaccgtaccggagggggtaacggggtccgttaggggtacggtttccgggttaccgggaaccccgtaaaaccgtaaacggtaaaaccgtaacgtaacgggttaacggggtaaaagggttaaaaaacgtaaaaaccgttaaggttacgggtcggtaaacgtttaccgggttagggttaaccgggaaacggggttacccgttaacgttttcccggaaaccccgttaacgtttaccccgtaccctaaaggggaacccgtaaacccggtaaacccgggtaaaccgtaaaaaacggggtaaacgttaccccgttaaccgttaacgggttttaacctaccgggtttaaccaaacgttaaaccggtaaacccggtaaacgtaaccgggttaccccgggttaagtaccggggaacccgggttaacccggggaacgggttacccgggtaacggtttacccgggtaacgggttaaacgtttaacccgttaccgggtaggtttaacgggacggaaaccgggttaacgttaaccgttacccgggtttacttaacccggtttacgttttacccccggtttactttttacccgggaagtttccccgggg

SEQ ID NO: 46723 - DNA, 643 bp, Homo sapiens
  misc_feature: GYAE6OF02G1QKR.27.57.F02.1.454.CMB.1.raw
  modified_base (300)..(300): a, c, t, g, unknown or other
  misc_feature (300)..(300): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
tcagagcgtcgtctcacgaccggtgctcgatttagctcgatatagttgggtttgtaggtctcagagaggagccttagccctgactccaaggcctttccacttggtgatcagcacggagcacagaggacccaccatggaactggggctgagctgggttttccgttgttgcttattttagaaggtgtccagtgtgaggtgcctaagtggtggattctgggaggaggtgtcggttcaggctggagaatccctgagctctcctgtgcagcctctggattctacctttagtagttattgatgagntcgggtccgcagtacctccgagggaagggctaggagttcgtaggaccaacgaataaccaagtanaggtaaaggaaanaaaaacgtatgtacggaactgtcgttaaggaaggaccgttaacgttaccaacgtataccgtaccgaaacgtaacgaaccgaaacgaacccgtaaagaaacgttacgacttaagttacgttcctagaaacgttaaanaaccganaacgtcgagagtacgacgaacgaacgacgtacttaagtaacttacgtacgtagtacggtaaccgaagtaccgtaacttccgtaacgttccgttaaccgttccggtttacgttactacgttcgg

SEQ ID NO: 46724 - DNA, 782 bp, Homo sapiens
  misc_feature: GYAE6OF02FV5PU.27.57.F02.1.454.CMB.1.raw
  modified_base (231)..(231): a, c, t, g, unknown or other
  misc_feature (231)..(231): n is a, c, g, or t
  modified_base (283)..(283): a, c, t, g, unknown or other
  misc_feature (283)..(283): n is a, c, g, or t
tcagagcgtcgtctcacgaccggtgctcgatttagctcgatatagttggggtttgaggtctcagagaggagccttagccctggactccaaggcctttccacttggtgatcagcacggtagcacagaggacccaccagtggaacgtggggctagagcgttgggttttccttgttgcttatttagaaggtgtccgaggtgtggaggttgctaagtggtggattcgtggagggnggtgtcggtccaggccgtaggagaactcccgtggaacgtactccgtctgtcnctacgtcctaggttggaactttcctaaccttttaggttaagttacgtttagggacttggacggttaccggtcgggtcccgtccggaacgtaacccgtacgggaacggggggtaacggggttccgtaaggggttcggtttaccggacggggtaaccctaaaacggtaacgttaaaaccgaaaggacgttaaggggtaaaaggtaaaaacgtaaacgtgtacggttacggaccttgtacggtaagggacccgggtaccgttaagtaccctaaccgtactccgacctaaacgacggtaaacaccggtaacccgaaaggtacgtaccgtaagtttcgaacgttcgttaacgtaataacggtaacgaaccgtacggtacgttacggacgggtaacggaccgaacggaacggtaacggtctacgttacgtagtcgtaggcggtaacggtcgtacgacgttacgttcgttacgtccgtttaccgttacgttttccgacggttcggg

SEQ ID NO: 46725 - DNA, 999 bp, Homo sapiens
  misc_feature: GYAE6OF02G1CVQ.27.57.F02.1.454.CMB.1.raw
  modified_base (970)..(970): a, c, t, g, unknown or other
  misc_feature (970)..(970): n is a, c, g, or t
tcagagcgtcgtctcacgaccggtgctcgatttagctcgatatagttgggtttgaggtctcagagaggagccttagccctggactccaaggccctttccacttggtgatcagcgacggagcacagacggacccaccatggaactggggctgagcgttgggttttccttggttcgcttattttagaggtgtccgagtgtgaggtgacacgtgggtggacttcgtgggagggtacggttggtcggttacccaggtcccgtgggaacgtaacctccccgtaggtacgtaccttccttccgttagttcggacctacggtcccttaccgtggtaacttccgtaaccgttttaggttaacgtttaggtttagggtacgttaggtacggtccgggttcggggtaccccggtaccggaacggtacccgtaacccgggtaagggggggtaacggggtaccggttaggggttaacggtttccgggtaccggtacccgtaaaccgtaaacgttaaaacccgaaacggtaggttaaaccggggtaaaagggttaaaaaccggtaaaaacgtttacggttacggggttaacggtaacccgttacgggtagggttaaccggggtaaccggggttaacccgttaacgtttaccccggaaacctaccggtttaacccgtaacccgggtaaagaacccgtaaaccccggaaacccgtaacccgaaaaggttaaacccgtactaaaccggttacgtttaacttaccgtaagtaaacccgtaaacgtccgggaaaacgttacccggaccggttagggtaaaccgggacccggggttaaccccggaaaccggtaccgggtaaacccggttcgtttaacgggtaacccttacgggtttacccgttacgggggttaaccggaaccggttaacggacgggttactttaaccccgggtatttacccgggttacccgttttacccgggttttttnttaacccgggggtctttaccccccggggg

SEQ ID NO: 46726 - DNA, 735 bp, Homo sapiens
  misc_feature: GYAE6OF02I8ULH.27.57.F02.1.454.CMB.1.raw
  modified_base (183)..(183): a, c, t, g, unknown or other
  misc_feature (183)..(183): n is a, c, g, or t
  modified_base (435)..(435): a, c, t, g, unknown or other
  misc_feature (435)..(435): n is a, c, g, or t
  modified_base (665)..(665): a, c, t, g, unknown or other
  misc_feature (665)..(665): n is a, c, g, or t
  modified_base (697)..(697): a, c, t, g, unknown or other
  misc_feature (697)..(697): n is a, c, g, or t
tcagagcgtcgtctcacgaccggtgctcgatttagctcgatatagttgggtttgaggtctcagagaggagccttagcccctggactccaaggcctttccacttggtgatcagcacggagcacagaggacccaccatggaactggggctgagctgggttttccttgttgctattttagaaggtntccagtgtgaggtgcaactggtggatttctggaggaggtgtggtcccagtccctaggagtaactcccgtagagactctccgtggtacgcacgtccctcgtagggtactttaccgtaccttttacggttaaagttttagttaggggtattacggaaggttcccggttacgggggtcccccggaacccgttaaggacccgttaacccgggtaagggggggaacggggtccgttacggggaacggtttttccggnggggtaacccctaaacgaaacgttaaaaaccgaacggtaggtacggggtaaaagtaaaaggtaaaacgtgtacgggtagtaccgtccgttaggtaacgggaacgggtacctagtttacccgaaccgtacttacccgaccgaacgactaacccgacgtaaccaacgaacgtcgacgttacgtactctagaaacctaatacggaagtcgacgtgaacgacggcgaacggacncggtacgtgtaactctacgcgtacgacggtanagtactcttaacggctacttcgtactttgtaccttcgg

SEQ ID NO: 46727 - DNA, 742 bp, Homo sapiens
  misc_feature: GYAE6OF02HB5K1.27.57.F02.1.454.CMB.1.raw
  modified_base (219)..(219): a, c, t, g, unknown or other
  misc_feature (219)..(219): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaacgtggggctgagctgggttttcctgttgctattttagaaggtgtccagtgtgaggtgcaactggtggattcgtgggaggnggtgtggtccagcctgggagaactcccgtgagacctcctcctgtgacacggcctcgtggtacttcctacctttagtagtttagttcggatggacgtcggtcgggtcccgccgagaccctaccggaggggaacggggtcgtagggtacgtttcggtcggtaccaaacgtaacgtaaaacccgaaaggtaggttaggggtaaaggtaaaaacgaaaaacgtttacgtaggtacgggtaacttcgtaggtaacgggtaacggggaccgtacgttaccgaacctacgttcccgtaaccgtaacggaaccggtaaaccgaaacccgaaccgtaaaacggtaaaccgtaccgtaaccggttacgttaacttacccgtaagtaacctaaaacgttacggaaaccgtaacggacccttagggaacggtaccgacgggaacggaccgacggaccgttagtaactacgtcgtggtcgacggaagtacgtactacgttagtacctacgtttaccgtcgttttagaccttccggg

SEQ ID NO: 46728 - DNA, 733 bp, Homo sapiens
  misc_feature: GYAE6OF02JYB7Q.27.57.F02.1.454.CMB.1.raw
  modified_base (120)..(120): a, c, t, g, unknown or other
  misc_feature (120)..(120): n is a, c, g, or t
  modified_base (193)..(193): a, c, t, g, unknown or other
  misc_feature (193)..(193): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
tcagagcgtcgtctcacgaccggtgctcgatttagctcgatatagttgggtttgaggtctcagagaggagccttagccctggactccaaaggcctttccacttggtgatcagcgacggancacaggacggacccacatggaactgggctgagctgggttttctgttgctatttagaggtctcagtgtgaggtncgaacgtggtaggattcgnggaggnggtgtcggtcagccgtggatactcctgacgaccttcacgtgtagcacgccttagtaggtactttcctaaccgtttagttagttagttagggataggtaccgtcggttaccggggcccgtacgacggtaacccgtcgggaaacgggggtaacggggcgttaggggtaccgttcgggacggtaaccctaaacgtaaacggtaaaaccgaagtacgggtaaggaaaaggttaaaacgaaacgttaggtacggtacgtaaccgtggttacgaacgggtaccgggtactaacgtaccgtaacgtacgtacccgtacgtaaacgacggaaaccacggtaaacgaacggtaacgtacgtaacgttacgtactacgtagaccgtaaatacgaacgacgtacgagtacggaacgtaccgggtaagacccgaggtaccgttaacgtacgttaacgtcgtaaacgccgtaaggtactacgttacgaccttaggttacctacggttaccgtacttcggtactacggg

SEQ ID NO: 46729 - DNA, 826 bp, Homo sapiens
  misc_feature: GYAE6OF02GHDS4.27.57.F02.1.454.CMB.1.raw
  modified_base (184)..(184): a, c, t, g, unknown or other
  misc_feature (184)..(184): n is a, c, g, or t
tcagagcgtcgtctcacgaccggtgctcgatttagctcgatatagttgggtttgaggtctcagagaggagccttagccctggacctccaaggcctttccacttggtgatcagcacggagcacagaggacccaccatggaactggggctgagcttgggttttccttgttgctattttggaaggtntccagtgtgaggtgcaacgtggtggattcgtggaggaggtgtggtccagcctggagaactcccgtagacgacctctcctgtgcacgcctgtggtattcctaccgtttagttagtttagttggataggtagtcgttcggggtcccgaccgaacgtaccgtaccgggaacgggggtaacggggtccgttaggggtacggtttcggtaccggaaccctaaaaccgtaacgttaaaaacccgaaagtacggtaaggggtaaaacggtaaaaaggtaaaaacctttagggtacggtaacgggtaccttacgtaagggtaacgggtaaacggggtcccgtaaacgttaccctaaccctacttaccccgtacgtaaacgtaaccggtaaacccgaaaccggaacccgtaaaaagggtaaccgtacccttaacggttacgttaacgtcgttaacgaaacgttaaaacgtaacgaaaccgtaacgtacccgtaaggaacgggtaaccgaacccgggtagggaaccctaacgggttgttaaacgtaacctttaccgtaacggttacggtcggtaaacggtaagtaaccgttaactacccggtttaacgttaccgttaccgttttccgtttacgttttacggtacttccgggg

SEQ ID NO: 46730 - DNA, 813 bp, Homo sapiens
  misc_feature: GYAE6OF02IAWH5.27.57.F02.1.454.CMB.1.raw
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (639)..(639): a, c, t, g, unknown or other
  misc_feature (639)..(639): n is a, c, g, or t
tcagagcgtcgtctcacgaccggtgctcgatttagctcgatatagttgggtttgaggtctcagagaggagccttagccctggactccaaggccctttccacttggtgatcagcacggagcacagaggacccacatggaactggggctgagctggttttccttgttgctattttagagtntccagtgtgaggtncaacgtggtggattcgtgggaggtaggtggtcggtccgagccgtggacgaactcccgtagacgtaccttctcctggtgcacgccttcgtacggtacttaccgttaaccgttttaggttaacgtttagttaggtagtacggtagtcccgttcggggtaccccgccgtaacggacccgttaccgggaacggggggtaacggggtcgttaggggttaacgtttccgggtaggaccccaaaacgtaaacaaaacccgaaggtaacggtaagggaaaggttaaaaacgaaacttaagttaggacggtaccttagtagggtacggaaacgggtcccgttaacttaccaaccgtacttccccggtaacaagggaaaccgtaacccgaaaccggtacccgaaaaaggtaacgttccgtaacgttaggttaaccttcgtaacgaaaccgttaaanacggaaaccgcgtaaccgtggaacgaccggaaccgggaacgtcgtaaccggtaccttaggttaacccttagttaacccgggttgaaacgggtaccggtaagtaaccgttaccgtttaaccgttcgtttaaccgtaccgttttacccggtttgtttttaccgacgtttacccggg

SEQ ID NO: 46731 - DNA, 893 bp, Homo sapiens
  misc_feature: GYAE6OF02IG1QW.27.57.F02.1.454.CMB.1.raw
  modified_base (186)..(186): a, c, t, g, unknown or other
  misc_feature (186)..(186): n is a, c, g, or t
tcagagcgtcgtctcacgaccggtgctcgatttagctcgatatagttgggtttgaggtctcagagacggagccttagccctggactccaaggcctttccacttggtgatcagcacggagcacagaggacccaccatggaactggggctgagctggttttctgttgctatttagagtgtcagtgtgngtgcacgtgtgattcgtggaggaggtgtggtccagccgtggagactcccgtgacgactctccgtagtcgcacgtcctcgtacggtacttcctaacctttagttaagtttagtttagggtagttcggaacggtccgttcggggggttccccgaccgtacggacccgttacccggaacgggggggaagggggtacccggttaggggttaccggtttacggtaccggggtaaccctaaaaccgtaacgtaaaaaccccgtaaggtaacggtaagggggaaaacgggttaaaaaggtaaaaaccgtttaaggttacgggttaacggggttaaccttacgttaaggggttacggggtaaaccggggtacccgtttaacggtttacccctaaaccgttaccgtttaaaccccgttccggtaaaacgggaaacccggttaacccgaaaacccgggtaacccgaaaaggttaaaccggtaaacctaaccgtttaacgggtaacttaccggtttaccggaaacgtaaacgtaggaaaaccgtaccggtacgtaacgggaacgtaaccggacccgggaacggtaacccggcggtacgttaaccggttaacgttaccgttaacggttacgtaacggggtacccgtaaggtaacgttaaccgttacgttaccggttacttacccgtttcggtttacccgttttacgaccgtttaccggg

SEQ ID NO: 46732 - DNA, 837 bp, Homo sapiens
  misc_feature: GYAE6OF02G7EKX.27.57.F02.1.454.CMB.1.raw
tcagagcgtcgtctcacgaccggtgctcgatttagctcgatatagttgggtttgaggtctcagagaggagccttagccctggactccaaggcctttccacttggtgatcagcacggagcacagacggacccaccatggaactggggctgagcgttgggtttttccttgttgcttattttagaaggtgtccagtgtgagggtgactacgtggtggtattcgtagggagggaggtggtggtcccaggtccgtgggaagaaccgttcccgtagaaccgtacctcctaccgtgtcgcgtacgtcccttcgtaggtactttaccttaccgttttaaggttaggtttacgttgggtagttacggtcggtccggttccggggttccccgaccgtaacggtaccccggtaccgggggaaggggggtaaccgggggtcggttaacggggttacgggttttcccgggaaccggggaaacccctaaaaacggttaaaaccgtaaaaaccgtaaaacgggtaaggtaaaccgggggtaaaaggttaaaaaacgtaaaacgtttggttaacgggtacgttaacttacgggtaggtaacggggacgggttaccgtaacttacccgaacccttacttaccgtaccgaaggtaaccgaaaccggaaaccaaccggtaaacgaacgtaccggtaaacgttcgttactcgaacgtaacgtaacgtaacgtaaccgacgttacgtacggagaccggaccgggaagaccgaggtacttcgtaacttcgtacgtcggtagaacggtacagttaccgtacttacgttacttacgtttccgtattttacggacttccggg

SEQ ID NO: 46733 - DNA, 781 bp, Homo sapiens
  misc_feature: GYAE6OF02JC03W.27.57.F02.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (682)..(682): a, c, t, g, unknown or other
  misc_feature (682)..(682): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctgggttttcctgttgcttatttagaggtgtccagtgtgaggtgcaactggtggattcgtggaggaggtgtgtccagctgganactcctgagactcncctgtgcagcctcgtaggtcttcctaccgtttagtgttaagttggatcggtacgtccgttacggggttcccgaccgtacggtacctccggaagggggtaaacggggtcgttaggggtaacgtttcggtaccggggaccctaaaccgtaaccgttaaaacccgaaagtaacgtacggggtaaaaggttaaaaacggaaaaacctttagtagggtcgggtaaaccgtttccgttaagggtaacgggtaacgggggccctaacgttttacccgaaaccgtacgtttacccgtaccgaaacggtaacggtaaaccccgaaaccggaacccgtaaaagggtaacgttccctaaaccgttcgttaacttaccgtacgaactaaacgtacgaaaccgacgtaccgtacggacggacggtaacccgaacggtaccgaacccggtnttacggttaacgttaccgtacggttaggttcggaaccggtagtacaaccgtttaccgtacggttacgtaccctttccgtacgttttacgtcttaccggg

SEQ ID NO: 46734 - DNA, 693 bp, Homo sapiens
  misc_feature: GYAE6OF02JPGDP.27.57.F02.1.454.CMB.1.raw
  modified_base (570)..(570): a, c, t, g, unknown or other
  misc_feature (570)..(570): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccaccatggaacgtggggctgagcgttgggttttcctttgttgtcttattttaggaaggtgtccgagtgtggaggtgctaacgtgggtggtattcgtgggaggtaggtggtggtccagtccgtggagactcccgtgagtacctctctgtcgcgacgcctgtagtacttcctaccgtttagttagttagttgtatgagtcgtcgggtcccgacgacgtaccgtaccggaggggaacgggtcgtaggtacgttcggtacggacctaactaataaaccgaagtagtacggtaaaggtaaacgtaaacgttagtaggtacggtactacgttaggtacgggaaacgggtacctacgttccaaccgtacttctaccgaagtacgaaacctaacgacgtaaagtacgtactaattacggtactacgtactaacgtaactaggtaaacncgtaccgaagggtacgacggtaccggaacgtaccgacggttacgtaccgttacctacgttcgtacgtcgaagtacgtatacgtcgttaacgtcgttaaccttcggtttacttacgtacgtcgg

SEQ ID NO: 46735 - DNA, 854 bp, Homo sapiens
  misc_feature: GYAE6OF02JRP1S.27.57.F02.1.454.CMB.1.raw
  modified_base (266)..(266): a, c, t, g, unknown or other
  misc_feature (266)..(266): n is a, c, g, or t
  modified_base (298)..(298): a, c, t, g, unknown or other
  misc_feature (298)..(298): n is a, c, g, or t
  modified_base (327)..(327): a, c, t, g, unknown or other
  misc_feature (327)..(327): n is a, c, g, or t
tcagagcgtcgtctcacgaccggtgctcgatttagctcgatatagttgggtttgaggtctcagagaggagccttagccctggactccaaggcctttccacttggtgatcagcacggagcacaggacggacccacatcggaactggggctgagtctgggtttcctgtgctatttagaggtcgtccagtgtgaggtgcactggtgattcagggaggagtggtcggccagccgtaggacgaacttccgagacgactctccgtggctacncgtccgtagtcggtacttctaaccgtttagtnttactggactaggactcggtcgggtaccncgtacgtaacctcggtaaggggacgggtccttaggggtacgttccggtacgacccgtaaaagtaaccgtaaaaccgtaggaacggtagggaaaacgttaaaaaccggtaacgttacggtacggtcggtaaactccgtaaaggggtaaccgggtaacgggtcctttaagttaacccgtacctacgggtacctaccggtaaaggtaccttaaccggaaaaccgggtcctaaaagggtacccttactaacggttcgttaaacgttccgaacgggtaacctaaaaggtcccggtaaaaaccgtcggttacccggtaaccgggaagttaaccccggggaccttaaaaccggggggtaaccctccgggggtttaacttaaccccgggtttaatttaacccccgggtggggttaaccgttaacgggtaacccggggaagtttaaccccggtttaaaccctgggggtttaacccttaccgggtttaacccttttcccggggtttaaacccgtttaggttcccctttaccgggggg

SEQ ID NO: 46736 - DNA, 716 bp, Homo sapiens
  misc_feature: GYAE6OF02IHHN1.27.57.F02.1.454.CMB.1.raw
tcagagcgtcgtctcacgaccggtgctcgatttagctcgatatagttgggtttgaggtctcagagaggagccttagccctgggactccaaggccctttccacttggtgatcagcacggagcacagacggacccaccatggaactggggctgaggcgttgggttttccttgttgcttattttagaaggttgtccagtgtgaggtgcaacgtggtggtattcgtgggaaggaggtgtaggtccaggccgtggaacgtaactccccgtgacgtacctctccgtgtagctacgtcctcgtggtacttacctaacgtttagttagttagtgtagtgtacgtccggtacgggtcccgaccgtacgaccgtacgggaacggggtagggtacgtgggttacggttccgtacggaaaccctaaagtaaactaaaacgaaggtaagttaacgggaaaaacggtaaaacgtaacttaggtaacggtacgtacgtagtacggtaacgggaacggtaccgttactaacctaaccgtacgtaccaacggaacgaacgaccgaaaaccgacgaaacgtacgtcgtaacgttacgttacaccgtaagaacgtaaatacgaacgaacgtaccgagaaccggacgacggaacgacgtacgtactaagttacctacgtggtacgcggaagtacgacttacgtacgtacgtacttcgttcctacgttctacgttcg

SEQ ID NO: 46737 - DNA, 688 bp, Homo sapiens
  misc_feature: GYAE6OF02GUX9N.27.57.F02.1.454.CMB.1.raw
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (263)..(263): a, c, t, g, unknown or other
  misc_feature (263)..(263): n is a, c, g, or t
  modified_base (343)..(343): a, c, t, g, unknown or other
  misc_feature (343)..(343): n is a, c, g, or t
  modified_base (406)..(406): a, c, t, g, unknown or other
  misc_feature (406)..(406): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactgggctggagctgggttttcctgttgcttattttagagtgtccagtgtgaggtncaacgtggtggattcgnggaggaggtgtggtccaggccgtggacgaactcccgtagacgactctactgngcagcctctggattctactttagtagttatggaattgagtctcggggtcccacgacgacgtccggaagggggtaacgggntagggtagtttcgcggaccaaataacgtaaaccgaacgagtacggaaagtaaacgtaaaactntacggtgaactgtagtaggaaccgggccattcacctatacctaccgaagaacgaacgtaaacgaccgaaacgtaacgacctacgtacgttacncgtanaacgaaactacgaaactacggacctaagggtacgaacggtacccgggaacgacccggtacggtcctaacggtaacttacccgttaagtcgggttaacggtaacccggaagtaaccggttaccgttacccgttaacggttaccttaaccggtttccccgttagttttttacggacctttcccggg

SEQ ID NO: 46738 - DNA, 789 bp, Homo sapiens
  misc_feature: GYAE6OF02IP7DS.27.57.F02.1.454.CMB.1.raw
  modified_base (198)..(198): a, c, t, g, unknown or other
  misc_feature (198)..(198): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacgacccacatggaactgggctgagcgttgggttttcctgttgcttatttagaaggtgtaccgagtgtgaggtcnctaacgttggtggtattccgtaggggaagggacgggttgttacggtacccgaaggtcccgttagggaagtaacgttaccccgtgacgtacctcctccgttgtcgcgacgtcctcgtcggtacttacctacgtttagttagttacgttaggagtagtaggtcgtcgggtcccgtacgacgaccgtacggaggggacggtgtcgggttacggttccgaggacctaacgtaacgtaaaccgaagtaagtaacgggtaaaacgttaaaacgtaaaaacgttagtaggtaacggtaacttcgtaggtacggaaacggtccgtaacgtaccgtaacctacgtccgtaacgaacggtaacgaaacccgaacgaaccggtaaaggtaaccgtaccgttaaccgttagtaaccgttacgaacgaaactaagaacgaaccgtacgtaccgtaagtaacggaccggaccgggaacggtaccgtaccggtaagtacgttaaccgttacgttacgttaggtaacgttaacggagttaaccgtaacgttacccgttacgttaacccgttaacgttcccgtttacgttttaccgacgtttaaccgg

SEQ ID NO: 46739 - DNA, 919 bp, Homo sapiens
  misc_feature: GYAE6OF02G5KDN.27.57.F02.1.454.CMB.1.raw
  modified_base (902)..(902): a, c, t, g, unknown or other
  misc_feature (902)..(902): n is a, c, g, or t
tcagagcgtcgtctcacgaccggtgctcgatttagctcgatatagttgggtttgaggtctcagagaggagccttagccctggactccaaggcctttccacttggtgatcagcacggagcacagacggacccacatggaacgtgggctgagcttgggttttccttgttgtctagttttagagttgtccagtgtgagtgctactggtggattcgtgggaggtacggtgtcggtccgaggtccgtggaacgtaactcccgtaggtacgtaccttccgtcctaggttcgacgacgtccctctgggtacctttaccgttaaccctttaaggttaagtttttacgttgggtaacttggacgtacggtttcccgggggtacccctaccgtaacggtacccgtaccggaacgggggggtaacgggtacgttcggggttaaccgtttcgggaccgggtaacccctaaacgaaacttaaaaacccggaaggtaacgttaagggggaaaaggttaaaaaccgtaaaaacggtttagtacgggttaaccggtacgttaccgttaggtaacggggtaaacgggtacccgtacgtttacccaaacccgtaccttccgaacccgtaaacggtaacccgaaacccggttaaaaccgaacccggtaaaaggtaaccttaacccggtaccggttaaggtttaccctttacggtaacggttaaaacaaacggttaaccgggaaactaaccgggttaaccctacgggaaaccgggtaaccgtaacccggggtaccgaaacgggttcccgtaacggttctttaaaccggtaccctttaagggtccggaacggtaccggtaaggtaaccgttacccttaacgtttaacggtacccctttaggtttaccttttaaccccggtttnaaaccccggtttcccgg

SEQ ID NO: 46740 - DNA, 810 bp, Homo sapiens
  misc_feature: GYAE6OF02GECOE.27.57.F02.1.454.CMB.1.raw
  modified_base (232)..(232): a, c, t, g, unknown or other
  misc_feature (232)..(232): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccacatggaactgggctgagctggtttcctgtgctattttagaaggtgtccagtgtgaggtgcaacgtggtggattcgtggaggaggtgtggtccagcctgganaactcccgtagacgtacgttctccgtgtgacctacgtcccttgtacgggtactttacccgttaacccttttaaggtacggttttagttgggtaacgttaggtaacggtccggttcggggtccccgtaccgaacgtaccgttacccggaagggggaacggggtctcggggtaaggttccggtacggtaaccccgaaacgtaacgtaaaacccgtaaaggtagtaacggggtaaaacgggtaaaaagtaaaaccttagttacgggtacgtaaccgttcgtaggttaacgggaacggggtacccgtaagtttacccgaaccgttaacgtaccgttaccgaagaaacccggtaaaccgtaaacggacccgtaaaaggtaaccggttaccgttaacgttcggtaaccgttacgtaacggtaactaaaccgttaagaaacccgtacgttacccggttagaaaccggtaccggacccggaaacgggaccgtaccgggtacttacgtaacgttaccgtaccggtaggtccggaagtacgtacgtacgttacgttactcgtaccgtttcctcgtttacgtactccgg

SEQ ID NO: 46741 - DNA, 652 bp, Homo sapiens
  misc_feature: GYAE6OF02JDYY1.27.57.F02.1.454.CMB.1.raw
  modified_base (343)..(343): a, c, t, g, unknown or other
  misc_feature (343)..(343): n is a, c, g, or t
  modified_base (526)..(526): a, c, t, g, unknown or other
  misc_feature (526)..(526): n is a, c, g, or t
tcagagcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattcgtggaggaggtgtggtccagcctggagaactccctggagactctcctgtcgcagcctctggacttcacctttagtatttattggatgagtcgtagggtccaccgagacctccggaaggggacggggctagggnggttcgcggaccaataactaaaccgaaagacgtaagggaaaggtaaaacgaaaattagtaggttacggaaccttgtagtaggtaaacggggccgtacttaccgacctaatccctacgaacgacgtaaccaaacggtacccaaagtacgaccacgttagtactactagaactaaagcgtaaacngaccgtaggacgaagggacccgaagggtaccacggtctacgggtaactacgtacgtggtacggacggaaggtacgaccgttaccgttagtaccgttcgttacccggttgttttaccgatttcccgg

SEQ ID NO: 46742 - DNA, 133 bp, Homo sapiens
  misc_feature: GYAE6OF01CRDST.49.60.F05.1.454.CMB.1.raw
  modified_base (131)..(133): a, c, t, g, unknown or other
  misc_feature (131)..(133): n is a, c, g, or t
tcagagtcgagagacacgaccggtgctcgatttagtacgtcatcagggaaagggcgcacactgcacatcgttggtttgggcatcgaaccggacaacgctgaactggtgagcgggctggcaaggcgcatagnnn

SEQ ID NO: 46743 - DNA, 164 bp, Homo sapiens
  misc_feature: GYAE6OF01C3RVI.49.60.F05.1.454.CMB.1.raw
  modified_base (155)..(164): a, c, t, g, unknown or other
  misc_feature (155)..(164): n is a, c, g, or t
tcagagtcgagagacacgaccggtgctcgatttagtacgtcatcagggaaagggcgcacactgcacatcgttggttgggcatcgaaccggacaacgctgaactggtgcaggggctggcaaggcgcatagctgagcgggctggcaaggcgcatagnnnnnnnnnn

SEQ ID NO: 46744 - DNA, 132 bp, Homo sapiens
  misc_feature: GYAE6OF01EZI3R.49.60.F05.1.454.CMB.1.raw
  modified_base (131)..(132): a, c, t, g, unknown or other
  misc_feature (131)..(132): n is a, c, g, or t
tcagagtcgagagacacgaccggtgctcgatttagtacgtcatcagggaaagggcgcacactgcacatcgttggtttggcatcgaaccggacaacgctgaactggtgacgcgggctggcaaggcgcatagnn

SEQ ID NO: 46745 - DNA, 135 bp, Homo sapiens
  misc_feature: GYAE6OF01DKU15.49.60.F05.1.454.CMB.1.raw
  modified_base (132)..(135): a, c, t, g, unknown or other
  misc_feature (132)..(135): n is a, c, g, or t
tcagagtcgagagacacgaccggtgctcgatttagtacgtcatcagggaaagggcgcacactgcacatcgttggtttgggcatcgaaccggacaacgctgaactggtgcgaggggctggcaaggcgcatagnnnn

SEQ ID NO: 46746 - DNA, 146 bp, Homo sapiens
  misc_feature: GYAE6OF01EY7QM.49.60.F05.1.454.CMB.1.raw
  modified_base (130)..(146): a, c, t, g, unknown or other
  misc_feature (130)..(146): n is a, c, g, or t
tcagagtcgagagacacgaccggtgctcgatttagtacgtcatcagggaaagggcgcacactgcacatcgttggtttggcatcgaaccggacaacgctgaactggtgagcgggctggcaaggcgcatagnnnnnnnnnnnnnnnnn

SEQ ID NO: 46747 - DNA, 137 bp, Homo sapiens
  misc_feature: GYAE6OF01D9PVH.49.60.F05.1.454.CMB.1.raw
  modified_base (133)..(137): a, c, t, g, unknown or other
  misc_feature (133)..(137): n is a, c, g, or t
tcagagtcgagagacacgaccggtgctcgatttagtacgtcatcagggaaagggcgcacactgcacatcgttggtttgggcatcgaaccggacaacgctgaactggtgcgacggggctggcaaggcgcatagnnnnn

SEQ ID NO: 46748 - DNA, 132 bp, Homo sapiens
  misc_feature: GYAE6OF01EVZ0Y.49.60.F05.1.454.CMB.1.raw
  modified_base (131)..(132): a, c, t, g, unknown or other
  misc_feature (131)..(132): n is a, c, g, or t
tcagagtcgagagacacgaccggtgctcgatttagtacgtcatcagggaaagggcgcacactgcacatcgttggtttgggcatcgaaccggacaacgctgaactggtgagcgggctggcaaggcgcatagnn

SEQ ID NO: 46749 - DNA, 133 bp, Homo sapiens
  misc_feature: GYAE6OF01EOJHV.49.60.F05.1.454.CMB.1.raw
  modified_base (132)..(133): a, c, t, g, unknown or other
  misc_feature (132)..(133): n is a, c, g, or t
tcagagtcgagagacacgaccggtgctcgatttagtacgtcatcagggaaagggcgcacactgcacatcgttggtttgggcatcgaaccggacaacgctgaactggtgacgcgggctggcaaggcgcatagnn

SEQ ID NO: 46750 - DNA, 136 bp, Homo sapiens
  misc_feature: GYAE6OF01BCIXG.49.60.F05.1.454.CMB.1.raw
  modified_base (131)..(136): a, c, t, g, unknown or other
  misc_feature (131)..(136): n is a, c, g, or t
tcagagtcgagagacacgaccggtgctcgatttagtacgtcatcagggaaagggcgcacactgcacatcgttggtttgggcatcgaaccggacaacgctgaactggtgagcgggctggcaaggcgcatagnnnnnn

SEQ ID NO: 46751 - DNA, 139 bp, Homo sapiens
  misc_feature: GYAE6OF01CXH8J.49.60.F05.1.454.CMB.1.raw
  modified_base (128)..(128): a, c, t, g, unknown or other
  misc_feature (128)..(128): n is a, c, g, or t
  modified_base (133)..(139): a, c, t, g, unknown or other
  misc_feature (133)..(139): n is a, c, g, or t
tcagagtcgagagacacgaccggtgctcgatttagtacgtcatcagggaaagggcgcacactgcacatcgttggtttgggcatcgaaccggacaacgctagaactggtgcgaggggcctggcaaggcncatgnnnnnnn

SEQ ID NO: 46752 - DNA, 125 bp, Homo sapiens
  misc_feature: GYAE6OF02G50ML.49.60.F05.1.454.CMB.1.raw
  modified_base (125)..(125): a, c, t, g, unknown or other
  misc_feature (125)..(125): n is a, c, g, or t
tcagagtcgagagacacgaccggtgctcgatttagtacgtcatcagggaaaggggctggccctgacgtgtttctgttcccaccctcctctctctcgactctgagcgggctggcaaggcgcatagn

SEQ ID NO: 46753 - DNA, 132 bp, Homo sapiens; identical to SEQ ID NO: 46748
  misc_feature: GYAE6OF02HOB59.49.60.F05.1.454.CMB.1.raw
  modified_base (131)..(132): a, c, t, g, unknown or other
  misc_feature (131)..(132): n is a, c, g, or t

SEQ ID NO: 46754 - DNA, 169 bp, Homo sapiens
  misc_feature: GYAE6OF02FPE0J.49.60.F05.1.454.CMB.1.raw
  modified_base (156)..(169): a, c, t, g, unknown or other
  misc_feature (156)..(169): n is a, c, g, or t
tcagagtcgagagacacgaccggtgctcgatttagtacgtcatcagggaaagggcgcacactgcacatcgttggtttgggcatcgaaccggacaacgctgaactggtgcaggggctggcaaggcgcatagctgagcgggctggcaaggcgcatagnnnnnnnnnnnnnn

SEQ ID NO: 46755 - DNA, 554 bp, Homo sapiens
  misc_feature: GYAE6OF01CSJ7M.3.12.B01.1.454.CMB.1.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgagggggaaanagccaccctctcctgcagggccagtcagagtgttagtgcaacttagcctggtaccagcatatcttggccaggctcccaggctctcatctatggtgcatcccacccgggcacgtgtactcccagccgaggttcagtggcagtgggctggacagagttcactctcactntcagcagcctggatctagaanctctgctagtttattacgtgtcagactagttattaattacgtggtaccgtggtaccggttccggacgtaagggacctaagggtaggaaactaccgaaaacggtaacgtggtagggtcctacggaccctaccgtaattccgttagttccttccgtaactttcccccg

SEQ ID NO: 46756 - DNA, 527 bp, Homo sapiens
  misc_feature: GYAE6OF01ETVI3.3.12.B01.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (519)..(519): a, c, t, g, unknown or other
  misc_feature (519)..(519): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagtagcaacttagcctggtaccagcatattctggccaggctcccaggcctcctcatctatggtncatcccacccgggccactggtactcccagccaggttcaggtggcaggtgggtctggacagagttcactctcacatcagcagcctggatctgaagctctgctagtttatactgtcagctagttataattacgtggtccgtaggtacgttcggaccgtaagggaccgaagggtacggaaatccgaaaacggtacgtggtaggtctggacacctacttctagtccttnacttcccg

SEQ ID NO: 46757 - DNA, 183 bp, Homo sapiens
  misc_feature: GYAE6OF01A8JTC.3.12.B01.1.454.CMB.1.raw
  modified_base (182)..(183): a, c, t, g, unknown or other
  misc_feature (182)..(183): n is a, c, g, or t
tcagagacgcactccacgaccggtgctcgatttagtagtgtagattccgcgggcacgaccggtgctcgatttagtagtgtagatcccgcggaatctacactactaaatcgagcaccggtcgtgctgcctggtcaaggactacttccgagtgcgtctctgagcgggctggcaaggcgcatagnn

SEQ ID NO: 46758 - DNA, 512 bp, Homo sapiens
  misc_feature: GYAE6OF01DAN3R.3.12.B01.1.454.CMB.1.raw
  modified_base (305)..(305): a, c, t, g, unknown or other
  misc_feature (305)..(305): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
tcagagacgcactccacgaccggtgctcgatttagtagtgtagattccgcggggggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacngggccactggcatcccagccaggttcagtgcagtggctggacagacttcactctacaccatcagtacgcctagacgacctgaagtattttgctagtctattattgtcaacagcgtggcaacgtcgccctcggtggtacgttcggacaacgggaccaaggtaggaaactcgaacgacgtgtagctgacacatctgtntcntcctcccg

SEQ ID NO: 46759 - DNA, 522 bp, Homo sapiens
  misc_feature: GYAE6OF01CWUED.3.12.B01.1.454.CMB.1.raw
  modified_base (198)..(198): a, c, t, g, unknown or other
  misc_feature (198)..(198): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (515)..(515): a, c, t, g, unknown or other
  misc_feature (515)..(515): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccacctctcctgcagggccagtcagagtgttagtagcaacttagcctggtaccagcatattctggcaggctccagctctnatctatggtncatccaccgggccacgtcggtactcccagccgaggttcagtggcaggtgggtctcgggacaggacgttcactctcaaccatcagcagccgtggacgtctagaacgctctgactagtttatactgtacagtcagtataatacgtggcgtggacgttcgaccgtaggaccaaggtgaaactacgaaaacgtacgtagacggtctacgacaccgtattcgtagtccttncttcccg

SEQ ID NO: 46760 - DNA, 502 bp, Homo sapiens
  misc_feature: GYAE6OF01B07SI.3.12.B01.1.454.CMB.1.raw
  modified_base (197)..(197): a, c, t, g, unknown or other
  misc_feature (197)..(197): n is a, c, g, or t
  modified_base (351)..(351): a, c, t, g, unknown or other
  misc_feature (351)..(351): n is a, c, g, or t
  modified_base (487)..(487): a, c, t, g, unknown or other
  misc_feature (487)..(487): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcaggggccagtcagagtgttagtagcaacttagcctggtaccagcatattcttggccaggctccaggctcctcatctatggtgcatccacccgggcactggtatcccagccaggttcagtggctagtgggtctggacagnttcactctcaccatcagcagcctggatctgaagtctctgctagtttatactgtcagcagtataattactcggtccgttggacgttcggaccgaagggaccaaggtgaaactacgaaacgtactggtcgctgcactntctatcttcattccc

SEQ ID NO: 46761 - DNA, 569 bp, Homo sapiens
  misc_feature: GYAE6OF01D21IC.3.12.B01.1.454.CMB.1.raw
  modified_base (198)..(198): a, c, t, g, unknown or other
  misc_feature (198)..(198): n is a, c, g, or t
  modified_base (295)..(295): a, c, t, g, unknown or other
  misc_feature (295)..(295): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattctggccaggctcccaggctcctcatctatggtncatcccgacccgggcactggtactcccagccaggttcagtggcaggtgggtctcggacagacgttcactctcaccatcagcagcctggagtctagaagactcgtgctagttttactactgtcagctagttataacttacgtcgggccgttaggtaccgtttacggacccgtaaggggaccctaaagggttaggaaaactaccgaaaacggtaacgttggtacgggtcctaggacccaacccgtattccgtaggttcctttccgacgtttccccg

SEQ ID NO: 46762 - DNA, 583 bp, Homo sapiens
  misc_feature: GYAE6OF01CWQQ5.3.12.B01.1.454.CMB.1.raw
  modified_base (198)..(198): a, c, t, g, unknown or other
  misc_feature (198)..(198): n is a, c, g, or t
  modified_base (573)..(573): a, c, t, g, unknown or other
  misc_feature (573)..(573): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattcttggccaggctcccaggctcctcatctatggtgcatccacccgggccactggtactcccagccaggttcagtggcaggtgggtctcggacaggagttcactctcaccatcagcagcctggagtctaggaacgactcgtgctagttttattactgttacagactagttaattaacttaccgtgggtacccggttggtaccggtttaccgggaccgtaaaggggtacccgtaaagggtacggaaaacgttaccgaaaacggtaaacgttgggtacggcgtacggacctaacccagttcctagtttccgttcncgtttccccg

SEQ ID NO: 46763 - DNA, 541 bp, Homo sapiens
  misc_feature: GYAE6OF01DAXCZ.3.12.B01.1.454.CMB.1.raw
  modified_base (198)..(198): a, c, t, g, unknown or other
  misc_feature (198)..(198): n is a, c, g, or t
  modified_base (290)..(290): a, c, t, g, unknown or other
  misc_feature (290)..(290): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagagcaacttagcctggtaccagcatatctggcaggctccaggctctcatctatggtncactcccaccgggcactggtactcccagccaggttcaggtgcagtgggtctcggacagacgttcacttctcaaccatcagcacgcccgttggagtctagaacgtactcgtgactagttttattacgtgtccagtctagttataattacgtggtccgtggacgttcggacgaagggaccaagggtagaaactacgaaacgtaacgttggtacggctaggaccaactagttacctgttacttcacgttccccg

SEQ ID NO: 46764 - DNA, 608 bp, Homo sapiens
  misc_feature: GYAE6OF01BQIXJ.3.12.B01.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
  modified_base (452)..(452): a, c, t, g, unknown or other
  misc_feature (452)..(452): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanacgccaccctctcttgcagggccagtcagagtgttagagcaacttagcctggtaccagcatattctggcaggctcccgaggctcctctatctatggtncactcccgaccgggccacgtggtactcccagcctaggttcacggtggactagggtcgggtctcgggaactaggtacgttcactctacaacctagtcagcacggctggacgtctagaacgtactcgtgtaccttagtttacttacgtgtacaagtntaagttaattaacgttacgtcgggtaccggttacggtaaccgttcggaacccggaagggtaaccgaagggtaggaaaactaacgaaaaccggtacgtaggtaggacgtcggaaccctaccgtaacttccgttagttccttacgtaccgtttccccg

SEQ ID NO: 46765 - DNA, 630 bp, Homo sapiens
  misc_feature: GYAE6OF01A4IKR.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaangccacctctcctgcagggccagtcagagtgttagtagcaacttagcctggtaccagcatattctggccaggctcccaggctcctcatctagtggtgcactcccgaccgggccacgtggtactcccgagccaggttcaggtggcaggtgggtctcgggacaggtagttcactctacaccatcagcacgccgtaggactctaggaacgtcttcgtgtaccttaaggttttacttacgtcgttacaggtactaagttaacttaacgtttacgtcgggtacccgttacggggtaaccggtttccgggaaccggtaaacggggtaaccgtaaaggggttaacggtaaaacctaaccggtaaaaacggtacgttagggtcgggtactacggaacctaccgtagttaccgttacggtttacctttcgactttcccccg

SEQ ID NO: 46766 - DNA, 556 bp, Homo sapiens
  misc_feature: GYAE6OF01C4YDH.3.12.B01.1.454.CMB.1.raw
  modified_base (199)..(199): a, c, t, g, unknown or other
  misc_feature (199)..(199): n is a, c, g, or t
  modified_base (293)..(293): a, c, t, g, unknown or other
  misc_feature (293)..(293): n is a, c, g, or t
  modified_base (355)..(355): a, c, t, g, unknown or other
  misc_feature (355)..(355): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagcccaccctgtctgtgtctccaggggaaangccacctctcctgcagggccagtcagagtgttagtagcaacttagcctggtaccagcattattctggccaggctccaggctctcatctatggtncactcccacccgggccacgtggtactcccagccaggttcaggtgcaggtcgggtctcggacngtagttcactctcacatcagcagcctggacgtctagaacgtctctggactagtttacttactgtcagactagttaattaatacgtggcgttacgggtacgttcgggaccgtaacgggtaccgaagggtacggaaacgtcgaaaacggtacgtggtacggtctacgaccaccgtattccgtagttccttcgtacgtttcccg

SEQ ID NO: 46767 - DNA, 610 bp, Homo sapiens
  misc_feature: GYAE6OF01EO2UZ.3.12.B01.1.454.CMB.1.raw
  modified_base (199)..(199): a, c, t, g, unknown or other
  misc_feature (199)..(199): n is a, c, g, or t
  modified_base (384)..(384): a, c, t, g, unknown or other
  misc_feature (384)..(384): n is a, c, g, or t
  modified_base (433)..(433): a, c, t, g, unknown or other
  misc_feature (433)..(433): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagcccaccctgtctgtgtctccgaggggaaanacgccacctctcctgcagggccagtcagagtgttagtagcaacttgcctggtaccagcattattcttggccaggcctcccaggcctcctcatctagtggtgcatcccgacccgggccactggtactcccagcccaggttcaggtcggcaggtcgggtctcggacaggacgttcactctacacctntcacgcagtcctggagtctagaacgctctgtactagttttactacgttntacgagtacgtagttaacttaagtttaacgtcgggtaccggttagggtacccggtttacggacccgaacggggtaacctaaggggtaacgaaaacgttaccgaaaacggtaccgttaggtacgggccttacgggaccctaaccgtgttacgttggttccctttcgaacgtttccccg

SEQ ID NO: 46768 - DNA, 501 bp, Homo sapiens
  misc_feature: GYAE6OF01AHJU7.3.12.B01.1.454.CMB.1.raw
  modified_base (197)..(197): a, c, t, g, unknown or other
  misc_feature (197)..(197): n is a, c, g, or t
  modified_base (495)..(495): a, c, t, g, unknown or other
  misc_feature (495)..(495): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagtagcaacttagcctggtaccagcatattcttggccaggctcccaggctcctcatctatggtgcatccacccgggccactggtactcccagccaggttcagtggcagtgggtctcggacagagttcactctcaccatcagcagcctggagtctgaagactctgctagtttatactgtcagctagtataattactggccgttggacgttcggccaagggaccaagggtgaaatcaaacgactggtggctgcaccatctgtcttcnttcccg

SEQ ID NO: 46769 - DNA, 507 bp, Homo sapiens
  misc_feature: GYAE6OF01B6DRQ.3.12.B01.1.454.CMB.1.raw
  modified_base (197)..(197): a, c, t, g, unknown or other
  misc_feature (197)..(197): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgtagtagcaacttagcctggtaccagcatattcttggccaggctcccaggctcctcatctatggtgcatcccacccgggccactggtactcccagccaggttcagtggcagtgatatgggacagacttcactctcaccatcagcaatctgcagtctagaatattttgacttagtttatttctgttcagtactagtttaacacttggtcctggtaagtttcggaccgtagggaccaaggcgtggacgcgtacaaacgactggtgctgccacatctgtcttc

SEQ ID NO: 46770 - DNA, 553 bp, Homo sapiens
  misc_feature: GYAE6OF01D1CQJ.3.12.B01.1.454.CMB.1.raw
  modified_base (198)..(198): a, c, t, g, unknown or other
  misc_feature (198)..(198): n is a, c, g, or t
  modified_base (295)..(295): a, c, t, g, unknown or other
  misc_feature (295)..(295): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagtagcaacttagcctggtaccagcatattcttggccaggctcccaggctcctcatctatggtncactcccgacccgggccacttggtactccccagccaggttcaggtggcaggtgggtctcgggacaggagttcactctcaccatcagcagcctggatctagaagctcgtgctagttttatactgtacagtcagttataattacgtggccgttaggtaccgttcggacctaaggggacctaaagggtggaaaactcgaaaaccggtacgtggtacggcctaggacctaaccgtattacgttacgttcttccgacttcccg

SEQ ID NO: 46771 - DNA, 574 bp, Homo sapiens
  misc_feature: GYAE6OF01D4IKP.3.12.B01.1.454.CMB.1.raw
  modified_base (199)..(199): a, c, t, g, unknown or other
  misc_feature (199)..(199): n is a, c, g, or t
  modified_base (465)..(465): a, c, t, g, unknown or other
  misc_feature (465)..(465): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagccaccctctcctgcagggccagtcagagtgttagagcaacttagcctggtaccagcatattctggccaggctcccaggctcctcatctatggtgcatcccgacccgggcactggtactcccagccaggttcagtcggcaggtgggtctcgggacaggtacgtttcacttctccaaccattccagcagtcccgtaggggacttcgtaggaaacgtacttcgtaggcttaagttttacttacgtgtcagtctaagtataattacgnggtccgtggtacgttcggaccgaagggaccaaagggtagaaactacgaaaacggtacgtggtacggactagaccctaacctagttacgtagttcctttcgacttccccg

SEQ ID NO: 46772 - DNA, 494 bp, Homo sapiens
  misc_feature: GYAE6OF01C4ALJ.3.12.B01.1.454.CMB.1.raw
  modified_base (197)..(197): a, c, t, g, unknown or other
  misc_feature (197)..(197): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaangccaccctctcctgcagggccagtcagagtgttagtagcaacttagcctggtaccagcatattctggccaggctccaggctcctcatctatggtgcatcccacccgggcactggtactcccagccaggttcagtggcagtgggtctcggacagngttcactcncaccatccagcagcctgggagtctgaagactctgtctagtttattactgtcagctagtataattcgtggccgtgacgttcgcgaaggacaaggtagaatacgaaacgatgngcngcactntctgtctntntccc

SEQ ID NO: 46773 - DNA, 588 bp, Homo sapiens
  misc_feature: GYAE6OF01E4GXO.3.12.B01.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
  modified_base (443)..(443): a, c, t, g, unknown or other
  misc_feature (443)..(443): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccgaggggaaangccaccctctcctgcagggccagtcagagtgttagtagcaacttagcctggtaccagcatattcgtggccaggcctcccaggcctcctcatctagtggtnccactccccgaccgggccacgttggtactcccgagccgtaggttcaggttgcgtaggtcgggtcctcggacagtacgttcactctcaccatcagcacgtccgtagggactcgtagaacgtactcgtagacttagtttaacttcgngtacagtactaagtaattaagttacgtgggtccgttagggtaccgttcgggaccgaacgggtaccaaagggtacggaaaactacgaaacgtacgtggacggtccttacgaccaccgtacgttcgttagttccttcgacttccccg

SEQ ID NO: 46774 - DNA, 556 bp, Homo sapiens
  misc_feature: GYAE6OF01CNRPK.3.12.B01.1.454.CMB.1.raw
  modified_base (198)..(198): a, c, t, g, unknown or other
  misc_feature (198)..(198): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattcttggccaggctcccaggctcctcatctatggtgcatcccacccgggcacgtggtactcccgagccaggttcaggtggcgaggttcggggtctcggacaggacgttcactcgtcaccatcagcagcctggagtcgtagaagactctgtactagtttattactgtcagtctaagttattaattacgtggtaccccgtggtaccggttcggaccgaacgggaccgaagggtacggaaataccgaaacgtacgtaggtaggtctcgacaccgtactactgttccttctcttaccccg

SEQ ID NO: 46775 - DNA, 588 bp, Homo sapiens
  misc_feature: GYAE6OF01CPIJT.3.12.B01.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagcccaccctgtctgtgtctccgaggggaaanagccaccctctcctgcagggccagtcagagtgttagtagcaacttgcctggtaccagcaattattctggccaggcctccaggctcctcatctatggtncactcccgacccgggcacgtggtactcccagcctaggttcagtgcaggtcgggtctcggacagacgttcactcncaccancagcagcctaggctctagaacacttctgactagttttaactacgtgtacagctaagttaattaacgttacgtcgggtacccggttggtaacccggtttccggaaccgtaacggggaacccgtaaaggggtaagtaaaactaccgaaaacggtaacgttggtacggctagtccaaccgtattccgttacgtttacttcgtacgtttccccg

SEQ ID NO: 46776 - DNA, 543 bp, Homo sapiens
  misc_feature: GYAE6OF01B0EJ5.3.12.B01.1.454.CMB.1.raw
  modified_base (151)..(151): a, c, t, g, unknown or other
  misc_feature (151)..(151): n is a, c, g, or t
  modified_base (198)..(198): a, c, t, g, unknown or other
  misc_feature (198)..(198): n is a, c, g, or t
  modified_base (349)..(349): a, c, t, g, unknown or other
  misc_feature (349)..(349): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacngtgctgacgcagtctccagccaccctgtctgtgtctccaggggaaangccaccctctcctgcagggccagtcagagtgttagtagcaacttagcctggtaccagcatattctggccaggctcccaggctcctcatctatggtgcactcccacccgggcactggtactcccagccaggttcaggtggcaggtcgggtcncggacagagttcactctcaccatcagtcagtcctgggacgtctagaacgactcgtagcttagttttatactgtacagtctagtaataagttactggccgttaggacgttcggacgaacgggaccaagggtacgaaactacgaaacgtacgtggtaggctacgccaccgtattcgttagtcctttcacgttcccg

SEQ ID NO: 46777 - DNA, 594 bp, Homo sapiens
  misc_feature: GYAE6OF01CACP1.3.12.B01.1.454.CMB.1.raw
  modified_base (198)..(198): a, c, t, g, unknown or other
  misc_feature (198)..(198): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagtagcaacttagcctggtaccagcatattcttggccaggctcccaggctcctcatctatggtgcatccacccgggcactggtactcccagccaggttcagtggcaggtgggtctcggacagtagttcacttctcaccatcagcagtccctgggacgtctagaatctctcggcttaagttttattacgtgtacagtactaagttaattaacgtttacgtcgggtcccggttgggtaaccggtttccgggacccgtaaaggggacccgtaaagggttacgggtaaaactaccgaaaacggtacgttaggtacgggcgttacgaccgtaaccgtacttcgttagttcctttacgtacctttcccg

SEQ ID NO: 46778 - DNA, 545 bp, Homo sapiens
  misc_feature: GYAE6OF01CODZP.3.12.B01.1.454.CMB.1.raw
  modified_base (200)..(200): a, c, t, g, unknown or other
  misc_feature (200)..(200): n is a, c, g, or t
  modified_base (397)..(397): a, c, t, g, unknown or other
  misc_feature (397)..(397): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaaggggaaanagcccaccctctcctgcagggccagtcagagtgtagtagcaacttagcctggtaccagcatattcttggccaggctcccaggctcctcatctatggtgcactcccacccgggccactggtactcccagccaggttcagtggcaggtgggtctgggacagagttcactctcaccatcagcagcctgcagtctgaagtntttgcttacttttatttctgtcagtctagtaataagtaactggtacccttccggtaggtacggttcgggccgggggtaaccgagggtggaagtacgtacgaaacggtacgtggtcggctgacctaaccattcgtcgttcttcgtaccg

SEQ ID NO: 46779 - DNA, 640 bp, Homo sapiens
  misc_feature: GYAE6OF01DW80W.3.12.B01.1.454.CMB.1.raw
  modified_base (150)..(150): a, c, t, g, unknown or other
  misc_feature (150)..(150): n is a, c, g, or t
  modified_base (199)..(199): a, c, t, g, unknown or other
  misc_feature (199)..(199): n is a, c, g, or t
  modified_base (309)..(309): a, c, t, g, unknown or other
  misc_feature (309)..(309): n is a, c, g, or t
  modified_base (615)..(615): a, c, t, g, unknown or other
  misc_feature (615)..(615): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacngtgctgacgcagtctccagccaccctgtctgtgtctccgaaggggaaancgcccaccctctcctgcgagggccagtcagagtgttagtagctaacttagcctaggtaccagctattattctggaccaggcctacccgaggtctcctcattctagtggtnacctagtcccgacccgggtctacgttggtaactccccgagaccgtaggttcaggtcggacctaggttcgggtcctcggggactaaggtacgttccacttcctacgaacctattacacgtcaacggtcccgttagggacgttaccgtaggaaacgtaccttcgtggtacttaaggtttttaactacgttgtactagacttaagttaataagttacgtcggtaccggtaggtaccgttccggacgtaacgggacctaaagggtacgaaactacgaaaacgtacgtggtacggtcttagaccaaccgtnttaccgttgttactcgtcttccccg

SEQ ID NO: 46780 - DNA, 637 bp, Homo sapiens
  misc_feature: GYAE6OF01CCTP7.3.12.B01.1.454.CMB.1.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccacctntcctgcagggccagtcagagtgttagagcaacttgcctggtaccagcatatctggcaggctccaggctctnatctatggtncactcccgaccgggccacgtggtactcccgagcctaggttcaggtggcaggttcgggtctcgggacaggtacttccgacttcgtacacccgattccgagccgaagtcccgtagggacgttcgtaggaaacgtacttcgtaggtaccttaaggttttacttaaccgtgtacgtagtactaaggttaacttaaagtttaccgtgggtacccgttagggttaacccggtttcgggaacccggtaaacggggtaacccgtaaagggttacggaaaaacgttaccgaaaaaccggtacgttggtacggtccttacggaccaaccgtactccgttagtttccttcctagtttccccg

SEQ ID NO: 46781 - DNA, 679 bp, Homo sapiens
  misc_feature: GYAE6OF01D0WDG.3.12.B01.1.454.CMB.1.raw
  modified_base (199)..(199): a, c, t, g, unknown or other
  misc_feature (199)..(199): n is a, c, g, or t
  modified_base (303)..(303): a, c, t, g, unknown or other
  misc_feature (303)..(303): n is a, c, g, or t
tcagagacgcactccacgaccggtgctcgatttagtagtgtagattccgcggggggaactgctcagttaggacccagacggaaccatggaagccccagcgcagcttctcttcctcctgcttactctggctcccagatatcactggagaaacagtgctgacgcagtctccagccaccctgtctgtgtctccgaggggaancgccaccctctcctgcgagggccagtcagagtgttagtacgctaacttagcctggtaccagctatattctggccaggcctccaggcctcctctatctagtggtnccacgtcccgacccgggccacgttggtacctccccgacgtcccgtaggtttcagggtcggacgtacgggttcggggtcctacgggaactaacggttacgtttaccaccttccgttaccgaacctagtccgaacgcgtacgtccgtagggacttcgtagaacgtacttcgtcgaactttagtttacttacgtgtaccgagtactaagttaattaacgtttaccgcgggttaccgttacggggtaccgtttccgggaaccggtaacgggacggtaaagggtacggaaaactaacgtaaaaccggtacgtagggtacggtactacggaacccaaccgtacgtttaccgttaccgtttacctttaccgcctttaccccgg

SEQ ID NO: 46782 - DNA, 624 bp, Homo sapiens
  misc_feature: GYAE6OF01AOZ62.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaangcccaccctctcctgcagggccagtcagagtgttagagcaacttgcctggtaccagcatattcttggccaggctcccgaggcctcctcattctagtggtgcactcccgacccgggccacgtggtactccccgagcctaggttccaggtcggcaggttgggtcctcgggactaggtagttccacttctacacctatccagcacggtcctgggtacgtccgtagaacgtacctcgtgtaccgtagttttacttacgtgtctaggctaagttataatttacgtacggtccgttagggtaccggtttacggaccggtaacggggacccgtaaagggtacggaaaacgtaccggaaaacggtaccgttagggtacggtacctacggacctaaccgtaacttccgttagttaccgttactcgtttaccccg

SEQ ID NO: 46783 - DNA, 585 bp, Homo sapiens
  misc_feature: GYAE6OF01C5PD5.3.12.B01.1.454.CMB.1.raw
  modified_base (199)..(199): a, c, t, g, unknown or other
  misc_feature (199)..(199): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (358)..(358): a, c, t, g, unknown or other
  misc_feature (358)..(358): n is a, c, g, or t
  modified_base (404)..(404): a, c, t, g, unknown or other
  misc_feature (404)..(404): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccgaaggggaaancgcccaccctctcctgcagggccagtcagagtgttagagcaacttagcctggtaccagcatattctggccaggctcccaggctcctnatctatggtncatcccgaccgggccatggactcccgagccaggttcagtggactaggtcgggtcacggaacngtagttcactctacaccatcagcagcctggacgtctaggaacactntggacttaagtttatactgtcaagtcaagttaactaactttaacggcggtaccgtagggtaaccggttcgggaaccgaacggggaaccgtaaagggtacggaaaaacgtaacgaaaaacggtaccgttagtcgggtcctagacccaaccgtaacttcgttagtctttacgactttccccgg

SEQ ID NO: 46784 - DNA, 686 bp, Homo sapiens
  misc_feature: GYAE6OF01BQR0I.3.12.B01.1.454.CMB.1.raw
  modified_base (151)..(151): a, c, t, g, unknown or other
  misc_feature (151)..(151): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacngtgctgacgcagtctccagcccaccctgtctgtgtctccgaggggaaagacgcccaccctctcctgcagggccagtcagagtgttagtagctaacgttagcctggtaccagcatattcgtggccaggcctcccgaggtcctcctcatctagtggtcgcctacgtccccgacccgggcctacgtcggtactccccgagtcccgtagggtttccaggttcggaccgtagggttcgggtcctacggggaactaggtacgtttccaaccttcctaccaccctaatccagccgtacgcccgtagggacgttcgtaggaacgtaccttcgtcggtaccttaaggttttacttacgtgtacacgtactaagttaattaacgtttaccgtcgggtccggttacgggtaccggttcgggaaccgtaacgggtaacccgtaaagggttacggaaaaccttaaccggaaaacggtacgttacgggttacgggacctacggtaccaacccgttagttccgtaggtttaccttcgtaccgtttccccg

SEQ ID NO: 46785 - DNA, 676 bp, Homo sapiens
  misc_feature: GYAE6OF01CLSNX.3.12.B01.1.454.CMB.1.raw
  modified_base (152)..(152): a, c, t, g, unknown or other
  misc_feature (152)..(152): n is a, c, g, or t
  modified_base (199)..(199): a, c, t, g, unknown or other
  misc_feature (199)..(199): n is a, c, g, or t
  modified_base (330)..(330): a, c, t, g, unknown or other
  misc_feature (330)..(330): n is a, c, g, or t
tcagagacgcactccacgaccggtgctcgatttagtagtgtagattccggcggggggaactgctcagttaggacccagacggaaccatggaagccccagcgcagcttctcttcctcctgctactctggctcccagatatcactggagaaacngtgctgacgcagtctccagccaccctgtctgtgtctccgaggggaanacgccacctctctgcagggccagtcagagttgttagtagactaacgttagcctggtaaccaggctagttagttccgttagggaccctaggtcctccccgaggtccctcctcgtattccgtagttcgggtcncctactccccgaacccggggctacgtcggtactcccgagtccgtaggttcgaggtcggcgtaggtcgggtctacgggactagtcgtttccacgttctaccgactataccgacgaccgacggtccgttagggtacttcgtaagaacgtacgttcgtagtaccgtttaagttttacttacgtcgtacgtacgtacgttaagttacgttaaacgtttacggtacggtcccgggttaggttaaccggttacgggacccgtaaacgggaaccgtaagggtacgaaacttacgaaacggtacgtggtaacggctacggaccacgtactacgttcggttacttcgacttcccg

SEQ ID NO: 46786 - DNA, 545 bp, Homo sapiens
  misc_feature: GYAE6OF01CYZ3X.3.12.B01.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagccaccctctcctgcagggccagtcagngtgttagtagcaacttgcctggaccagcatattcttggccaggctcccaggctcctcatctatggtgcatcccgacccgggccacgtggtactcccgagccaggttcagtggcaggtgggtctcggacagagttcactctcaccatcagcagcctggatctgaacgactcgtgctagtttattacgtgtcagctaagttattaagttacgtcgggtccgttggtaccggtttacggaccgaagggacctaaggggtacgaaatacgaaacgtacgtggtaggacttcgacactactcttgttccttcgtcttcccg

SEQ ID NO: 46787 - DNA, 747 bp, Homo sapiens
  misc_feature: GYAE6OF01B7VQS.3.12.B01.1.454.CMB.1.raw
  modified_base (199)..(199): a, c, t, g, unknown or other
  misc_feature (199)..(199): n is a, c, g, or t
  modified_base (300)..(300): a, c, t, g, unknown or other
  misc_feature (300)..(300): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagccaccctctcctgcagggccagtcagagtgttagtagcaacttgcctggtaccagctatattcttggccaggcctcccaggcctcctcatctagtggtncactcccgacccgggccactggtactcccgagccaggttcaggttcggctaggttcggggtcctacgggaactagggtaacgtttccaaccgttccttacccgaacctagttccaaacggtccgaacgggtccccgttagggggtacgttccgtaaggaaacgtaccgttcgtaggtaccttaaggtttttaacttaccgttcggtaccgtaaggtaccttaaaggtttaaactttaacgtttacccggttacggggtacccggtttaggggtacccggttttaccgggaacccggtaaaacgggggaaccccgtaaagggggttaacggtaaaaccgtaaccggtaaaaaacccggtacgtttaggggttacggggtacccttacgggtacctaacccgttacgttacccggttacggtttaccctttacgtaccgtttacccccg

SEQ ID NO: 46788 - DNA, 647 bp, Homo sapiens
  misc_feature: GYAE6OF01DT9MB.3.12.B01.1.454.CMB.1.raw
  modified_base (150)..(150): a, c, t, g, unknown or other
  misc_feature (150)..(150): n is a, c, g, or t
  modified_base (198)..(198): a, c, t, g, unknown or other
  misc_feature (198)..(198): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacngtgctgacgcagtctccagccaccctgtctgtgtctccgaggggaaangccaccctctcctgcagggccagtcagagtgttagtagctaacttagcctggtaccagcattattcgttcggccaggcctcccgaggtctcctcatctagtggtgctactcccgacccggcacgttcggtactcccgagccgtaggttcaggtcggacgtagggtcgggtcgtcgggaactaggacgtttaccacgttctaccaccgtatacgacgcacgcctgctagttacgtagtaagttactttcgtactttacgttttactttcgtcgttaccagtactaagttaataaacgttaacgtccgtacccgttaccgggttacgggttaccgggttaccggggaccgggggtaaccgtaaggggtacggtacggtaactaaccggtaaacgtaacgttgggtcggtaccgtccgacgtaccgttacgttcgttcgttcttccgtaccg

SEQ ID NO: 46789 - DNA, 608 bp, Homo sapiens
  misc_feature: GYAE6OF01CLWZV.3.12.B01.1.454.CMB.1.raw
  modified_base (201)..(201): a, c, t, g, unknown or other
  misc_feature (201)..(201): n is a, c, g, or t
  modified_base (483)..(483): a, c, t, g, unknown or other
  misc_feature (483)..(483): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggaagaaacagtgctgacgcagtctccagccaccctgtctgtgtctccgaaggggaaanacgccaccctctcctgcgacgggccagtcagagtgttagtagactaacttagccgtaggtaccagcattatttcttggccaggcctcccgaggcctcctcatctagtggtcgcactcccgacccgggccacgttaggtactcccgagccgtaggttcaggttcgcgtagggtgggtcctacggacaggtacgttcgactactacaacctatacgagcgtacggccgtgggagtacgtaggaactacgttctgtacttagttttaacttacgtagttcaagtntaagtattaacgttagtcggtacgtggtaacgttcggaacgaacgggtaacgtaagggtacggaaactaacgaaacggtaacgtggacgtcacggactactacgttcttatcttcgtcttacccg

SEQ ID NO: 46790 - DNA, 555 bp, Homo sapiens
  misc_feature: GYAE6OF01DTZVF.3.12.B01.1.454.CMB.1.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagcccaccctgtctgtgtctccgaggggaaangccaccctctcctgcagggccagtcagagtgttagtagctaacttagcctggtaccagctatattctggccaggctccaggctcctcatctatggtncacgtcccgacccgggccacgtggtactcccagccgtaggttcaggtcggcaggttgggtctcggacaggtacgttccacttctacacctatcacgcacgtccgtgggagtcgtagaagactcgtgtacttagtttatctgtcagctaagttataattacgtggtccgtggtaccgttcggaccgagggacctaagggtagaaactacgaaacgtacgttggtaggcctacgcacctatacttgttctctattccccg

SEQ ID NO: 46791 - DNA, 805 bp, Homo sapiens
  misc_feature: GYAE6OF01D5PEP.3.12.B01.1.454.CMB.1.raw
  modified_base (152)..(152): a, c, t, g, unknown or other
  misc_feature (152)..(152): n is a, c, g, or t
  modified_base (206)..(206): a, c, t, g, unknown or other
  misc_feature (206)..(206): n is a, c, g, or t
  modified_base (350)..(350): a, c, t, g, unknown or other
  misc_feature (350)..(350): n is a, c, g, or t
tcagagacgcactccacgaccggtgctcgatttagtagtgtagattccgcggggggaactgctcagttaggacccagacggaaccatggaagccccagcgcagcttctcttcctcctgctactctggcctcccagatatcactggagaaacngtgctgacgcagtcctccagcccacctgtctgtcgtctaccgaagggggaaacncgccctaccctctcctggccgagggaccctagtcgagtagttggttaagtagcctaaacgttacggccccttagggtaaccaggtactaagttacgttttcgttcggacccgtaggtcccttacccgaagggtcccttaccctntaactttccgtaagttcgggtcgcctaaccgttccccggaaccccgggtcctaaccgtttcgggttaacctcccccgaacggtcccgtaaggtttccgaacgggttcggcggttaacggggtcgggttaccgttaccggaacgtaggtaccgtttccgaaacctcccgttaccaacgtatacccgaaggtccgacggttcccggtaggtcgtacgttagaaacgtccgttacgtcggtaaccgttttagttttacgttaaacccgttggttaacctaacggtaactttaaagttaaactttaaccggttacggttaccgggtacggtttacccggtaacgttacccgggacggaaacgggttaacgaacgggttaagaaactaacggaaacggtagttcggtacggactaccaaccgttaactcgttacgttacttcttaccgtcgtttaccccg

SEQ ID NO: 46792 - DNA, 531 bp, Homo sapiens
  misc_feature: GYAE6OF01D6TGZ.3.12.B01.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (356)..(356): a, c, t, g, unknown or other
  misc_feature (356)..(356): n is a, c, g, or t
  modified_base (397)..(397): a, c, t, g, unknown or other
  misc_feature (397)..(397): n is a, c, g, or t
  modified_base (436)..(436): a, c, t, g, unknown or other
  misc_feature (436)..(436): n is a, c, g, or t
  modified_base (523)..(523): a, c, t, g, unknown or other
  misc_feature (523)..(523): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaangccaccctntcctgcagggccagtcagagtgttagtagctaacttagcctgggtaccagcatattcttggccaggctcccaggcctcctcatctatggtcgcatcccaccgggcacgtggtactccagccaggttcagtgcagtggtctcggacagnttcactctcacatcagcagccgtaggagtctaggaacactntgtactagtttactacgtgtcagtcagttataacttcgnggtcgttggtacgttcggacgagggaccaagggtacgaaacgtacgaaacggtactggtcggtctcgacacctgtactagttccttncgttcccg

SEQ ID NO: 46793 - DNA, 733 bp, Homo sapiens
  misc_feature: GYAE6OF01CIGPV.3.12.B01.1.454.CMB.1.raw
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggaagaaacagtgctgacgcagtctccagcccaccctgtctgtgtctccgaagggggaaaanacgccaccctctcctgcngggccagtcagagtgttagtagactaacttagcctggtaaccagcaattattcgttacggccacggcctcccgtaggccttcctacacttctagtggtcgcacctcccgacccgggacctacgtacggtaccaccctagccgtaaggttcaggtcggcctagggttcggggcctcggacgtaggtacgtttaccgacttaccaccacccattaccgacgtccgaacggtccgtacgggtagttccgtaacggtaaactacctcgtacggtacgttaacggttttaacttacgtcggttacaacgtacgtaaaggtttaactttaacgtttaccggtacgggttacccggttaggggttaacccgggttcccggaaaccgggtaaaccgggtaaccggtaaacggggttaaaggaaaaccttaaccgggtaaaaacgtacgggtagggtacggttaccacgggtaaccctaacgtaattcccggttacgtttaccttctaaccgtttccccg

SEQ ID NO: 46794 - DNA, 820 bp, Homo sapiens
  misc_feature: GYAE6OF01AQ0AT.3.12.B01.1.454.CMB.1.raw
tcagagacgcactccacgaccggtgctcgatttagtagtgtagattccgcggggggaactgctcagttaggacccagacggaaccatggaagccccagcgcagcttctcttcctcctgctactctggcctcccagatatcactggaagaaacagtgctgacgcagtctccacgccaccctgtctgtgtctaccgaaggggaaagacgccaccctctcctgcgacgggccagtcgagtagtgttagtacgactaacgttacgtccgtaggtaccagactattacgtttcgttcggcccgtacggccgtccccgaggtcccttcctacgtacttcgttagttggtcgacctaccgtacccgaccccgggcctacggttcggtacctaccccgacggtccgtacggttcgacgggtcggacggtacgggttcggggtacgtaccgggaacgtaacggtaccgtttaccgtaccgttccttaacccgaacctacgttaccgaacggtccgaaccggttcccgtaggggtacgttacgtacggtaaacgtaccgttacgttacggtactttaacgttttacgttaccgtacgtaccgtaagtacgttaacgtttaaacgtaacgtttaaccggttccggggtacccggttacggggttaacccggtttaccgggaaacccgggtaaccggggaaaccggttaaacggggtaaacgttaaaccggtaaaccggtaaaacggtaccggttacggtaccgggtacgtaccgtaacccgtaacgttaccgttacggttacttaccctttacccgtacccgtttaccccg

SEQ ID NO: 46795 - DNA, 672 bp, Homo sapiens
  misc_feature: GYAE6OF01D5DX7.3.12.B01.1.454.CMB.1.raw
  modified_base (200)..(200): a, c, t, g, unknown or other
  misc_feature (200)..(200): n is a, c, g, or t
  modified_base (320)..(320): a, c, t, g, unknown or other
  misc_feature (320)..(320): n is a, c, g, or t
tcagagacgcactccacgaccggtgctcgatttagtagtgtagattccggcgggggggaactgctcagttaggacccagacggaaccatggaagccccagcgcagcttctcttcctcctgctactctggctcccagatatcactggagaaacagtgctgacgcagtctccagccaccctgtctgtgtctcgaggggaaancgccaccctctcctgcgagggccagtcaggtagttgttagtagactaacgttagccgtaggtaccagctaattatttcgtggccacggtcctcccgaggtcctcctctatctagtggtcncactcccgacccggcacgttggacctcccgagaccgtaggttcaggtcggacgtagggttcgggtaccgtacggagtagtacgttacgaccttctaccgaaccctagtccgaagacgtacggtccgttaggggtacgttacgtaggtaaacgtccttacgtacgtacgtttaagtttttactacgttcgttcgtagtacgtagttacgttcggtttaccttcgtacgtttcgtttaggtacgttaacggttccgggaccgggtaccgggaacgttagggtacggtaaacgtcgtaaacgtaaacgtcggtacgggtacgtacgtccggactaaccgtcgttcgtcgttaccc

SEQ ID NO: 46796 - DNA, 602 bp, Homo sapiens
  misc_feature: GYAE6OF01B9NHO.3.12.B01.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagcccaccctctcctgcagggccagtcagagtgttagtagacaacttagcctggtaccagctatattctggccaggcctccaggctcctcatctatggtncactccgacccgggcacgtggtactcccagcctaggttccaggtggacaggtgggtcctcgggacaggtagttccactcctacaccatcagcagccgtggacgttcgagaacgtctctcgacttagttttactacgtgtacgagtctaagttataacgttacggtcggtaccggttagggtaccggtttccgggaaccgtaacggggaacccgtaagggtacggaaactaccgaaaaggtccgtagggtacggctacggaccctaaccgtacttaccgttacgtttacttccgtcgtttccccg

SEQ ID NO: 46797 - DNA, 828 bp, Homo sapiens
  misc_feature: GYAE6OF01BTVN9.3.12.B01.1.454.CMB.1.raw
  modified_base (199)..(199): a, c, t, g, unknown or other
  misc_feature (199)..(199): n is a, c, g, or t
  modified_base (795)..(795): a, c, t, g, unknown or other
  misc_feature (795)..(795): n is a, c, g, or t
tcagagacgcactccacgaccggtgctcgatttagtagtgtagattccggcggggggaactgctcagttaggacccagacggaaccatggaagccccagcgcagcttctcttcctcctgctactctggcctccagatatcactggagaaacagtgctgacgcagtcctccagccacctgtctgtgtctcgaggggaaancgccacctctcctgcagggccagtcagtagtgttagacgactaacgttacgccgtaggtaaccaggacctaattaacgttttccgttagggacccgtaagggtcccttccccggaacgggttcccttaccccttcaagttttaccgttaagttcggggttacaccgtaaccgttcccccggaaccccggggtcctaacgttacgggtaaccctaccccgaacggtaccccgtaagggtttccaaaggggttcgggacgtaacggggttcgggggttaccctacgggaacgtaacggtacggtttccaaccgttcgtaccctaacctagttacccgaagtcccgtacgggtacccgtgggtaacgttcgtaacggaaacgtaccttcggtagtaccgtttaagtttttactaacgtcgtaccgtaacgtacttaagttaacgttaaacgtttaccggtacgggtacccggtttacggtacccgggtttacgggaacccggtaaacggggtaacccgttaaaaggggtaacgtaaaacgttaaacccgggtaaaaacggtacgttcgggtacggtaccgtaccaccgtaaacccgttntaccgttatttaccttccgtaaccgtttccccg

SEQ ID NO: 46798 - DNA, 746 bp, Homo sapiens
  misc_feature: GYAE6OF01AGH89.3.12.B01.1.454.CMB.1.raw
  modified_base (198)..(198): a, c, t, g, unknown or other
  misc_feature (198)..(198): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccacctgtctgtgtctccgaggggaaangccaccctctcctgcagggccagtcagtagtgttagtagctaacttacgcctggtaccagcattacttcttggccaggcctcccgaggtctcctcactcgtagtgtcgccacgtccccgacccgggcctacgtcggtacctcccgagccgtaggtccgaggtcggacgtaggttcgggtccgtacgggaacagtacgttaccaccttccgtacctaacctagttaccgaaggtcctaacggtcccggttagggacgttacgtacggaaacgtacttcgttacggtactttaagtttttaacgttaccttggttaccgaagtaccgttaaagtttaactttaaaccggtttaccggtaccggggttacccgggttaagggttaccccgggtttaccgggaacccgggtaaacggggtaacccggtaaagggtaccgggtaaaaacgttaaccggaaaaaccgggtacgttagggtacggtccgtaaccggtaacccgtaacgttaccgtttaccgtacggttttaccttaccgttaccctttacccccg

SEQ ID NO: 46799 - DNA, 586 bp, Homo sapiens
  misc_feature: GYAE6OF01C4Y9Q.3.12.B01.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
  modified_base (577)..(577): a, c, t, g, unknown or other
  misc_feature (577)..(577): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaangccaccctctcctgcagggccagtcagagtgttagtagctaactttagccttaggtaccagcattattcttggccaggcctcccaggtctcctcattctatggtncactcccgacccgggtcactggtactcccgagccgtaggttcaggtggcgtaggttcgggtctacgggactaggacgtttccactttctaccaccatccagcacgcctgggaactcgtagaacgtcttcgtgtacttaagttttattacgtgttcagtactaagttattaagttactgggtccgtggtaccgttcggacgtacgggaactaagggtagaaactacgaaaccgtagtggtcggctacggacaccgtattcgttagttccttacncgttccccg

SEQ ID NO: 46800 - DNA, 752 bp, Homo sapiens
  misc_feature: GYAE6OF01E0ZUG.3.12.B01.1.454.CMB.1.raw
  modified_base (204)..(204): a, c, t, g, unknown or other
  misc_feature (204)..(204): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccttgtctgtcgtctaccgaaggggaaacncgccaccctctcctgcagggccagtcagtagtgttagacgctaacttgcctggtaccagctattagttcgttaggcctaggcctcccgaggtcctccgtacagtcgtagtggtcgcacgtcccgacccggctacgttcggtactcccgagccgtaggttcaggtcgacgtagggtcgggtacgtacggaactacgggtacttccaaccgttcctaccgaaccgtacgttacgaacggtccgtaacggtacccgttaggggtacgttaccgttaacggaaaccgtaccgtttacgtacggtaccgtttaacggtttttaacgttaccgtttacggtacgtaacgtacgttaacgtttaacttaacgtttaccggtcgggttacccggttagggtaacccggtttacgggaacccgggtaaacgggtaaccggttaaaggggtaaccggtaaaacgtaaccggtaaacggttaacgttggggtacggtaccgtacggacccgttaaccgtagtttcccggttagtttacccttaacgtccgttacccccg

SEQ ID NO: 46801 - DNA, 851 bp, Homo sapiens
  misc_feature: GYAE6OF01CWN9X.3.12.B01.1.454.CMB.1.raw
  modified_base (223)..(223): a, c, t, g, unknown or other
  misc_feature (223)..(223): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcacgtggagaaacagtgctgacgcagtcctccagcccaccctgtctgtcgtctaccgaaggggaaagacgccctaccctcgtccngccgagggcctagtcaagagttagttagtagactaaccgttagccgttaggtaacctagacctaatttacgttccgttacggacccgaacgggtcccttaccccgagggtccccttccctactacgttaccttaggtcggtacgacctaacgttcccccgaaccccggggtacctaccggttacggtaaccctaccccgtaacggtccggtaacgggttaccgagggttcggaccgtaaggggttccggggtccgtaacgggaccgtaagggttacgttaaccctcgttacccgtaccctaaaccgtacgtaccgtaccggaacccgtacgggtacccgtttacggggaaccgtttacgtaaccggtaaaccggtacccgttcggttttaacggaacgttttaacggttttaacgttaaccgtacgttaacgtacgtaacgtaacgtttaaattaaccgtttcgggtacgggtaacccgttacggggtaccggttaccggtaaaccggaacggtaaaccgggtaacggtaaacggtaaacccgtaacggtaaaacggtaccggttacgacggtccgaccgtacctaaccgtcgttacttccggttactttaccgtccgttaacccccg

SEQ ID NO: 46802 - DNA, 674 bp, Homo sapiens
  misc_feature: GYAE6OF01AII5Z.3.12.B01.1.454.CMB.1.raw
  modified_base (148)..(148): a, c, t, g, unknown or other
  misc_feature (148)..(148): n is a, c, g, or t
  modified_base (205)..(205): a, c, t, g, unknown or other
  misc_feature (205)..(205): n is a, c, g, or t
  modified_base (360)..(360): a, c, t, g, unknown or other
  misc_feature (360)..(360): n is a, c, g, or t
tcagagacgcactccacgaccggtgctcgatttagtagtgtagattccggcggggggaactgctcagttaggacccagacggaaccatggaacgccccagcgcagcttctcttcctcctgctactctggctcccagatatcactgganaaacagtgctgacgcagtcctccagcccacctgtctgtgtctaccgaaggggaaacncgcccaccctctccgtgcgagggccagtcagtagtgttagagctaacgttcgccgtaggtaccagtcattacttccgttcggaccacggtcctaccccgaggtccctacctcgacttcgtagttgcgccacgtcccgaccggctacgtggtaccncacgtccaggttcaggtcgcgtagggtcggtcctacggactaggtacttcaccttcgtaaccactacgtccgaacgccgtaacgccgtagggtccttacgtaagaaccgtcttcgttataccgtttaagtttactacgtagtaccgaattaccgtaagtttaaacgttcgtttaacgggcggtccggtacggtaccggttacgggaaccgtaacgggaaccgtaaagggtacgaaaacctaccgaaaacgttaggcggtacgtccgttacgaccctacgttacgttcgttacctccgttacctcccgttacccg

SEQ ID NO: 46803 - DNA, 752 bp, Homo sapiens
  misc_feature: GYAE6OF01CF3JF.3.12.B01.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (460)..(460): a, c, t, g, unknown or other
  misc_feature (460)..(460): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtcctccagcccaccctgtctgtgtctccgaggggaaanacgccaccctctcctgcagggccagtcagngtgttagagcaacttagccgtggtaccagcattattctggccaggcctcccgagggccttcccctagtacttactagggtcgtcgacgttaccccgacccccgggtacccggtacctacggttaccggtacccctaaccgacgtaccgggttacggttagcgggtaccggagttacggggttcggtccggaacgtaggacggttacctactacctccgtaccaccttanacgacgacgtccgtcggtaggttactcggtaacgtacctcgttcgtacgttgttttaacgtttacttcgtacgtacgtctaacgttaagttaatttacggttacggtccgggttacgggtaccggttacccggttaacggaaccgggttaaaccgggaacgggttaacgggtaaaacgtaaccggtaaaccgtaaacgggttaccggttacgggtacgttaacgacccctaacgtaaccgtttaccgttcgtttaccggtttccttaacccgttcccggtttaaccccccgg

SEQ ID NO: 46804 - DNA, 699 bp, Homo sapiens
  misc_feature: GYAE6OF01BPHY9.3.12.B01.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
  modified_base (430)..(430): a, c, t, g, unknown or other
  misc_feature (430)..(430): n is a, c, g, or t
tcagagacgcactccacgaccggtgctcgatttagtagtgtagattccgcggggggaactgctcagttaggacccagacggaaccatggaagccccagcgcagcttctcttcctcctgctactctgctcccagatatcactggagaaacagtgctgacgcagtctccagccacctgtctgtgtctccgaggggaancgcctaccctctcctgcgacgggccagtcgagtgttagttagtagactaacttgcctaggtaccagcctattattcgtcggccaggtcctcccgaggcctcctanacgtctagtggtacgccactcccgacccggctacgtggtaccncccgacgtccgtaggttccaggtcggacgtagggtcgggtccgtacgggaacgtacggttacgttcctaaccgtctaccgtaaccncgttacgacgtaccgacgtccggtaggtacgtcgtaggaactcgtcgtacgtacgtttaacgtttacttacggtagttaccgaaggttacttaaacgttaacgtttaaacgtttaccgggttacgggtaccggttacgggtaacccgtttacgggaaccgtaaaggggtaacccggttaaagggtaacgtaaacggtaaaccgtaacggtaacgtggtaacggtctaccgacttacgtacgttcttacggtacttccgtacgttccccg

SEQ ID NO: 46805 - DNA, 755 bp, Homo sapiens
  misc_feature: GYAE6OF01DYVY3.3.12.B01.1.454.CMB.1.raw
  modified_base (150)..(150): a, c, t, g, unknown or other
  misc_feature (150)..(150): n is a, c, g, or t
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctccagatatcactggagaaacngtgctgacgcagtctccagccaccctgtctgtgtctcgaaggggaaancgtccacctctcctgcaggccagtcagagttgttagtagcaaactttagctggtaaccngactattattcgttcggaccaggctcccgaggcctccgtctatcgtagtggttcactatccccggaacccgggcctaacgttcgggttaacctcccccgaaaggtccctaagggttttccgaaggttcgggcgtaaggggttcggggtccgtaacggacgaggtacgtttacaccttcgaccactactcaagcgtacgccgtagggtagttccgttaaaggaactaccttcggtcggttaacttaaacggttttttacttaaaccggtcgttacgtaacggtacttaaacggtttaaacgtttaaactttaccgggttacgggtacccgggttttacggggttaaacccgggttttcccgggaaaccgggaaaacccgggggttacgtaaaaaccggggtagtaaaaaccgtaacgtaaaaaccgggtacttacggggtacggtctaaccggaccaccgtttaaagtcccttttaggacccttttgacctttaccccg

SEQ ID NO: 46806 - DNA, 931 bp, Homo sapiens
  misc_feature: GYAE6OF01DFA97.3.12.B01.1.454.CMB.1.raw
  modified_base (151)..(151): a, c, t, g, unknown or other
  misc_feature (151)..(151): n is a, c, g, or t
  modified_base (248)..(248): a, c, t, g, unknown or other
  misc_feature (248)..(248): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggaagaaacngtgctgacgcagtcctccgagccaccctgtcgtgtcgtctccgaaggggaaagacgcccacctctcctgcacgggccagtcgagtagttgttagtanctaactacgccgtacggtaccagtcaattcttaccgttcggccctacgggtcccttacccgacggtccctcctacctagtttacgttaaggttcgggtaccgcctaaccgtacccccggaccccgggtcctacggttaccgggtaccttaccccggacgtccgtaacggtttacgacgggtcggtaccgtaggggtcgggtaccgtacgggactaggtaccgttcaccgtcctacgaacctagtaccgagacccgtacggtaccgttcgggtacgttaccgaaggttaaacccgtactttacggtacgtttacgtttaaacgtttttaccgttaaccgttaggtaacccgttagggtaaaccgtttaaggtttaaaacgttttaccgttaacccgggtttacggggggttaccccggtttagggggttaaacccccgggtttaaccggggtaaaacccggggtaaacgggggttaaaaccccgggttaaaaaagggggttaacggtaaaaaaaaacccccgtttcccgggttaaaaaaaacccgggttaccgggggtttaacccggggtacgggttaacccccgttaaaccggggaaaccccctttcccggttaaaacgggtttttccccgttaacgttttcccccgttttaaaaccgtccccgggtttttaccccccccccg

SEQ ID NO: 46807 - DNA, 603 bp, Homo sapiens
  misc_feature: GYAE6OF01ADUI4.3.12.B01.1.454.CMB.1.raw
  modified_base (242)..(242): a, c, t, g, unknown or other
  misc_feature (242)..(242): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggaagaaacagtgctgacgcagtctccagccaccctgtctgtgtctcgaaggggaaacgcgcccaccctctcctgccgagggccagtcagagtgtaganctaacgttagcctggtaccagcattacttcgttggccaggcctcccgaggtcctcctcatctagtggtcncnctcccggacccggcctacgtcggtacctcccagtccgtaggttcgaggtcggacgtaggtcgggtccgtcggactaggtacgttcacttcaccactactcgacgtcacgtcgtggcgtcgtagaacgtcttcgtgtacttagtttactcgtcgtactagtctaagttaattacgttacggtcggtaccggtacgggtaccgttaccgggaccgtaacgggtacgaaggtacgaacgtaacgaaacgtcgtggtacggctagacctactactctagtctcgtcgtccccg

SEQ ID NO: 46808 - DNA, 819 bp, Homo sapiens
  misc_feature: GYAE6OF01DTRZI.3.12.B01.1.454.CMB.1.raw
  modified_base (155)..(155): a, c, t, g, unknown or other
  misc_feature (155)..(155): n is a, c, g, or t
  modified_base (215)..(215): a, c, t, g, unknown or other
  misc_feature (215)..(215): n is a, c, g, or t
  modified_base (432)..(432): a, c, t, g, unknown or other
  misc_feature (432)..(432): n is a, c, g, or t
tcagagacgcactccacgaccggtgctcgatttagtagtgtagattccggcgggggggaactgctcagttaggacccagacggaaccatggaagccccagcgcagtcttctcttcctcctgctactctggctccagatatcactggaagaaaacngtgctggacgcagtcctccacgccctacccgtgtctgtcgtcgtaccggaaggggaaacncgcccctaccctctccgtcgcggacgggcctagtcgaaggtagttagttagacgacctaaacgttacggcctaggtaaccgatactaagtttaccgttcggttacgggacccgtaacggcccgttacccgacggttccctaccgttataacttaccggttggtacggtaccgacctaacccggtccccggaacccgtaccgtaacgttcggtacccnccgtaacgtccgtacggttcgaacggtcggtaccggtacgggtaccgggttcgaaccggtaagtaacgttcgttacccgacttcccaaacgtaccctagtacccgaggaccgtacggtaccgggttcggaaccggtttacaaacgggtaaccttcgtacgttacgttaaccgttttaagttttaacccgtcggtacttaacgtaggttaaccttaagtaacttaacggttacgtcccgggtaccggttaccggtacgggtaccggaacggacgggtaacggtaaggtaacgaacgttaaaaccgaacgttcgggtgaccgtaggttaccaaaccccgttacgtaccggtttaccgtttacttacccgtaccttttccggtacccccg

SEQ ID NO: 46809 - DNA, 701 bp, Homo sapiens
  misc_feature: GYAE6OF01CQ4MD.3.12.B01.1.454.CMB.1.raw
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
  modified_base (302)..(302): a, c, t, g, unknown or other
  misc_feature (302)..(302): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggaagaaacaggtgctgacgcagtcctccagcccaccctgtctgtgtctccgaaggggaaancgcccaccctctcctgcgacgggccagtcaggngtgttagagactaacttacgcctacggtaccagctattacttcgttcggcctacggcctacccgnggtccctcctctattactagtggtcacacgtccccgacccgggctacgtcggtacctcccgagccgtaggtcgaggtcggcgtaggttcggggtccgtacggacgtaacgtccgtttacaccgttccgtccaaccgactaccgtacgaccgtacggtcccgtaggggtaacgtcgtaacggaaacgtccttacgtcgtacgttagttttaactcgtagtacgtacgtacgttaagttaacgttaaacgttcggtacggtaccgggtagggttaccggttaccgggaacggtaacgggaaccgtaaagggtacgtaaacggtaaccgtaaacggtacggtagggtccgacgttaccgaccgtaccgtacgttcttacggtctttaccgtccgttaccccg

SEQ ID NO: 46810 - DNA, 735 bp, Homo sapiens
  misc_feature: GYAE6OF01CE2YV.3.12.B01.1.454.CMB.1.raw
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaagagccaccctctcctgcgagggccagtcagagtgttagtagctaacgttagcctggtaccagcaattattcgttggccaggcctcccgaggcctcctcatctatggtgcacgtcccgacccgggctacgtggtacctcccgagtccgtaggttccaggtcggacgaggggttcggggtccgtaccgggaacgtacggtacgtttaccgaccttcgtaccaacccctattccgaacgcctaacggtcccgtagggtacgtacgttaggaaacgtaccttccgtaggtacgtttaagtttttacttaaccgttgtaccgtaaggtacttaaacgtttaacgttaagtttaccggttaccggggtacccgggttacggggttaacccggtttacccggggaaccggtaaacggggtaacccggtaaaggggttaacggaaaaaccgttaaccgaaaaaccgggtacggttagggtacgggcgttaccggacccgttaaacctgttacccgttgttaccttccgttacccgtttacccccg

SEQ ID NO: 46811 - DNA, 722 bp, Homo sapiens
  misc_feature: GYAE6OF01D9FRS.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagcccaccctgtctgtgtctccgaggggaancgcccaccctctcctgcagggccagtcagagttgttagtagactaacttagccttggtaccagctaattactttcgttggcccaggtcctacccgaggtcctcctctattcctagtcggtcgcacgtcccgacccgggcctacgtcggtactccccgagtccgtaggttcaggttcggacgtagggtcgggtacctacgggaactaggtacgtttccaccgtctaccgacctagttccgaagtcccgaacggtcccgttagggacgttaccgtaaggaaacgtaccttcgtacgtaccgtttaagttttaacgttaccgtgttaccgaaggttaccttaaaggtttaactttaacgtttacgttacgggtacccggtttagggttaccggtttacgggtaaccggtaaacggggtaaccgtaaagggttaacggaaaacgttaacgaaaaccggtacggttacgggtacgacgttacggaccctaaccgtattccgtttacgttccttcgtacgtttcccccg

SEQ ID NO: 46812 - DNA, 776 bp, Homo sapiens
  misc_feature: GYAE6OF01CGR1I.3.12.B01.1.454.CMB.1.raw
  modified_base (155)..(155): a, c, t, g, unknown or other
  misc_feature (155)..(155): n is a, c, g, or t
  modified_base (222)..(222): a, c, t, g, unknown or other
  misc_feature (222)..(222): n is a, c, g, or t
tcagagacgcactccacgaccggtgctcgatttagtagtgtagattccggcgggggggaactgctcagttaggacccagacggaaccatggaagccccagcgcagcttctcttcctcctgctactctggcctccagatatcacgtggaagaaacngtcgctgacgcagtcctccacgcccaccgtgtctgtcgtcgtacggaagggaacacgccacctctcngcgacggcagtcagtagtgttaagtacgactaacgtacgtccgttaggaaccagtactacgttacgttcgtacggaccgtacggtcctaccgaccggtcctcctactacgttacgtacggtcggtcgaccaccgtccccggaccggtcctacgtacgttacccgaccgacgtacgtacggtcgtacggtcggtacgtaggggtcgggtccgtacggtaacgtacgtaaccgttaccgacttcccgaacctacgtacgtaccgaacgtaccgtacgtcggtacggtacgttcgaaacgtacgtacttcgtaaggtactttaacggtttatacgtacgtacgcggtaattaacgttaaactttcggacgggtttaccgggtacggttaccgggtaaccggttacggaaacccgggtaaagggtaaccggtaaaagggttaacccaaaaacggttaaccggtaaaacggttccggtagggtaacccgggtcttaacccggaacgttaaccgtttcgttacccgtttacgttcccttaaccgttaaccccgggtcccc

SEQ ID NO: 46813 - DNA, 667 bp, Homo sapiens
  misc_feature: GYAE6OF01EHLP2.3.12.B01.1.454.CMB.1.raw
  modified_base (414)..(414): a, c, t, g, unknown or other
  misc_feature (414)..(414): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagcccacctgtctgtgtctccgaggggaaagcgcccacctctcctgcgagggccagtcagtagtgttagtagcaactttagccgtggtaccagcattattcgttggccaggcctcccgaggcctcctctatctagtggtgcacgtcccgacccgggcctactcggtactccccagtacccgtaggttacaggtcggctagggtcggggtacctcgggaacacggtacgttccacgtcctacactancgagacacgctgggatcgtagaacgctntacgcttagttttactacgtcgtanacgtacgtagttaacttaagttaccgtacgggtccgtaaggggttacccgttaccgggaccggtaaacggggaacctaaagggggtacgtaaaaccgtaaccggtaaaaacggtaccgttagggtaccgggtacgtacccgaacccgtacccgttaacgttccgtttaccggttacctttaccgtacccggttacccccg

SEQ ID NO: 46814 - DNA, 868 bp, Homo sapiens
  misc_feature: GYAE6OF01CC7FV.3.12.B01.1.454.CMB.1.raw
  modified_base (155)..(155): a, c, t, g, unknown or other
  misc_feature (155)..(155): n is a, c, g, or t
  modified_base (214)..(214): a, c, t, g, unknown or other
  misc_feature (214)..(214): n is a, c, g, or t
  modified_base (456)..(456): a, c, t, g, unknown or other
  misc_feature (456)..(456): n is a, c, g, or t
tcagagacgcactccacgaccggtgctcgatttagtagtgtagattccggcgggggggaactgctcagttaggacccagacggaaccatggaagccccagcgcagcttctcttcctcctgctactctggctcccagatatcacgtggaagaaacnggttgctgacgctagtcctccacgcccaccctgtcgtgtcgtcctacggaaggggaaancgccctaccctctccgtgacgacgggccagtcgaaggtagttagtaagtagaacctaagttacggccgtacgggacctagactaactttgtttcgttacggaccgtaacgggtcctacccgtaggtccccttacccgtactacttacgtaggttcgggacgaccgttaccggacccccggtacccggtaccaccggtttcggaacctcccgtaacggtccgtacgggttaccgagggttcgnggtaacgggttcggggttaccgtacggaacctaagggtacctttacgtacccgtactaaccgaaccttagaccgacgtacgtacggtaccggttacgggtaacttacggtaaacggaaccgtaccgtttacggtactttaaccgtttaacgttttaacgttttaccggacgtttaacgaacgttaacggtttaaaacgtttaactttaaacggggtttccgggttaaccgggtacccggggttaagggttaccccgggttacgggaaacccgggtaaacggggtaaaccggttaaaagggtaaaccgttaaaacgtaaaccggtaaaccggtagggttaccggtaaggtcccgtaacgacccgtaccgttaacgtttcctttaccggttaccttaccgtcggtttacccccg

SEQ ID NO: 46815 - DNA, 652 bp, Homo sapiens
  misc_feature: GYAE6OF01C2ZSY.3.12.B01.1.454.CMB.1.raw
  modified_base (210)..(210): a, c, t, g, unknown or other
  misc_feature (210)..(210): n is a, c, g, or t
  modified_base (458)..(458): a, c, t, g, unknown or other
  misc_feature (458)..(458): n is a, c, g, or t
  modified_base (468)..(468): a, c, t, g, unknown or other
  misc_feature (468)..(468): n is a, c, g, or t
  modified_base (593)..(593): a, c, t, g, unknown or other
  misc_feature (593)..(593): n is a, c, g, or t
  modified_base (611)..(611): a, c, t, g, unknown or other
  misc_feature (611)..(611): n is a, c, g, or t
  modified_base (622)..(622): a, c, t, g, unknown or other
  misc_feature (622)..(622): n is a, c, g, or t
tcagagacgcactccacgaccggtgctcgatttagtagtgtagattccggcggggggaactgctcagttaggacccagacggaaccatggaagccccagcgcagcttctcttcctcctgctactctggcctcccagatatcacgtggaagaaacagtgctgacgcagtcctcgacgccctacctgtctgtcgtcgtaccggaagggaacncgcccacccgtctccgagcgacgggccagtcaggtagttagttagtaacgactaacgttcgaccgttacgacgagtactatttacgttccgttcgggaccgtacggtcccgtcccgagtcccttactaccattcgtagttcggcgacctacccgtacccggacccggtcctaaccgtcggtacctaccccgacgtacgtacggtgtggcggacggtgggtcggctacgggatgtacgtcctacgtccnctacgagtcngacgaccggtgtacgtgtacgtacgagtcgtacgtgtatttacgtactcgttatcgacgttatacgtaattacggccgtcgggtacgtcggtaaccgtacggaacgtaggaacgtacgggtaaanaaacgtacgaaaggtcgnggtcgacgacncggacttgttacgcttactctccgtacccg

SEQ ID NO: 46816 - DNA, 836 bp, Homo sapiens
  misc_feature: GYAE6OF01BI6F2.3.12.B01.1.454.CMB.1.raw
tcagagacgcactccacgaccggtgctcgatttagtagtgtagattccggcgggggggaactgctcagttaggacccagacggaaccatggaagcccagcgcagcttctcttcctctgctactctggctccagatatcacgtggaagaaacaggtcgcgtgaccgcacgtcctaccgacgaccctaccgttgttctcggttcgtccgtaccggaaggggaaacgacgccctacccgttcctccgtcgacgacgggcctagtccgaaggtacggttagtttaacggtacgaccgtaacgttacgtccgtacggtaccgagtactatttacgtttccgttccggacccgtacggtacccgtcccgacggtcccttcctactacgttcgttaggttcggtcgacccgtacccggtaccccggtacccgggtacctacggttaccggtaccgtaccccgtaacggtaccgttaacgggttccggacgggtacggacggtacgggttcgggtaccgttacgggaacgtaacggttaccgttacctacccgttacctaaccgtacctaacgtacgaccgtacggtaccgttccggtaggtaacggttcgtaacgaacggttctacggttacgttacttttaaggttaccgttacgttaggtacctaggttaacttaagtttaaacgtttacgtacggggttacgttacgggttaccgggttacggtacgggtaaccgggtaacgggaaccgttaagggaacgttaaaccgtaaacggtaacgtggttggacgtcgacgtacctaacgtacgttttaccagtttacccgtcttccggttaccg

SEQ ID NO: 46817 - DNA, 910 bp, Homo sapiens
  misc_feature: GYAE6OF01CE0F2.3.12.B01.1.454.CMB.1.raw
  modified_base (163)..(163): a, c, t, g, unknown or other
  misc_feature (163)..(163): n is a, c, g, or t
  modified_base (231)..(231): a, c, t, g, unknown or other
  misc_feature (231)..(231): n is a, c, g, or t
tcagagacgcactccacgaccggtgctcgatttagtagtgtagattccgcggggggtaactgctcagttaggacccagaccggaaccatggaagccccagccgcagcttctctttcctcctgcttacgtctcggcctcccgagatatcacgtggaagaaacgnggtgctgaccgcacgtcctaccacgtcccacccttgtctttggtcgttccgtaccggaaggggaaacnccgcccctacccgttcctccggtacggccggacgggacctaggtacgaggttaacggttcgtttaacggacgtaacccgttaacgttaccggtccgttaacggtaacctacgacgtaacgtttacgtttccggtacggcccgtaaccggtccctacccgtaccggtacccttccgtacctacgttccgtttacggtacggttcgtaccgtacccgtaccccggacccgggtacctacgtaccggttaccgaccgcgtaccgtaacggtcgtacgggtcggtacggttacgggtcgggttaccgtccggtaacgtacgttaccgttaccgtacttacccgtactaaccgtaccgtacggtaccgtaccggtaccgttaccggtacgggttaagttaccgttaacggttacgttaccgtacgttcgtttaacgttaacgttttacgtaacgttcgttaaccgtacgttaacgttaacgtttaacgttaccggttaacggggtcccgggttaccgggttaacccgggttaccgggtaacccggtaaccggggaaccggttaaaccggtaacgggtaaaccgtaccgtaaaaccgtacggttacgttaccggtacggttaacctcccgtaaaccttccgttaccttccggttaaaccttccgttaacgttaccccggttcccg

SEQ ID NO: 46818 - DNA, 742 bp, Homo sapiens
  misc_feature: GYAE6OF01EESLV.3.12.B01.1.454.CMB.1.raw
  modified_base (202)..(202): a, c, t, g, unknown or other
  misc_feature (202)..(202): n is a, c, g, or t
  modified_base (331)..(331): a, c, t, g, unknown or other
  misc_feature (331)..(331): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggaagaaacagtgctgacgcagtcctccacgcccaccctgtctgtgtctccgaagggaancgcccacctctcctgccgacgggccagtcgagagttgttagtacgactaacttacgccgttacggtaccagtctaagttacgtttcgttcggcctacggcctcccgagtcctcctctatctagtggtcncctaccgtcccgacccggccctacgttaccggtacctcccgacggtccgtacggttaccgagggtcggtacgtacgggttcgggtcctacgggactacggttacgttccaacccttcctaaccgtacctacgtaccgaacggtaccgaccggttaccggtagggtaacgttacgtaagtaaaccgtcttacgtgtaccgtttaagtttaactttccgtagtaccgaaggtacttaagttaacttacgttaacgtccgggtaccgggttacggtaccgggttaccggaaccggtaacggggtaaccgtaaacgggtaacggtaaacctaaaccggtaaaaccgtacggtacgggttacggacgtaccgaactaaccttctaccgttcctttaacttccgtaccgttcccccg

SEQ ID NO: 46819 - DNA, 805 bp, Homo sapiens
  misc_feature: GYAE6OF01EF6H8.3.12.B01.1.454.CMB.1.raw
  modified_base (191)..(191): a, c, t, g, unknown or other
  misc_feature (191)..(191): n is a, c, g, or t
  modified_base (252)..(252): a, c, t, g, unknown or other
  misc_feature (252)..(252): n is a, c, g, or t
tcagagacgcactccacgaccggtgctcgatttagtagtgtagattccgcggggggaactgctcagttaggacccagacggaaccatggaacgccccagcgcagcttctccttcctcctgctactcgtggccctccagtatactcagtggaaacgaacgtgtcgcgtacgacgcgacgttcctaccgaccnccctaccgttgttcgtcgtcgtaccgtacgggaagggaacgaccgcccctccgtcctccgngacggacggcctagtactaggtacgttagttaacgcgtacgtaacgttcgtaccgtacgaacagtctaagttcgttccgaccgaccgtaccgtcccgttccgacgtccctaccgtacgttccttagtacggtcggtcctaacccgtacccggtacccccggacccgtaccgtaccgttaccggtaaccctccccggtacgtaccgttacggttcgtaacgggtccggtaacggtcggggtaccgttacgaccggtacgtacggttactacctaccttcccgtaactacgtaactccggacgtccgtaccggtacgttaggtacgttacgaagtacgttcgtaacgttcgttacttttaacgttacgttccgtgtaacgtacgtttaataacgtttaactacggttccggccgggtttagggtaacccggtttacccggacggtaaacggtaacccggggtaagtaacgggaaacttaaaccgaaacggttacggtgtaccgtacggcgtaccgactaccttcgtttctacccgttactcccttcgtaccccgg

SEQ ID NO: 46820 - DNA, 836 bp, Homo sapiens
  misc_feature: GYAE6OF01BBH2X.3.12.B01.1.454.CMB.1.raw
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtcctccagccaccctgtctgtcgtctccgaggggaaacgacgccacccgtcctcctgcgacggggccagtcagtagttgttagtacgactaacttagccttaggtaccagacattacgttcgttcggccaggccttacccgaggtcctccctacactaccgtagtcggtacgcctaccgtcccggaaccccgggtccacggttacggtaccgtaccccgtacggacccgttacgggttaccgtaagggtcgggtaccgtaacggggtttcgggtacccgttaccgggaacgtaacgggtacggtttacccaacccgtttaccgtaccccgaaaccctacttaccggaacgcggtaacccgtacccggttaggggttaacccgggttaacccgtaaggttaacccggttacctttacggtacgttaacggttttaacgttttaaaccggttaccgttacgttacgtaacggttaactttaaaacggtttaagtttaaccggttaccggttacggggtacccggttacggggttaacccgggtacgaaacccgggggtaacggaaaggggtaacggtaaaacggtaaacgtaaaaccggtaacggtacggttaggtaggtacccgacgtaccttaaccgttcgttacttaccgttcgttacccgtccgttccccg

SEQ ID NO: 46821 - DNA, 757 bp, Homo sapiens
  misc_feature: GYAE6OF01BAPJ0.3.12.B01.1.454.CMB.1.raw
  modified_base (199)..(199): a, c, t, g, unknown or other
  misc_feature (199)..(199): n is a, c, g, or t
  modified_base (724)..(724): a, c, t, g, unknown or other
  misc_feature (724)..(724): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccctgtctgtgtctcgaggggaaanacgccaccctctctgcgacgggccagtcaggtagttagttagtacgactaacttacgccgtggtaccagctaattactttcgttacggaccgacggtccttacccgaggtccctttccgtacacgtttacgtaggttcgggttacgacctaaccggttaccccggaccccggggtaccttaacggttcgggtaacccttccccgacggttacccgtaaggtttccgaagggttcggacgttacggggttcgggttaccgacgggtaacgtacggttacgttacacttacctacgacctatacgacgtacgacgtccgaggtccgtacgtaaggaactctcggtactaccgtttagtttacctacggtacgacctaggttactaagtttaacgttaacgttcgtcgggttaccgggttacggtaccggttaccggaacgggtaaaccggtaacggtaaacggggtactaaaacgtaaacccggtaaacggttcggtaggtccggacgttaccgacgttaacccgtnttaccggttaccgtttctaccgttcgttccccg

SEQ ID NO: 46822 - DNA, 741 bp, Homo sapiens
  misc_feature: GYAE6OF01CFMLE.3.12.B01.1.454.CMB.1.raw
  modified_base (152)..(152): a, c, t, g, unknown or other
  misc_feature (152)..(152): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacngtgctgacgcagtctccagcccaccctgtctgtgtcctaccgaaggggaaagacgccctacctcctccgtgcgacgggccagtcgagagttggtaagtacgctaacttacgcctaggtaccagactaagttactttcgttcggacccgtaacgggtccctaccccggtaacggtcccttacccgttaccacgttacctttacggttacggggttccgaccgtaccgttacccccgaccccgggggtaccctacggttacgggtaccctacccgacggtaccgtacggttcgacgggtcggacgtacggggtgggtaccgtacgggaactaggttacggttcctaaccgtcgtacccaactactaccgaacgtcgacgtcccgtaggaacgttcgtaagacgttacctgtacgtacgttaatttaacgttcgttcgtactacggtattaaggtacttacgttaacttcgtacgtttcgtagttacgttacggttcgggccggacggtaacgtaggtacgggtactaacggttaaccgaaacggttcgtcgggtcgtaccgtagtccctagttacctggttacgttacccg

SEQ ID NO: 46823 - DNA, 800 bp, Homo sapiens
  misc_feature: GYAE6OF01BK8YS.3.12.B01.1.454.CMB.1.raw
  modified_base (155)..(155): a, c, t, g, unknown or other
  misc_feature (155)..(155): n is a, c, g, or t
  modified_base (208)..(208): a, c, t, g, unknown or other
  misc_feature (208)..(208): n is a, c, g, or t
  modified_base (639)..(639): a, c, t, g, unknown or other
  misc_feature (639)..(639): n is a, c, g, or t
  modified_base (770)..(770): a, c, t, g, unknown or other
  misc_feature (770)..(770): n is a, c, g, or t
tcagagacgcactccacgaccggtgctcgatttagtagtgtagattccggcggggggaactgcgtcagttaggacccagacggaaccatggaagccccagcgcagcttctcttcctcctgctactctggctcccagatatcactggaacgaaacngtgctaggacgcagtctccagccctaccctgtctgtgtctaccgaggggaacncgcccgacccttctcctgcgaggccagtcagtagtgttaagacgctaacgttcgccgtaggtaccagtcctaagttatttccgtggaccctaacgggtccctacccgaggtcccttccctacgtactttccgtagttcgggtactaccgtaaccggttcccccggacccgggttacctaaccggtttcgggtaaaccctccccccgtaacgggtaccccgtttaacgggtttcccgaaggggttacccgggtacggtaacgggtttcgggggttacccgaccggggtaaacgttacgggtaaccgtttcccgaccttcctaaccgaccctaagttccaacgtaccgacggttcccgtagggtacgttaccgtaacggaattcccttaggtacgttacgtttaacgtttttactccggtacgtagtaacgtntttaagttaacgttaacgttccgggacgggttaccgttagggttaccggttcggaaccgtaacggggtaactaagggttacaaaaccgtacgaaacggttcgtcggttacggactcccgtacgtaaccgtnttccccgtagttaccctagttcccctcccg

SEQ ID NO: 46824 - DNA, 821 bp, Homo sapiens
  misc_feature: GYAE6OF01DMYZI.3.12.B01.1.454.CMB.1.raw
  modified_base (94)..(94): a, c, t, g, unknown or other
  misc_feature (94)..(94): n is a, c, g, or t
tcagagacgcactccacgaccggtgctcgatttagtagtgtagattccggcgggggggaactgctcagttaggacccagacggaaccatggaanccccagcgcagtcttctcttcctcctgcctactctggcctcccagtatatcacgtggaagtaaacagtgcctgacgcagtcctccacgcccaccctgtctgtcgtctaccggaaggggaaacgacgaccctacccctcgttcccgtcgaccggacgggcccgacgttacgaaggttaggttaggtttaaggtaccgacttaaaccgttacggtacccgtacggtaaccagtacttaattacgtttcgttacggtaccgtaccggtccctacccgtacgtcctcctacgttaacttacgtagttcggctaccgccgtaccccggacccggtacctccgttaacgtaccctaacccggcgtaccgtaaggttaccgtacggtcggtaacggtacggggttcgggtaccgtacggtaacgttacggtccttaacccgtctaccgtaaccaccgtacgtctacggcctacgtcggttacggtagttaaccgacggtaacgttaccgttagtaccgttagttttaaacgtttaccgtttacgtcgtaacgtcgttaaggttaactttaagttaaccggttacgggtacccggttccgggttacgggaccgttacgggaacccggtaaacgggtaacggtaaacgggtaagaaaccgtaaacgaaccgggtaagttcgggactaggacccgtacttacgttacttcgttacttacttaccgccgtttaccccg

SEQ ID NO: 46825 - DNA, 719 bp, Homo sapiens
  misc_feature: GYAE6OF01DETXC.3.12.B01.1.454.CMB.1.raw
  modified_base (153)..(153): a, c, t, g, unknown or other
  misc_feature (153)..(153): n is a, c, g, or t
  modified_base (158)..(158): a, c, t, g, unknown or other
  misc_feature (158)..(158): n is a, c, g, or t
  modified_base (215)..(215): a, c, t, g, unknown or other
  misc_feature (215)..(215): n is a, c, g, or t
  modified_base (302)..(302): a, c, t, g, unknown or other
  misc_feature (302)..(302): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (401)..(401): a, c, t, g, unknown or other
  misc_feature (401)..(401): n is a, c, g, or t
  modified_base (450)..(450): a, c, t, g, unknown or other
  misc_feature (450)..(450): n is a, c, g, or t
  modified_base (468)..(468): a, c, t, g, unknown or other
  misc_feature (468)..(468): n is a, c, g, or t
  modified_base (664)..(664): a, c, t, g, unknown or other
  misc_feature (664)..(664): n is a, c, g, or t
tcagagacgcactccacgaccggtgctcgatttagtagtgtagattccgcggggggaactgctcagttaggacccagacggaaccatggaacgccccagcgcagcttctccttcctcctgctacctctggcctacccatatatcacgtggaanaaacngtcgctagaccgactgtcctcgactccccactgtctcgtgtaccacgggaggggaanccctaccctcctctaccgtggcgtaacggggccctggactaggttaaggttgtttagaaccgtataaccgtttgaccggtgtaaccncgtatcgttacttcggtacggccgtacgtccctcgacggttcctaccnctntacgtagtcggtnacctccgtaccccggccctcgtacgttaccgtccncccggtactccggtaacgtgtacgggtcgacggttagggtcggttaccnccgggatacgtcgtaccnctacacagtcacgacgtccacggctacggtactacgtataacctcggttctacgttacgttaacgtttacgtacgtttcacgttacgtaactagttaacgtaagttccgtcgggtccggttacgggacggttacggaacgtaacgggtaacgtacggtaaagtaccgtaaacccggtaggttactagggttacccngtccgttacgaacgttccggttactttaccggtaccctggttaacccctttcccg

SEQ ID NO: 46826 - DNA, 959 bp, Homo sapiens
  misc_feature: GYAE6OF01BGLXQ.3.12.B01.1.454.CMB.1.raw
  modified_base (144)..(144): a, c, t, g, unknown or other
  misc_feature (144)..(144): n is a, c, g, or t
  modified_base (149)..(149): a, c, t, g, unknown or other
  misc_feature (149)..(149): n is a, c, g, or t
  modified_base (166)..(166): a, c, t, g, unknown or other
  misc_feature (166)..(166): n is a, c, g, or t
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
tcagagacgcactccacgaccggtgctcgatttagtagtgtagattccgcggggggaactgatcagttaggacccagacggaacatggaacgcccagcgcagcttctcttcctctgctactctggctccagatatcactggaanaaacngtcgctgacgcagtccnccgacgccctacctgtcctgtcgtcctacggaaaggggaacacgccctacctcnccgtgcgaggcctagtcagtagttgtagacgactagtacgcgtaggacctanactattacgttcgtacggaccgacgtacctcccgacggtaccctcgtactacttcgtagttcggaccgtaccgtaccgtaccccggtacccggtacctaccggtaacgttacccgtaccgtaccggttacgtaccggtttacgtacggggtacgtccggttaacgggttcggaaccggtaccggtaaacgtacggttaacccggttacttaacccgtaccgtaacccgtaaccgttacgaaccggtaccgggtacccctaaggggtaccgtttaacgggtaaccgggttaaccgtaacggaaaccggtttacccgtttaaccggttaacggtttaacccgtttttaaacggttttaaccggtttaccggttaaaccgttaaccggttaaccggtttaaacgttaaacggttttaaaccggtttttaaccggttaacccgggttaccgggttaacccgggggtttaacccggggaaaccccgggttttaaccggggaaaccccgggtaaaaccggggttaacccgggtttaaaaagggtaaaccgggttaaacccggttaaaaaccgggtaaaccggttaccgggttacgggtaaccgggtttaacccgaccggttaaaccgttccgtttaacccgttacggttttacccggtttccctttaaacccggtttcccccttaaacccggg

SEQ ID NO: 46827 - DNA, 1024 bp, Homo sapiens
  misc_feature: GYAE6OF01AZPX5.3.12.B01.1.454.CMB.1.raw
  modified_base (160)..(160): a, c, t, g, unknown or other
  misc_feature (160)..(160): n is a, c, g, or t
  modified_base (252)..(252): a, c, t, g, unknown or other
  misc_feature (252)..(252): n is a, c, g, or t
tcagagacgcactccacgaccggtgctcgatttagtagtgtagattccggcggggggaactgctcagttacggacccagacggaaccatggaagccccagcgcagcttctccttcctcctgccttactcgtcggcctacccagatactcacgtgggaaanaaacgtaggtcgactaggaccgctacgttcctacccgacgcccctacccgttgttccgtaggttcgtacccgtacgggaaagggggaaaccnccgcccctacccttctcccgtggaccgacggggcctacggtacgaggttacggttagttaagtaccgtacctaaacgttcggtccgttaggtaccgacgtactaatttccgtttccgttacggaccgtaccggtacccttacccggacgttccccttaccgtacttaccttacgttacgggttcggttacccgacccgttaaccccggttaccccccgggtaacccccgggtaaccgttacccggtaaccggggttacccctaccccgggtaaccggttaccgggtttacgggttaccccggtaagggttccgggtaacccgggtttacgggggttccgggttaaccggtaccggtaacgttacgggtttaccctacccgttacctcccgtaaccgacctacggtacccggaagtacccgacgggttaccggtacggttaaccgttacggaacggttaaccgtacgtttcccggtaacggttttacgtttaacgttttaccgtacgtttcggtaaccgtaacggtttaccgtaaaggttttacctttaacgggtaaccgggtttcccggggttaaccggggtttaccgggtaaccgggttaccggggtaaacccgtaaacgggggtaccggtaaacggggttaaaagtaccccggttaaaacggtaaaccccgttagggttaccgggttaccggacccgtttaaccgaacccgttaaccggttcctttaaccggggttacctttaccccttaccgggtccccgtttacccgg

SEQ ID NO: 46828 - DNA, 701 bp, Homo sapiens
  misc_feature: GYAE6OF01DOVO4.3.12.B01.1.454.CMB.1.raw
  modified_base (162)..(162): a, c, t, g, unknown or other
  misc_feature (162)..(162): n is a, c, g, or t
  modified_base (510)..(510): a, c, t, g, unknown or other
  misc_feature (510)..(510): n is a, c, g, or t
  modified_base (520)..(520): a, c, t, g, unknown or other
  misc_feature (520)..(520): n is a, c, g, or t
  modified_base (538)..(538): a, c, t, g, unknown or other
  misc_feature (538)..(538): n is a, c, g, or t
  modified_base (545)..(545): a, c, t, g, unknown or other
  misc_feature (545)..(545): n is a, c, g, or t
tcagagacgcactccacgaccggtgctcgatttagtagtgtagattccggcgggggggaactgctcagttaggacccagacggaaccatggaacgccccagcgcagtcttctcttcctcctgctactcgtggcctacccagaatatccacgtggaataaacngtgctgacgcagtcctcacgccctacctgtctgtcgtccgtacggaaggggaacgaccgccctaccctccgtccgacgccggacgggacctagtacgaagtaggttagtacgtacgactacgttacgtcgttacggtacagtacttattccgttcgtccggtaccgacggtccctacccggacgtcccttctacgtacgttacgttgggtcggtacaccgtacccgtcccccggaccggtcgtacgttacggtaccctaccgacggtccggtgttacgagggtcgtacgggtcgggtacggtaccgtaggaactaggtccttactctaccgactacaagtccagtccncgctacggtntacgtcgtaatacgtttntacgttnttaactttgtactcgtatacgacttaattaacgtcgtacgggtccgttggtaccggcggttaaccgggtcgggaccggtaagacggttaacgagttaacgaaccggtacgtggtaggctacgtacgaactgttaccgtgttactccgtacctcccg

SEQ ID NO: 46829 - DNA, 732 bp, Homo sapiens
  misc_feature: GYAE6OF01AKMHU.3.12.B01.1.454.CMB.1.raw
  modified_base (108)..(108): a, c, t, g, unknown or other
  misc_feature (108)..(108): n is a, c, g, or t
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (720)..(720): a, c, t, g, unknown or other
  misc_feature (720)..(720): n is a, c, g, or t
tcagagacgcactccacgaccggtgctcgatttagtagtgtagattccgcggggggaactgctcagttaggacccagacggaaccatggaagccccagcgcagcttcncttcctcctgctactctggctcccagatatcactggacaaacngtgctgaccgcagtctaccagcccaccgtgtctgtcgtctcgagggaacncgcccacctntcngcgacggcagtcagtagttgttacgacgactaacgttacgccgttaggtaaccagactagttacttcgttcggccgacggtccttccccgaagggtcccttccctacgtaagttccgttacggtcgggttcacctaccgtccccggaacccgggtctaccggttcgtactcccggaccgtaccgttacggttacgtggtccggtacgtaggggttccggtacgtacccggtaacgaggttaccgttaccgtacccttccgtaacgacccgtactccggtaaccggtaccgtacccggtccggttaaggttaccggtaccgtaacggtaaaccgtccttaaccggttgtaacctttacggtttattaccggttagtcccgtaacgtagttaacgttaacgttaaccgttcggtacggtacggtacgggttaccgtacgaaccggtaaggacgtacgaccggtaaataccggaaacgtcggtgtacgcgtcacgctacgtctgtttcncgtaccttcccg

SEQ ID NO: 46830 - DNA, 675 bp, Homo sapiens
  misc_feature: GYAE6OF01A45Y3.3.12.B01.1.454.CMB.1.raw
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccacgcccaccctgtctgtgtctccgaggggaaagacgccaccctctcctgcgagggccagtcagagtgttagtagctaacttacgccgtaggtaccacgactaattactttccgttggcccacgggccctacccgacggtccttccctcacttctagtcggttcaccaccgtacccgacccgggtcctacgttcggtactccccgagtccgtaggttcgcggtacggtcgtaggtcgggtccgtacggacgtaggtcgttccactcctaccacctataccgacgcacggtcccgtagggacgtagttacggaaactcgttcgtacgtacgttaacgtttttacgtaccgttgtaccgtaaggttactaagggtttaaactacgttacgtcgggtaccgtaggttaccggtcggaccggaagggtaaccgtaagggacgtaaacaccggtaacgtcgttaggcggtacgtaccgactacgtacttctgttaccttcgtacccttacccg

SEQ ID NO: 46831 - DNA, 493 bp, Homo sapiens
  misc_feature: GYAE6OF02HR9S2.3.12.B01.1.454.CMB.1.raw
  modified_base (197)..(197): a, c, t, g, unknown or other
  misc_feature (197)..(197): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattcttaggccaggctcccaggctcctcatctatggtgcatccacccgggccactggtatcccagccaggttcagtggcagtgggtctcggacagagttcactctcaccatcagcagcctggagtctgaagactctgcagtttattactgtcagcagtataattactgccgtggacgttcgccaagggaccaaggtggaatcaaacgaactgtggctgcacatctgtcttcatcc

SEQ ID NO: 46832 - DNA, 511 bp, Homo sapiens
  misc_feature: GYAE6OF02HWT5R.3.12.B01.1.454.CMB.1.raw
  modified_base (197)..(197): a, c, t, g, unknown or other
  misc_feature (197)..(197): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattcttggccaggctcccaggctcctcatctatggtgcatccacccgggccactggtatcccagccaggttcagtggcagtgggtctcggacagagttcactctcaccatcagcagcctggatctgaagactctgctagtttattactgtcagcagttataattacgtggccgttggacgttcgggaccgaaagggacccaagggtggaaatcgaaacggtactggtaggctgccacatctgtcttcattccc

SEQ ID NO: 46833 - DNA, 500 bp, Homo sapiens
  misc_feature: GYAE6OF02GFXZH.3.12.B01.1.454.CMB.1.raw
  modified_base (198)..(198): a, c, t, g, unknown or other
  misc_feature (198)..(198): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattcttggccaggctcccaggctcctcatctatggtgcatccacccgggccactggtactcccagccaggttcagtggcagtgggtctcggacagagttcactctcaccatcagcagcctggatctgaagactctgctagtttatactgtcagcagtataattactggccgtggacgttcgccaagggaccaaggtgaatcgaaacgtacgtgtggctgacacatcctgtcttcattcccg

SEQ ID NO: 46834 - DNA, 508 bp, Homo sapiens
  misc_feature: GYAE6OF02I9ZSD.3.12.B01.1.454.CMB.1.raw
  modified_base (197)..(197): a, c, t, g, unknown or other
  misc_feature (197)..(197): n is a, c, g, or t
  modified_base (500)..(500): a, c, t, g, unknown or other
  misc_feature (500)..(500): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattcttggccaggctcccaggctcctcatctatggtgcatccacccgggcactggtactcccagccaggttcagtggcagtgggtctcgggacagacgttcactctcaccatcagcaatctgcagtctgaagtatttgctagtttatttcttgtcagtctagtttaacacctggtccgtggtaagttttggccgtagggacaagcgtggagctacgaaacgtaactggtgctgcaccatctntcttctac

SEQ ID NO: 46835 - DNA, 621 bp, Homo sapiens
  misc_feature: GYAE6OF02JFR2E.3.12.B01.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
tcagagacgcactccacgaccggtgctcgatttagtagtgtagattccgcgggggaacgtgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctntcctgcagggccagtcagagtgttagtagcaacttagcctggtaccagcatattcttggccaggctcccaggctcctcatctatggtgcatcccacccgggcacgtggtactcccgagccctaggttcagtggctaggtggggtcctacgggacaggtagtttccaaccgttctaccaaccctatccgacggtccaaggtcccgtgggaacgttcctaggaacgaccttcgtaggaccttagttttaacttcgtagtcagtcaagttataacgtttacgtggtaccgttggtaccgtttcgggaccgaaacggtaaccgaagggttacggaacttaccggaaacgtacggttcggtacggtcgttacgaccgtaaccgtacgttacgttcggttacctttacacctttcccgg

SEQ ID NO: 46836 - DNA, 557 bp, Homo sapiens
  misc_feature: GYAE6OF02GSXN3.3.12.B01.1.454.CMB.1.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (304)..(304): a, c, t, g, unknown or other
  misc_feature (304)..(304): n is a, c, g, or t
tcagagacgcactccacgaccggtgctcgatttagtagtgtagattccgcgggggaactgctcgagttaggacccagacggaaccatcggaagccccgaagcgcaagccttctcttcctcctgctacttctggctcccagatatcactggagaaacagtgactgacgcagtctccagcccaccctgtcctgtgtctccagggggaaangccaccctctcctgcagggccagtcagagtgttagngcaacttagcctggtaccagcatattctggccaggcctcccaggctcctcatctatggtncatcccaacccgggcactggtactcccagcccaggttccaggttggcaggtgggtctcgggacaggagttcactctcaccatcagcagcctggacgtctgaacgctcgtgctagtttattactgtcagctagtataattacgtggtaccgttggtaccgttcggacctaacgggaacctagggtacggaacgtcgaaaccggaacgttaggtacggctagaccaccgtagttccgtgtcctttcgatttcccg

SEQ ID NO: 46837 - DNA, 536 bp, Homo sapiens
  misc_feature: GYAE6OF02JBIV0.3.12.B01.1.454.CMB.1.raw
  modified_base (290)..(290): a, c, t, g, unknown or other
  misc_feature (290)..(290): n is a, c, g, or t
tcagagacgcactccacgaccggtgctcgatttagtagtgtagattccgcgggggggaactgcgtcagttaggacccagacggaaccatggaagccccagcgcagcttctcttcctcctgctactcctggctcccagatatcactggagaaacagtgctgacgcagtctccagccaccctgtctgtgtctccacggggaaagagccaccctctcctgcagggccagtcagagtgttagtagacaacttagccttggtaccagcatattctggccaggctcccaggctccncatcatggtgcatccaccggcactggtactcccagccaggttcagtggcagtgggtctcggacaggagttcactctcacatcagcagcctggagtctgaagactctgctagtttattactgtcagcagttaataattacgtgaccgttggacggttcggaccgaaagggaccaagggtaggaatcgaaacggtacgtaggtcggacctaggacctaccgtacgtccgtagtccttacacttccccg

SEQ ID NO: 46838 - DNA, 528 bp, Homo sapiens
  misc_feature: GYAE6OF02H8WEU.3.12.B01.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctntcctgcagggccagtcagagtgttagagcaacttagcctggtaccagcatattcttggccaggctcccaggctcctcatctatggtgcatccaccgggccactggtactcccagccaggttcagtggcaggtgggtctcgggacagagttcactctcaccatcagcagcctggagtctgaagactctgctagtttattactgtcagcaagttataattactggaccgttggacgtttcggaccgaaagggaccgaagggtagaactcgaaaacgacgtaggtggcttacgcctaccacttcctggttacttaccgattcccg

SEQ ID NO: 46839 - DNA, 182 bp, Homo sapiens
  misc_feature: GYAE6OF02GKM7M.3.12.B01.1.454.CMB.1.raw
  modified_base (182)..(182): a, c, t, g, unknown or other
  misc_feature (182)..(182): n is a, c, g, or t
tcagagacgcactccacgaccggtgctcgatttagtagtgtagattccgcgggcacgaccggtgctcgatttagtagtgtagatcccgcggaatctacactactaaatcgagcaccggtcgtgctgcctggtcaaggactacttccgagtgcgtctctgagcgggctggcaaggcgcatagn

SEQ ID NO: 46840 - DNA, 520 bp, Homo sapiens
  misc_feature: GYAE6OF02I7H1D.3.12.B01.1.454.CMB.1.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagagacgcactccacgaccggtgctcgatttagtagtgtagattccgcgggggaactgctcagttaggacccagacggaaccatggaagccccaggcgcagcttctctttcctcctgctacttctggctcccagatatcactggagaaacagtgcgtgacgcagtctccaggccaccctgtctgtgtctccaggggaaangccacccgtctcctgcagggcccagtcagagtgttagtagcaacttagcctggtacccaggcatattcttggccaggctcccaggctcctnatctatggtncatccaccccgggcacgtggtactcccagcccaggttcagtgcagtgggctcggacagagttcactctcaccatcagcagcctgggatctgaagactctgctagttttatctgtcagctagtataattacgtggccgttggtaccgttcggtacgtaagggtaccaagggtcgaatcgaaacgactgtggctgacaccatcctgtcctcgattcccg

SEQ ID NO: 46841 - DNA, 143 bp, Homo sapiens
  misc_feature: GYAE6OF02JDORQ.3.12.B01.1.454.CMB.1.raw
  modified_base (128)..(143): a, c, t, g, unknown or other
  misc_feature (128)..(143): n is a, c, g, or t
tcagagacgcactccacgaccggtgctcgatttagtagtgtagattccgcgggctggcaaggcgcatagctgcctggtcaaggactacttccgagtgcgtctctgagcgggctggcaaggcgcatagnnnnnnnnnnnnnnnn

SEQ ID NO: 46842 - DNA, 617 bp, Homo sapiens
  misc_feature: GYAE6OF02JHLBJ.3.12.B01.1.454.CMB.1.raw
tcagagacgcactccacgaccggtgctcgatttagtagtgtagattccgcgggggaacgtgctcagttaggacccagacggaaccatggaagccccagcgcagcttctcttcctcctgctactctggctcccagatatcactggagaaacagtgctgacgcagtctccagccaccctgtctgtgtctccgaggggaaagagccaccctctcctgcagggccaggtcagagtgttagtagcaacttagcctggtaccagcatattcttggccaggctccaggctcctcatctatggtgcatccacccgggccactggtactcccagccaggttcaggtggcaggtgggtctcgggacaggagttcactctcaccatcagcacgccgtgggagtcgtagaacgtacctctacgcttaagtttacttacgtgttaccagtacgagttaacttaacttacgtacgggtcccgttagggtaccgggttaccggtaccgaaagggtaacccgaagggttaacggtaaacgttaccgaaaaccggtaaacgttacggtaggggtacccagggttaccctaacccgtacgttccgttacggtttaccttccgtaactttccccgg

SEQ ID NO: 46843 - DNA, 547 bp, Homo sapiens
  misc_feature: GYAE6OF02IPSQV.3.12.B01.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattcttggccaggctcccaggctctcattcatggtgcatctaacngggccgatggcattccagccaggttcagtggcagtgatagtgggacagacttnactctcacatcagcaatctgcagtactagtaagtatttagactagttttatttctgtcagtctaagtttaactaccgttcggaccgttagggttaacgttttggaccgtacggggtaaccgaggtcgttcgggaacgtacctacgtaaacgtaacgttggtacggtcgtcgacctaaccgtagtacgttcg

SEQ ID NO: 46844 - DNA, 566 bp, Homo sapiens
  misc_feature: GYAE6OF02FKRO4.3.12.B01.1.454.CMB.1.raw
  modified_base (198)..(198): a, c, t, g, unknown or other
  misc_feature (198)..(198): n is a, c, g, or t
  modified_base (386)..(386): a, c, t, g, unknown or other
  misc_feature (386)..(386): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattcttggccaggctcccaggctcctcatctatggtgcatccacccgggccactggtatcccagcccaggttcagtggcagtgggtctcggacagagttcactctcaccatcagcagcctgcagtcngaagtattttgctaattttatttcttgtcagctaagtaacaattaattggtaccttttgacgtttccggacctaaagggaccctaagggttacgaaacgtaaacgtaaccgttaggtacgggtcctaggaccaaccgtaacgttcgttaggttacctttactacgttcccttacccccgg

SEQ ID NO: 46845 - DNA, 541 bp, Homo sapiens
  misc_feature: GYAE6OF02GZO0Y.3.12.B01.1.454.CMB.1.raw
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattctggccaggctcccaggctcctnatctatggtgcatcccgacccgggccacgtggtactcccgagccaggttcagtgcaggtgggtctcggacagtagttcactctcaccatcagcagtcctggacgtcgtagaagctctgcttagtttatactgtcagctaagttataagttacgtgggtcgttaggtacgttccggaccgaagggtaacctaagggtaggaactacgaaacgtacgtggtacggctagaccactattccgtcgtcttactattcccg

SEQ ID NO: 46846 - DNA, 497 bp, Homo sapiens
  misc_feature: GYAE6OF02I19L9.3.12.B01.1.454.CMB.1.raw
  modified_base (197)..(197): a, c, t, g, unknown or other
  misc_feature (197)..(197): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattcttggccaggctcccaggctcctcatctatggtgcatccacccgggccactggtatcccagccaggttcagtggcagtgggtctcggacagattcactctcaccatcagcagcctggagtctgaagactctgcagtttatactgtcagcagtataattactggccgtggacgttcggccaaagggaccaagggtgaatcaaacgactgtggctgcaccatcctgtcttacattccg

SEQ ID NO: 46847 - DNA, 644 bp, Homo sapiens
  misc_feature: GYAE6OF02GT8L0.3.12.B01.1.454.CMB.1.raw
  modified_base (198)..(198): a, c, t, g, unknown or other
  misc_feature (198)..(198): n is a, c, g, or t
  modified_base (295)..(295): a, c, t, g, unknown or other
  misc_feature (295)..(295): n is a, c, g, or t
  modified_base (356)..(356): a, c, t, g, unknown or other
  misc_feature (356)..(356): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattctggccaggctcccaggctcctcatctatggtncatcccacccgggcactggtactcccagccaggttcaggtggcaggtgggtctcggacagngttcacttctcaccatcgagcacgtcctgggatctagaacgtacttcgcgtactagttttacttacgtgttacagtctaaggttaacttaaagtttaccgtggggacccgtttggggtaacccgtttaccggggacccgtaaaacggggtaacccgtaaaggggttaacgggaaaactttaacccggaaaacgggtaacccgtttagggtaccggggtacccgttaggacccgtaacccgtagtttacccgtttacggtttaccttttacccgacgttttaccccccg

SEQ ID NO: 46848 - DNA, 513 bp, Homo sapiens
  misc_feature: GYAE6OF02ICBJ9.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccacctctcctgcagggccagtcagagtgttagagcaacttgcctggtaccagcatattctggccaggctccaggctctcatctatggtgcatccacccgggcactggtactcccgagccaggttcaggtggcagtgggctgggacagagttcactctcaccatcagcagcctgcagtctgaagtatttgctacttttatttctgtcagtctagtttaacacctggcctggtaagttttggaccgtaggggacaagctggagctacgaaacgtaactggtcggtcgtgcaccgtattctcgttccttctacg

SEQ ID NO: 46849 - DNA, 584 bp, Homo sapiens
  misc_feature: GYAE6OF02F31P5.3.12.B01.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagtagcaacttagcctggtaccagcatattctggccaggctcccaggctcctnatctatggtgcatcccgacccgggcacgtggtactcccagcctaggttcaggtggcaggtgggtctcggacaggagttcacttctacaccatcgagcacgtcctgggagtctaggaacgtacttcgtgtaccttaagttttactacgttgtacagtactagttaacttaacgttacgtcgggtcccgttagggtaccggtttccggaaccgtaaaggggacctaaggggtagaaactaccgaaaacggtacgtaggtcggactcgactaaccgtatccgttgttaccttcgtacttcccg

SEQ ID NO: 46850 - DNA, 558 bp, Homo sapiens
  misc_feature: GYAE6OF02IERYG.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaangccacctctcctgcagggccagtcagagtgttagagcaacttagcctggtaccagcatattctggccaggctcccaggctcctcatctatggtgcatcccgacccgggccacgtggtactcccgagcctaggttcaggtggctaggtgggtctcggacagagttccactctcacatcagcagcctggagtctagaaagctcgtgtctaagttttatactgtccagtcaagttattaattacgtgggccgttggaccgtttcggaccgaaagggaccgtaaagggtcggaaataccgaaaacgtaacgtggtacggcgttacgacctacctagttccgttacgttacttccacttccccg

SEQ ID NO: 46851 - DNA, 521 bp, Homo sapiens
  misc_feature: GYAE6OF02GATJV.3.12.B01.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagtagcaacttgcctggtaccagcatattcttggccaggctcccaggctcctnatctatggtgcatccacccgggccactggtactcccagccaggttcagtggcaggtgggtctcggacagtacgttcactctcaccatcagcagcctgggatctagaacgactctgctagttttatctgtcagctagttattaattctggccgtggtacgttcgacgaagggaccaagggtagaatacgaaacgtactaggtacggctacgcaccgtatccttagtccttcattcccg

SEQ ID NO: 46852 - DNA, 638 bp, Homo sapiens
  misc_feature: GYAE6OF02FU6MM.3.12.B01.1.454.CMB.1.raw
  modified_base (198)..(198): a, c, t, g, unknown or other
  misc_feature (198)..(198): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagtagcaacttagcctggtaccagcatattcttggccaggctcccaggctcctcatctatggtgcactccgacccgggccacgtggtactcccagcccaggttcagtggcagtgggtctcggacagagttcactctcaccatcgagcacgcccgtggacgttcgtggaaacgtactccgtggtaccttagttttaactttaccgttgttaccgagtactaaggttacttaaacgtttaccgttcgggtccgtttagggtaccggttttccggggacccgtaaacggggtaacccgtaaaggggttacgggaaacttaccggaaaaccggtaacgttacgggttacgggtaccgttacggtaccgtaccgtacgttaccgttaggttcctttaccgtactttcccccg

SEQ ID NO: 46853 - DNA, 658 bp, Homo sapiens
  misc_feature: GYAE6OF02GUHK2.3.12.B01.1.454.CMB.1.raw
tcagagacgcactccacgaccggtgctcgatttagtagtgtagattccgcgggggaactgcttcggagtttaggacccagacggaaccagtggaagccccagcgcagacttaactcttacctcctcgcttacttcttcggcctcccaggatatccacctggagaaacgacgtgcctgacgcagtctccaggccacccgtgtctgttgtctaccgaggggtaaagagccaccctctccctgccagggcccagtcagagtggttagtacgcaacttagcctaggtaccagtctatattcgtggccaggcctcccaggcccgtcgtcagtctagtggtgcatccaccggctacgtggtacgtcccagtccaggttcaggtcgcagtgggtctcgggacagacgttcacgtcctacaccactcaacggccacggtccctagggatcgtacgaagtaccttcgtgcctagttttactactgtaccaggtctaagttaacttaacgttacgtgggtacccgttaggtaccgtttacgggaaccgtaaggggtaacccgaagggtaggtaaacgttccggaaaacgggtcccgttagggttacgggaccgttacgtacgaacccgttacggtttccggtaccgttaccggttctaacgttccccg

SEQ ID NO: 46854 - DNA, 513 bp, Homo sapiens
  misc_feature: GYAE6OF02G405O.3.12.B01.1.454.CMB.1.raw
  modified_base (198)..(198): a, c, t, g, unknown or other
  misc_feature (198)..(198): n is a, c, g, or t
  modified_base (504)..(504): a, c, t, g, unknown or other
  misc_feature (504)..(504): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagtagcaacttagcctggtaccagcatattcttggccaggctcccaggctcctcatctatggtgcatcccgacccgggcacgtggtactcccagccaggttcaggtggcaggtgggtctggacagacttcactctcacctatcagcagactggagactagaagtacttgactagtttattacgtgttctgctagtatgtacttctactcttcgtctagtttcggcggtcggacgtaggtggagagtacgaaacgtacgtggtcgctcgcaccngtctgtctc

SEQ ID NO: 46855 - DNA, 603 bp, Homo sapiens
  misc_feature: GYAE6OF02J3LE5.3.12.B01.1.454.CMB.1.raw
  modified_base (214)..(214): a, c, t, g, unknown or other
  misc_feature (214)..(214): n is a, c, g, or t
  modified_base (424)..(424): a, c, t, g, unknown or other
  misc_feature (424)..(424): n is a, c, g, or t
tcagagacgcactccacgaccggtgctcgatttagtagtgtagattccgcgggggaacgtgctcagttaggacccagacggaaccatggaagcccagcgcagcttctcttcctcctgctactctggctcccagatatcactggagaaacagtgctgacgcagtctccagccaccctgtctgtcgtctccgaggggaaagacgccaccctctccngcgacgggccagtcagagtgttagtagctaacttacgcctaggtaccagcattattcgtggccaggtcctcccgaggtcctccgttcacgttctagtggtcgctacgtcccgacccggggtccacgtcggtacctccgacgccgtaggttccgagtcggctagggttcggtcgtacggctaggttacgtcaacgtcctacaccatcagcncgcgtgactcagaacgtctctgtattagttacttcgtgtcaagctagttactaagttcgtacgggtcgtggtaccgtcggaccgaaaggccgtaagggttcgaacgtaccaaacggtccgtggtacgaccgttacgactacccgttagtccgttacgttccctttacgacgtttccccg

SEQ ID NO: 46856 - DNA, 551 bp, Homo sapiens
  misc_feature: GYAE6OF02G9PC0.3.12.B01.1.454.CMB.1.raw
  modified_base (198)..(198): a, c, t, g, unknown or other
  misc_feature (198)..(198): n is a, c, g, or t
  modified_base (351)..(351): a, c, t, g, unknown or other
  misc_feature (351)..(351): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagagcaacttagcctggtaccagcatattctggccaggctcccaggctcctcatctatggtgcatcccgaccgggccacgtggtactcccagccaggttcagtgcagtgggtctggacngattcactctcaccatcagcagcctggagtctggaagtactctcgtactagtttattacgtgtcacgtctagttattaattacgtgggtaccgttggtacggtttaccgggaccgtaaagggaaccctaagggtacggaatacgtaaacgtaacgttggtaggcctagaccaacgtactctcgttacttctacgttcccg

SEQ ID NO: 46857 - DNA, 570 bp, Homo sapiens
  misc_feature: GYAE6OF02IJ0JT.3.12.B01.1.454.CMB.1.raw
  modified_base (200)..(200): a, c, t, g, unknown or other
  misc_feature (200)..(200): n is a, c, g, or t
  modified_base (281)..(281): a, c, t, g, unknown or other
  misc_feature (281)..(281): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggaagaaacagtgctgacgcagtctccagccaccctgtctgtgtctccgaggggaaangccaccctctcctgcagggccagtcagagtgttagagcaacttagcctggtaccagcatattctggcaggctccagctccnatctatggtgcactccgacccggccacgtggtactcccagcctaggttcaggtcggctaggtcgggtctcggactaggtacgttcacttctacaccatcgagcagcctggatcagaacgtctcgtgtactagtttactacgtgtacagtactaagttattaacgttcgtcggtccgttaggtaccgttccggaaccggtaaagggaaccgtaagggtacgaacgtacgaaacgtaacgtggtacggtcgtacgacctactacgttacgttcgttactctacttaccccg

SEQ ID NO: 46858 - DNA, 589 bp, Homo sapiens
  misc_feature: GYAE6OF02GPMMG.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaancgccaccctctcctgcagggccagtcagagtgttagagcaacttagcctggtaccagctatattctggccaggcctcccgaggtcctcctcattctagtggtcgcactcccgacccgggcacgtggtactcccagccgaggttcaggtgcaggtggtctcggacaggtacttcactctaccacactacagcacgtccgtggacgtcgtagaacgtcgtctacggtacttaagtttacttacgttgtacagtctaagttattaagttacgtcggtccgttaggtaccggttccggaaccgtaaagggaccgtaagggtagtaactacgaaacggtacgttaggtacggtcgtacgaccacgtacttacgtcgttaccttactacgttcccg

SEQ ID NO: 46859 - DNA, 533 bp, Homo sapiens
  misc_feature: GYAE6OF02JD82K.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagcccaccctctcctgcagggccagtcagagtgttagtagcaacttagcctggtaccagcatattcttggccaggctcccaggctcctcatctatggtgcatccacccgggccactggtactcccagccaggttcagtcggcagtgggtctcgggacaggtagttcacgtctcaccatcagcagcctggagtctagagactctgctagtttattacgttgtcagctagttataagttactggccgtggacgttcggacgacggtaccgaagggtgtaatcgaacgtaactacggtggcgtcgacctaccgtattccgtgtcttaccatttcccg

SEQ ID NO: 46860 - DNA, 639 bp, Homo sapiens
  misc_feature: GYAE6OF02JD0XX.3.12.B01.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
  modified_base (366)..(366): a, c, t, g, unknown or other
  misc_feature (366)..(366): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaangcccaccctctcctgcagggccagtcagagtgttagtagcaacttgcctggtaccagcatattctggccaggctcccaggctcctcatctagtggtcncacgtcccgacccggcacgtggtactcccagcctaggttcaggtcggactaggttcgggtctacggganacggtacgtttcaacttcctacgaaccctagtcaacggtcacggtccgtagggtactcgtaggaaactccgttcgtagtaccttaaggttttacttacgtcgttacgagtctaaggtttaattaacgttaccggttacgggccgttaacgggtacgttaccggaaccggtaaacgggtaaccgtaaggggttaagaacgttaaccgaaaacggtacgttgggtcgtacgtacggacctacctgttaccgttcgtttacctacgtaccttcccg

SEQ ID NO: 46861 - DNA, 771 bp, Homo sapiens
  misc_feature: GYAE6OF02H5XC2.3.12.B01.1.454.CMB.1.raw
  modified_base (218)..(218): a, c, t, g, unknown or other
  misc_feature (218)..(218): n is a, c, g, or t
  modified_base (339)..(339): a, c, t, g, unknown or other
  misc_feature (339)..(339): n is a, c, g, or t
tcagagacgcactccacgaccggtgctcgatttagtagtgtagatttccggtcgggggggggaactgctcagttaggacccacgacgggaaccatggaagccctagcgtcagcttctcttccgtacctgctactctggcctccagattagtcactggagaaacgagtttgctgacgtactaagtctccagccaccctgtctgtgtctcgaggggaagnggccaccctcgtccgtgggcagggccaaggtccagtacgtgttaggtacgctaacgttaggccttagggttaaccagcaattacgttcttaggccaaggtccgtcccgacggctaccctanaagttccgtatgggttgaccgatcccggacccggctaacgtggtactccgaggccgtacggttcaaggttggacctaaggtcgggtcacgggaactacggtacggttaccgaccttcaaccctaaccgtactacgaaacggacaacggtccgtaaaggggtaacgtacgttaagggaaacctacgttacctagggaaccttaaaggtttttaacgtaaacgttcggtactaacgggtactaaaggttaattaaaacggttaccttacgggggtccccgttaagggttaaccggttttaccggggtaaccgtaaaacggggaaaccgtaaggggtaaccgaaagttaaccggaaaaacgtacgggtacgggttcggtaaccgttaccgaacgacccgagttacccgtaggtttacctacgttacgttaccccg

SEQ ID NO: 46862 - DNA, 661 bp, Homo sapiens
  misc_feature: GYAE6OF02F6MDV.3.12.B01.1.454.CMB.1.raw
  modified_base (200)..(200): a, c, t, g, unknown or other
  misc_feature (200)..(200): n is a, c, g, or t
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagagacgcactccacgaccggtgctcgatttagtagtgtagattccgcgggggaactgctcagttaggacccagacggaaccatggaagccccagcgcagcttctcttcctcctgctactctggctcccagatatcactggaagaaacagtgctgacgcagtcctccacgccaccctgtctgtgtctccgaggggaancgccctaccctctcctgaccgacgggccagtcaagagttgttaaggtagcctaacttagcctggtaaccagcattattcgttggaccaggccctcccgaggtccttccctnattctagtggtcgcactcccgaccgggccacgtggtacncccagcctaggttcaggtggcaggtcgggtctcgganaggtcgttccacgttccaccacatcgagcacgtccgtgggacgtcgtagaaacgtaccttcgtacgtacgtttaagttttaacttaccttgtaccacgtacgtaagttaattaaacgttcgtcgggtcccggtaggttaccggtttaccggaaaccggtaacgggaaccgtaacgggtaacggaaactaacccggaaaagtaaccggttagggtaccgtacgtacgaccctaaccgtagttaccgttacggtttccttacgtaccgttaccccg

SEQ ID NO: 46863 - DNA, 586 bp, Homo sapiens
  misc_feature: GYAE6OF02JCWVU.3.12.B01.1.454.CMB.1.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
  modified_base (406)..(406): a, c, t, g, unknown or other
  misc_feature (406)..(406): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagccaccctctcctgcagggccagtcagagtgttagtagcaacttagcctggtaccagcatattctggccaggctcccagctcctcatctatggtncactcccgaccgggccaacgtggtactcccagccgtaggttccaggtcgcgtaggttgggtcctcgggacaggtacgttcactctccacctatcagcagtcctgggacgtntagaagacttctcgtacttagttttacttacgttgtacagtctaagttaactaattacgtcggtaccggttaggtaccggtttcggaaccggtaaagggaaccgtaagggtacgaactacgaaacgtaacgtggtacggtcgtagaccgactacgtacgttcggtctttctacttccccg

SEQ ID NO: 46864 - DNA, 666 bp, Homo sapiens
  misc_feature: GYAE6OF02J0XRW.3.12.B01.1.454.CMB.1.raw
  modified_base (199)..(199): a, c, t, g, unknown or other
  misc_feature (199)..(199): n is a, c, g, or t
  modified_base (640)..(640): a, c, t, g, unknown or other
  misc_feature (640)..(640): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagccaccctctcctgcagggccagtcagagtgttagtagctaacttagcctggtaccagctattattcttggccaggcctcccgaggtctcctcatctagtggtgacctacgtcccgaaccccgggcctaacgtgggtacctccccgaggccccgtaaggttccaggttcggcgtagggttcgggtcctcgggaactaggtacgttccacttccgccaacctatcacggcacggtccgtagggacgttctagggaaactccgttcgtcgacgttaagttttacttacgtgttacaggtacctaagttaacgttaactttcgtacgggtcccggttagggtaaccggtttcccgggaaccgtaaggggtaaaccctaaggggttaacgaaacttaaccggaaaggtaacccgttggtacggtacgttacgacgaacccgttntcggtacgtttcttactacttccccg

SEQ ID NO: 46865 - DNA, 679 bp, Homo sapiens
  misc_feature: GYAE6OF02HZ2VP.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctccagatatcactggagaaacagtgctgacgcagtctccagccaccctgtctgtcgtctccgaggggaaanacgcccacccttctcctgccgagggccagtcagtagtgttagagctaacttgcctaggtaccagcattattcgtggccaggcctacccgaggtcctcctcgattcctagtggtcacctactcccgaccccgggccacgttcggtaacctcccgagccgtaggttccgaggtcggtccgtagggttcgggtctcgggaatacgtagttccacgttcctacctaccatccgagtcgtacggtccgtgggtactcgtaggtaaacgtaccttgtacgtacttacgttttacttacgttagtaccgtaaggtacgtaagttaacgttaaacgtttaccggttacggtaccgggttacggtaccggtttaccggaaccggtaaacgggaaccgtaaggggtaacgtaaacgtaaccggtaaacggtaacgtcgggtagccgttacgacctacgttacgtccgttacgttactccgtacttccccg

SEQ ID NO: 46866 - DNA, 580 bp, Homo sapiens
  misc_feature: GYAE6OF02FME6Y.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagccaccctctcctgcagggccagtcagagtgttagagcaacttagcctggtaccagcatattcttggccaggctcccaggctcctcatctatggtgcatcccacccgggccacgtggtactcccagccctaggttcaggtcggcaggtgggtctcgggacagtcgttcactctacaccatcagcacgccgtgggacgtcttaggaagtaccttcgtagtcctagtttttaattactgttacaagtactaagttaattaattaccgtgggtccggttagggtaccgtttccgggaccgtaaacgggaaccgtaagggtacggaactacgaaacggtaacgtggtacggtctcgacgtacattccgtgtccttcacttcccg

SEQ ID NO: 46867 - DNA, 580 bp, Homo sapiens
  misc_feature: GYAE6OF02FW5PQ.3.12.B01.1.454.CMB.1.raw
  modified_base (198)..(198): a, c, t, g, unknown or other
  misc_feature (198)..(198): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagtagcaacttagcctggtaccagcatattcttggccaggctcccaggctcctcatctatggtgcactccacccgggccacgtggtactcccgagccaggttcaggtggcaggtcgggtctcgggacagtagttcacttctccaccatccagtccagcctgggagtctagaagtactcgtgcgttagtttatacgttgtcagtcagtattaagttacgtcgggtccgtagggtaccggtttaccggaccgtaaaggggaccctaaaggggttacggaaacgtacgaaacggtaacgtggtacgggcttacggacctacccattccgtcggttcctttactacttccccg

SEQ ID NO: 46868 - DNA, 552 bp, Homo sapiens
  misc_feature: GYAE6OF02HYL8I.3.12.B01.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagagcaacttagcctggtaccagcatattctggccaggctcccaggctctcatctatggtncatccgaccggccactggtactcccagccaggttcaggtgctagtgggtctcggacagacgttcacgtctcacatcagcacgctggacgtctagaagtactcgtgacttagtttatacgttgtcagctaagttataactttacgcgtacgtggtaccgttacggacgtaaagggaaccgagggtacgtaagtacgaaacggacgttacggtaggtcgtagacaccgtagttaccgttacggtccttaccgacttaccccg

SEQ ID NO: 46869 - DNA, 729 bp, Homo sapiens
  misc_feature: GYAE6OF02JK5DB.3.12.B01.1.454.CMB.1.raw
  modified_base (145)..(145): a, c, t, g, unknown or other
  misc_feature (145)..(145): n is a, c, g, or t
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (431)..(431): a, c, t, g, unknown or other
  misc_feature (431)..(431): n is a, c, g, or t
  modified_base (452)..(452): a, c, t, g, unknown or other
  misc_feature (452)..(452): n is a, c, g, or t
  modified_base (719)..(719): a, c, t, g, unknown or other
  misc_feature (719)..(719): n is a, c, g, or t
tcagagacgcactccacgaccggtgctcgatttagtagtgtagattccgcggggggaactggctcagttaggacccagacggaaccatggaagcccagcgcagcttctctcctctgcctactctggctcccagatatcactgganaaacngtgctgacgcagtctccagccaccctgtctgtcgtctccgaagggggaaacncgccctaacctctccgtgcgacgggccctaggtcagngttagttagacgctaacgttagccgtagtaccagtactacgttacgttcgtagggaccctaggtcctacccggaggtcctcctctaacgtctaagtcggtcgacctacgtcccggaacccggtctacggttcggtactccccgaggacccttagggttccaggtcgacgaggtttcgggccctagggaacgnggttacgttaccaacctttcnccgaactagtccgaacgaccgtacgtacccgtgggtacctcggtaacggtaaacggtacttacggacgtacgttaagtttaccgttaagttcgacgtaagtaccgtacgttaaattaacgttaccggtcggtaccgttaggtaaccggttccgaacgggtaaacggtaaccggtaagggtacgggtaactaaccggtaacggtaaacggttgtacccgggtagttaccggaacctaccggttacgtacgtttacggtaccgtttacncccgttaccg

SEQ ID NO: 46870 - DNA, 688 bp, Homo sapiens
  misc_feature: GYAE6OF02F693V.3.12.B01.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagccaccctctcctgcagggccagtcagagtgttagagcaacttgcctggtaccagcatattcgttggccaggctcccgaggcctcctnatctagtggtcgcactcccgaccccgggcacgtggtactccccgagccgaggtttccaggtcggctagggttcgggtctcgggacagtagttccactcctcaacctatccagacacggtccgtagggacgtctaggaacgtaccttcgtcggtactttaacgttttaattaccgttcggttaccaacggtctaacggttaattaaacttaccggttacgggtaccggttagggtaacccgggtttaccgggaacccgtaaaagggggtaacccgtaaaggggttaacggaaaacttaccggaaaaaccggttaaacgggtcggttaacgggtacccgttacggacccgtaaacccgttacttaccgttcgttttaacccgtttccaaccgtttcccccg

SEQ ID NO: 46871 - DNA, 760 bp, Homo sapiens
  misc_feature: GYAE6OF02IML27.3.12.B01.1.454.CMB.1.raw
  modified_base (197)..(197): a, c, t, g, unknown or other
  misc_feature (197)..(197): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctcgaggggaanagccaccctctcctgcagggccagtcaggtgttagttagtacgactaacttacgcgtacggtaccagctaattacttcgtcggaccgacggtccctacccgaggtcccttcccactacttacgttaggtcggtcgacctaccgtaccccggaccccgggtctacggttacggttacccaccgacgtaccggttaggttacgaggggtcggtacggtaggggtttccgggttaccggtacgggaacgtaggttaccgttacctaccttcctaaccgaacctagtacgacgtactactcgtgacgtacgttacgtagtaacgtttatttacggtacttttaacgttttactttcgttacgtacgttacgtaactttaaaccgtttaccgtaccggttccggttaccggtttaagggtttaccggtttccgggaaccgggtaacgggtaaccgtaacggtacggttacgggacgtaccgtaaacgggaaacggttaacgttacggggtacgtccggttaccgaaccgtaccgttacttaccgttcgtttaccttaccgttaacccg

SEQ ID NO: 46872 - DNA, 649 bp, Homo sapiens
  misc_feature: GYAE6OF02HR9GS.3.12.B01.1.454.CMB.1.raw
  modified_base (199)..(199): a, c, t, g, unknown or other
  misc_feature (199)..(199): n is a, c, g, or t
  modified_base (361)..(361): a, c, t, g, unknown or other
  misc_feature (361)..(361): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctccagatatcactggagaaacagtgctgacgcagtctccagcccaccctgtctgtgtctccgaggggaaanacgccaccctctcctgcagggccagtcagagtgttagagcaacttgcctggtaccagctatattctggccaggcctccgaggctcctcattctagtggtgcactcccgaccggccacgtggtactcccagcctaggttcagtggcaggtcgggtctcggaanaggtacgttcacctctccaccatcacgtcacgtccgtagggacgtcgtacggaaacgtaccgtcgttaggtacttaaggttttacgtttacgtgttacgaagtctaaaggttactttaaacgttaccggtagggtccgttacggggtaaccggttaccgggtaaccgggtaaacgggtaaaccgtaaggggttaacggtaaacgtaccgtaaaaccggtaacggtacggttacggacgttaccggacctaaccgtcgttacgttacgttcttaccgtacgttccccgg

SEQ ID NO: 46873 - DNA, 637 bp, Homo sapiens
  misc_feature: GYAE6OF02GOBCG.3.12.B01.1.454.CMB.1.raw
  modified_base (305)..(305): a, c, t, g, unknown or other
  misc_feature (305)..(305): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaagacgcccaccctctcctgcacgggccagtcagagtgttaagtagctaacttagcctggtaccagcattattctggccaggcctcccaggcctcctcatctagtggtnccactcccgacccgggccacgtcggtactccccgagccaggttcaggtggcgtagtgggtctcggataggtagttccacgtctaccacctatccagacacgtccgtgggacgtcgtagaaacgtctcgtcgtacttagttttaactcttagtcgacgtactaagttaattaaacgttacgtcgggtaccgttagggtaccggttacggaaccggtaaacgggaaccggtaaagggtacggtaaacgtaccggtaaaacggtacgttagggtacgggactaccggtacctaaccgtacgtttccgttacgtttccttaccgtaccttaccccg

SEQ ID NO: 46874 - DNA, 623 bp, Homo sapiens
  misc_feature: GYAE6OF02JBXVG.3.12.B01.1.454.CMB.1.raw
  modified_base (199)..(199): a, c, t, g, unknown or other
  misc_feature (199)..(199): n is a, c, g, or t
  modified_base (334)..(334): a, c, t, g, unknown or other
  misc_feature (334)..(334): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagcccaccctgtctgtgtctccaggggaaangccaccctctcctgcagggcccaggtcagagtgttagtagcaaacgttgcctaggtaccagccattattcttggccaggctcccgaggctcctcactctatggtgcatccgacccgggcacgtcgtactcccganccagtcagtcggcgaggtggtctacgggacaggtattcgatccgtaccactactcagcacgcctaggtagtcgtaggaacgtacttcgtacgcttagtttacttactgttacagtactaagttaacttaagttaccgtacgggtccgttacgggtaccggtttccgggtaaccgaaacgggtaaccgtaaggggtaacgtaaacgtaacgaaaaccggtacgtacggttacggtaccgtaccggacctaccgtagtaccttaggtaccctttacgtaccgtttaccccg

SEQ ID NO: 46875 - DNA, 745 bp, Homo sapiens
  misc_feature: GYAE6OF02GBUMV.3.12.B01.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (716)..(716): a, c, t, g, unknown or other
  misc_feature (716)..(716): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacngtgctgacgcagtctccagcccaccctgtctgtgtctccgaggggaaancgccaccctctcctgcagggccagtcagagttgttacgtagcctaaacttagccgtaggtaccagcgtattattcgttggccaggtcctccccgaggtcctcccgtcactcgtagttcggtcgcctacgtcccgaccccggggtcctaaccgttcggtactaccccgacgtacccgtacgggtttaccgagggtcggcgtaggggttcgggtaccgtaccgggacgtacggtacgttacacgttcctaccaaccgtactcgaacgccgtacggtcccgtagggtacttacgtacggaaacgtaccttcggtacgtacgtttaagttttacgttacgttacggtcgtaagtactaaacggttagtttaaacgtttaccggtacgggtaccggttacgggttaaccgggttaccgggaaccggtaaacgggtaaccgtaagggttacgtaacgttaaccgtaaaacgggtacgttacggtacggtacgtaccggtacctacccgtgtttaccggttnttacccggtttactaccgtttacccccgg

SEQ ID NO: 46876 - DNA, 559 bp, Homo sapiens
  misc_feature: GYAE6OF02IB1Z0.3.12.B01.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacngtgctgacgcagtctccagcccaccctgtctgtgtctccagggggaaangccacctctcctgcagggccagtcagagtgttagtagcaacttagccttggtaccagcatattttgccaggctccaggctcctcatctatggtncatcccgacccgggccacgtggtactcccagccaggttcagtggcagtgggtctcggacagagttcactctcaccatcagcagcctggagtctaggaagactctagcttagtttaattactgtcaggcagttaattaattacgtcggtcgtggaccgttcggaccgtaagggaccaaagggtagaattacgaaacgtaacgtggtacggacttcggacctaaccgtataccgttagttcctttactaccttccgttacccccgg

SEQ ID NO: 46877 - DNA, 592 bp, Homo sapiens
  misc_feature: GYAE6OF02FYENQ.3.12.B01.1.454.CMB.1.raw
  modified_base (198)..(198): a, c, t, g, unknown or other
  misc_feature (198)..(198): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccaggggaaangccaccctctcctgcagggccagtcagagtgttagtagcaacttagcctggtaccagcatattcttggccaggctcccaggctcctcatctatggtgcactcccaccgggcacgtggtactcccagccaggttcagtggcaggtcgggtctacggacagtacgttcactctcacctatcgagcacgtccgtggtacgtcgtagaacgtactcgtgcttaagttttactacgttacgtcgacgtctaagttacttaagttacgtcggtccgttagggtacggttaccggaccgaaacggtaaccgtaagggttacgtaacgtacgaaacggtacgttaggtacgggtactacgaccgtaccgtacgttaccgtagtccttacgtacgttaccccg

SEQ ID NO: 46878 - DNA, 648 bp, Homo sapiens
  misc_feature: GYAE6OF02HGLNZ.3.12.B01.1.454.CMB.1.raw
  modified_base (202)..(202): a, c, t, g, unknown or other
  misc_feature (202)..(202): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagcccaccctgtctgtgtctccgaaggggaaanagcccaccctctcctgcagggccagtcagagtgttagtagactaacttagcctggtaccagctattattcgttggccaggcctcccgaggcctcctcatctagtggtcactacgtcccgaccggccacgttggtacctcccgagccgtaggttcaggtcggcgtaggttcgggtcctacgggactaggtacgttccaccttccgtaccaaccctagttaccgaggccacggtcccggtagggtaacgtcgtaaggaacgtcttcgtacgtacgttaagttttacttacgtcgtacacgtactaagttaacttaacgttaccggtgggacccggttagggtaacccgttcggaaccggtaaaggaccgtaagggtacgaaactacgaaaccggtgttagggtcgactacgactaccgtgttcgttacgttaccttctaccgttcccg

SEQ ID NO: 46879 - DNA, 837 bp, Homo sapiens
  misc_feature: GYAE6OF02IB9IR.3.12.B01.1.454.CMB.1.raw
  modified_base (153)..(153): a, c, t, g, unknown or other
  misc_feature (153)..(153): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcacgtggaagaaacngtgctgacgctagtctccagccctaccctgtctgtcgtcaccggaagggggaaatcgccctacctctccgaggcgacgggcctaagtcaggtgttagttacgagacctaaagttcggccttacgggaaccaggtactaattactttcgttcggggaccctagggtcccttacccggaaggtccttcctaactattccgttagtcgggtactccaaaccgtccccggaccccgggtactaaccggttggtaaccctaccccgaggtacccgtaaggttccgaaggttcggaccggtagggttcgggttctaccgggattaacggtctttaccaaccgtttcgaaccctactaacgttaccgaggaccgtaccgggtccgtttaacggggacttaccggttaaaggtaaaccgttcccgttacgtggtttaaacccgtttaaggttttaaaccttaccggcggttaaaccgtaagtaacgtttaaaccgttaaagtttaaaccggttaccggtaccggggtttaccgtaaccgggttaccggtttaaccgggaaacccggggtaaacggttaaaccgggtaaagggttaaaccgtaaacgttaacggtaaacgggtaaccgtcggttacggaaccttccggtaacaaccgttacgttcggttaccttccgttacccagtttccccc

SEQ ID NO: 46880 - DNA, 602 bp, Homo sapiens
  misc_feature: GYAE6OF02GK6KB.3.12.B01.1.454.CMB.1.raw
  modified_base (200)..(200): a, c, t, g, unknown or other
  misc_feature (200)..(200): n is a, c, g, or t
  modified_base (350)..(350): a, c, t, g, unknown or other
  misc_feature (350)..(350): n is a, c, g, or t
  modified_base (439)..(439): a, c, t, g, unknown or other
  misc_feature (439)..(439): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagcccaccctctcctgcagggccagtcagagtgttagtagcaacttagcctggtaccagcatattcttggccaggctcccaggctcctcatctatggtgcatccacccgggccactggtactcccagccaggttcaggtgcaggtggtcncggacagagttcactctccaccatacagccagtcccgtggaacgtcgtagaacgacttctcgacgttagttttacttacgttgtacgancctagtaattaagttacgtcggtaccgtcgggtacgttacgggaccgtaaacgggaaccgtaagggtacggtaaacgtaccgtaaagggtaacgtaggttacggaccgttaacggacctaaccctaacgttccgttacgtacctttaccgtagtttacccccg

SEQ ID NO: 46881 - DNA, 740 bp, Homo sapiens
  misc_feature: GYAE6OF02H2MO2.3.12.B01.1.454.CMB.1.raw
  modified_base (107)..(107): a, c, t, g, unknown or other
  misc_feature (107)..(107): n is a, c, g, or t
  modified_base (199)..(199): a, c, t, g, unknown or other
  misc_feature (199)..(199): n is a, c, g, or t
tcagagacgcactccacgaccggtgctcgatttagtagtgtagattccgcggggggaactgctcagttaggacccagacggaaccatggaagcccagcgcagcttcncttcctcctgctactctggctccagatatcactggagaacagtgctgacgcagtctccagcccacctgtctggtcgtctccgaaggggaaancgccaccctctcctacgcgacgggccaggtcagagttgttagagactaacttagccttaggtaccagcattattcgtggaccacggcctcccgaggtcctccttacattcctagttcggtcgacctaaccgttcccccggaaccccggggcctaaacggtttcgggtaacctcccccgaaggtccccgtagggtttaccaggggttccggacgtagggttcgggtacctcgggaaactaggtactttcgaacttcctacctaccgtatccgaagcacggtccgtgggtaactcgttaaggaaacgtcgttccgtaggttaccttaaggttttactacttacgtaccgtaagacttaagtttaacttaacgttacggtaaccgggttcccgtaaggtttacccgggtacggaacccgggtaaaaggggaaccctaaagggggttacgaaaaccgttccgtaaaacggtacggttacgggtcggtaaccgtacgtaaccgacccttagtacccgtttgtaacctttccgtaacctttccccgg

SEQ ID NO: 46882 - DNA, 721 bp, Homo sapiens
  misc_feature: GYAE6OF02H1ZV3.3.12.B01.1.454.CMB.1.raw
  modified_base (148)..(148): a, c, t, g, unknown or other
  misc_feature (148)..(148): n is a, c, g, or t
  modified_base (205)..(205): a, c, t, g, unknown or other
  misc_feature (205)..(205): n is a, c, g, or t
  modified_base (415)..(415): a, c, t, g, unknown or other
  misc_feature (415)..(415): n is a, c, g, or t
  modified_base (713)..(713): a, c, t, g, unknown or other
  misc_feature (713)..(713): n is a, c, g, or t
tcagagacgcactccacgaccggtgctcgatttagtagtgtagattccgcggggggaactgctcagttaggacccagacggaaccatggaagccccagcgcagcttctccttcctcctgctactctggctcccagatatcactggaanaaacagtgctgacgcagtctccagcccaccctgtctgtcgtcctccgaaggggaaancgccctacccttctccgtaggccgacggggcctagtccaggtaggttaggtttaagacgactaaacgtttgcccgttgggtaacccagtactaattacgtttccgtagggccctaagggccccttacccgagggtcccttccctactattacccgttagtcggggttacactaccgtccccggaaccccgggctaacgttcgggtacccncccgtaacggtccgtaagggttcaggtcggccgtagggtcgggtctaccgggaactaagggtcgtttccacctttcgacccaaccgtagtaccgactacggacgtaccgtagggttacgtcgtaaggaaccgtacttcgtacgtacgttaacgttttaactcgtacgtcaagtacgaagttactttaacggtacgtcgggacgttggtaccgttacggacggaaggtaaccgtaaggtacgaacgtacgaaaccgtgtaggtcgcgttacgcctacgtatcgttacggttcttaaccngttacccg

SEQ ID NO: 46883 - DNA, 612 bp, Homo sapiens
  misc_feature: GYAE6OF02G2XKW.3.12.B01.1.454.CMB.1.raw
  modified_base (200)..(200): a, c, t, g, unknown or other
  misc_feature (200)..(200): n is a, c, g, or t
  modified_base (380)..(380): a, c, t, g, unknown or other
  misc_feature (380)..(380): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagccaccctctcctgcgagggccagtcgagagtgttagtagctaacttagcctggtaccagcatattctggccaggctcccaggctcctcatctagtggtcgcactcccgacccgggcactggtactcccgagccgtaggttcaggtgcgaggtcgggtctcggacaggtcgttcactcncacgatcgagcacgcgtcggactcgagaagtcctgtcgacgttagtttactacgttgtacgacgtactaagttacttaagttacgtcgggtaccgttacgggtaccggttaccggtaccggtaacggaaaccggtaacgggtaacggtaacgtaacgtaaaaccggtacgttacggtacggtacgtcgaacctaacgtacgttccgttacgttaccttacgtaccttccccg

SEQ ID NO: 46884 - DNA, 849 bp, Homo sapiens
  misc_feature: GYAE6OF02GTBCC.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccacctgtctgtcgtctccgaggggaaanacgcccaccctctcctgaccgagggcccaggtcaaggtagttgtttaagtacgacctaacgttagcccgttaggtacccagactaattagtttcgttcggacctaagggtccctaccccgaggtcccttcccgtactacttaccgttaggttcgggttcgacctaaccgtccccggaacccccggggtcctaaccggttcgggttaaccctccccgaacggtcccgtaagggtttaccagggttcggacgtaggggttcgggttccgtacgggactaggtacgttccaccttcctaccaccatccgacgactacgcccgtgccgtacgtccgtagtagttacgttacgttttcgaacctttaaacgttttacttaaccgtacgtaaacccgtaaacgttaacgtttaaaccgtaaacccggtttaaccccgggtacggtttaacccggggtttaacccgggtttaaccccggggaaacccggtaaaccggggggtaaacccgtaaaacggggggttaccgggtaaagttaaccggttaccgtaaaacgggtttaacccgggtaaacggtttcggggttaacggaacccgttacgggtaccctaacccggttactttcccggtttacgttttacccttaccgttaacccgg

SEQ ID NO: 46885 - DNA, 793 bp, Homo sapiens
  misc_feature: GYAE6OF02FWUIQ.3.12.B01.1.454.CMB.1.raw
  modified_base (200)..(200): a, c, t, g, unknown or other
  misc_feature (200)..(200): n is a, c, g, or t
  modified_base (334)..(334): a, c, t, g, unknown or other
  misc_feature (334)..(334): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanacgccaccctctcctgcagggccagtcagtagtgttagtagactaactacggcctaggtaccagactattatttcgttcggacctacggccttacccgagggtcccttccctctacttacgtacgttgggtacnccgtaccctcccggaaccccgggtcctaccgttaggttaccctaccccgacggtaccccgtaggtttccaggttcgggacgtacgggtttacgggtccgtaacgggacgtaacggttacggttaccacctttccgaacctacccgtaacgtaccgcgtcccgtaaggtcccgtagggaccgtttgtaaccggtaagtaccgtcgttaacgggtcgttttaaattttacgtaccgtttacgtacgaacgttacgttaaaggtttaacttaaaccggttcggttcggggtaaccccgggttgggtacccggtttaacggggaacccgtaaaaggggtaccggttaaaacggggtaccggttaagtaaccccgtaaagggaaccgtttagggacccgggttacgtacggaccccgtaagtttacccttcggttacgttccctttacccggtccttttccccg

SEQ ID NO: 46886 - DNA, 699 bp, Homo sapiens
  misc_feature: GYAE6OF02G4NZJ.3.12.B01.1.454.CMB.1.raw
  modified_base (200)..(200): a, c, t, g, unknown or other
  misc_feature (200)..(200): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggaagaaacagtgctgacgcagtctccagccaccctgtctgtgtctccgaggggaaancgcccaccctctcctgcacgggccagtcgagtagtgttaagtagactaacttagcctcggtaccagctattattcttcggccaggtcctcccgaggtcctcctactatctagtggtcgacacgtcccgaacccgggcctacgtcgtacctcccgacgtccgtacggttcgacggtacggcgtagggttcgggtccgtaccgggaacgtacgtacggttacctaccgtccgtacctaacctacgtacacgtacgacgtccggtgtaacgtcgtaagtaacgtactcgtataccgtaagttttctacgtgtacgtacgtacgtaagttaattaacgttaccgtacgggtcccggtaaggtacccggttacgggtaacccggaaaacggaacgggtaaacgttacggtaaacgttaccggtaaaacggttaacggtcgggttacgtccttaaccggaccgtactacgttccgtacgtttacccttaccgtacccgttcccgg

SEQ ID NO: 46887 - DNA, 698 bp, Homo sapiens
  misc_feature: GYAE6OF02IGX2N.3.12.B01.1.454.CMB.1.raw
  modified_base (137)..(137): a, c, t, g, unknown or other
  misc_feature (137)..(137): n is a, c, g, or t
  modified_base (153)..(153): a, c, t, g, unknown or other
  misc_feature (153)..(153): n is a, c, g, or t
  modified_base (216)..(216): a, c, t, g, unknown or other
  misc_feature (216)..(216): n is a, c, g, or t
  modified_base (341)..(341): a, c, t, g, unknown or other
  misc_feature (341)..(341): n is a, c, g, or t
  modified_base (400)..(400): a, c, t, g, unknown or other
  misc_feature (400)..(400): n is a, c, g, or t
  modified_base (473)..(473): a, c, t, g, unknown or other
  misc_feature (473)..(473): n is a, c, g, or t
  modified_base (499)..(499): a, c, t, g, unknown or other
  misc_feature (499)..(499): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggccctccganatactctacgtggaanaaacaggtgctagacgctagtctaccgagccctacctgtctgtcgttccacggaaggggaaanacgcccacccttctccgtgacgacgggcctagtacgaggtagttagttagacgactaacgttagccgtagtacaaccaaacgaacgtaaacgtcgaccgacggtccctaccggagtcctacctanacttactagttacgactcgactactaccaaacggtcggacctagtacgacacctaccgngtaccgtaggttcaggtcgcgtaggtcgggtacgacgggaacacgtacttacacttcgacactatcgagtacncgtaagacgtcgtaataagttcgttnattacgtactttaattggttacaactaaggacggtggtacgaactaacggtccggttacccgtaggttacgggtacccgtacggaacccgaaagggtaccgtaagggttaacgtaacgtaaacccggtaaaccggtgtaggtttaccgggactaccgtaccgtaaaccttacccggtttccgttacgtaccgttacccg

SEQ ID NO: 46888 - DNA, 509 bp, Homo sapiens
  misc_feature: GYAE6OF02H4SLQ.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccctgtctgtgtctccaggggaaanagccaccctctcctgcagggccagtcagagtgttagtagcaacttagcctggtaccagcatattcttggccaggctcccaggctcctcatctatggtgcactccacccgggccactggtactccagccagttcagtgcagtggtctcggacagagttcactctcaccatcagcagcctggagtctagaagtactctgctagtttacttactgtacagctagttataattactggccgttggacgttcggaccgaacgggaacaggtagaatacgaaacgatcgtggctgacacatctgtcttctatcccg

SEQ ID NO: 46889 - DNA, 599 bp, Homo sapiens
  misc_feature: GYAE6OF02FOZYB.3.12.B01.1.454.CMB.1.raw
  modified_base (200)..(200): a, c, t, g, unknown or other
  misc_feature (200)..(200): n is a, c, g, or t
  modified_base (417)..(417): a, c, t, g, unknown or other
  misc_feature (417)..(417): n is a, c, g, or t
  modified_base (442)..(442): a, c, t, g, unknown or other
  misc_feature (442)..(442): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccctgtctgtgtctccagggggaaanacgccaccctctcctgcagggccagtcagagtgttagtagacaacttagcctggtaccagctatattcttggccaggcctcccaggcctcctcattctatggtgcactcccgaccgggcactggtactcccagccacggttcagtggctagggtcgggtctcgggacaggtacgttcactctacaccatcagccagcctaggatctagaacgctcgngtacttagttttactacgttgtacngtactaagttaataagttacgtgggtacccgttagggtacccgttcgggacccgtaaagggaccgtaaaggggttaagaaacgtaccgaaaacggtaaccggttaggacggtacgtcggaccaaccgtagttccgttcgttactcgtaccttacccg

SEQ ID NO: 46890 - DNA, 663 bp, Homo sapiens
  misc_feature: GYAE6OF02GCTTH.3.12.B01.1.454.CMB.1.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
  modified_base (309)..(309): a, c, t, g, unknown or other
  misc_feature (309)..(309): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagccaccctctcctgcagggccagtcagagtgttagtagactaacttagcctggtaccngcattattcttggccaggcctcccgaggcttcctacattctagtgggtcncactcccgacccgggtctacgtcggtactcccgagcctaggttccaggtcggactagggtcgggtcctgggaacaggtacgttaccaccttcctaccaacctatccgagccgaacggtccgtagggtacgttacgtaggaacggtaccttcgtacgtacgtttaagtttttaattaccgttgttaccacgtactaagttaattaaacgttaccggtagggtccgttagggtaccggttaccggaacccggaaacgggtaaccgtaaggggtaacgtaacgtaaccgaaaaccggtacgttacggtcgtacgtacgaccgaacctagtccgttagttccttacgtacctttcccg

SEQ ID NO: 46891 - DNA, 759 bp, Homo sapiens
  misc_feature: GYAE6OF02GNAEH.3.12.B01.1.454.CMB.1.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaanagccaccctctcctgcagggccagtcagagtgttagagctaacttgcctggtaccagcatattctggccaggctccaggctcctnatctagtggtcgcacgtcccgaccggcacgtggtactcccgagcctaggttccaggttggctaggttcggggtcctcgggactaggtacgtttccaaccgttcctaccgtaacccgtattaccgaaggccgtaacgtcccgttagggtaacgttcgtaacggtaaacgtaccttccgtacgttacgttaacgtttttaacgttaccgttcggttaccgtaacgtacgtttaacggttaaactttaaaaccgtttaccggtttacggggtaccccggtttagggtttaacccggggtttaccgggtaaccccgggtaaacgggggttaaaccccggtaaagggggtttaacgggaaaccgttaacccgtaaaacgggtaaccggtttacgggtaccgggtacccgtaaccggtaacccgtaacccgttagtttacccggtttacggtttacccttttaccgaaccgttttcccccg

SEQ ID NO: 46892 - DNA, 850 bp, Homo sapiens
  misc_feature: GYAE6OF02GVX2P.3.12.B01.1.454.CMB.1.raw
  modified_base (148)..(148): a, c, t, g, unknown or other
  misc_feature (148)..(148): n is a, c, g, or t
  modified_base (153)..(153): a, c, t, g, unknown or other
  misc_feature (153)..(153): n is a, c, g, or t
  modified_base (206)..(206): a, c, t, g, unknown or other
  misc_feature (206)..(206): n is a, c, g, or t
tcagagacgcactccacgaccggtgctcgatttagtagtgtagattccgcggggggaactgctcagttaggacccagacggaaccatggaagccccagcgcagcttctccttcctcctgctactctggcctcccagatatcactgganaaacngtgctgacgcagtctccagcccacctgtctgtcgtaccgtaccgaagggaaancgcccaccctctcctggcacgggtccagtaccagtaggtcgttaagactaccgtaaacttaacgcccgttacgggtaaaccacggtacctaaacgtttacgttttaccgttaccgggacccgtaaccggtccccgttaccccgtacgggttcccttaccccgttacgtaaccttaccgttaggttcgggttcgaaccttacccgtacccccggtaaccccgggtaccccttaaccggttccgggtttaaacccctccccgggtaaccggtaccccggggttaacggttaccggtacgggttaccggtacgggttaccggggttccggggttacccggttaaaccgggaacgttaaacggtcgttaacccttccggttacctaccctaccgtaactaccgacggacgtaccgtccggttaggcgtttacgaacggtaaacgtccgtacgttacgtacgtttacgtttaactagttacgacgtaagtacgtttaaacttaacgttaccgtacggttacggtccgttaacggtaccgggtccggtaaccggtaaacgaaacgtaaggggtaaccgtaacaacggaaacgtagttaccgtcggtaccacgtccctaagtaccgttcgtactttacgttcgtactcccg

SEQ ID NO: 46893 - DNA, 708 bp, Homo sapiens
  misc_feature: GYAE6OF02GSDTZ.3.12.B01.1.454.CMB.1.raw
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctcgaggggaangcccaccctctccgtncgacgggccagtcgagtagtgttagagcctaacgttagcctaggtaccagctattattctcggccaggcctcccgaggccttcctctattctagtggtcaccgactcccgaccccgggcctaacgttcgggtacctacccgacgtaccccgtagggttaccaggttgggccgtaggggtttcgggtaccgtcggtaactagggttacttacgaccttcctaccgacccattaccgaggctaaccggtcgtacgggtacgttacgtaaggtaacgtacttcggtgacctttagtttaactacgttacgtatacgtacttaggttattaacgttacgtaccgggtaccgttacggtaccgttccgggtaaaccgtaaacgggtaaacggtaacgggtaacgtaacgttaaccggaaacgtaccgtacggttaccggaaccgttagaacccgtaaccgttggtaccttaccggttcctttaccggtacgtttaccccg

SEQ ID NO: 46894 - DNA, 634 bp, Homo sapiens
  misc_feature: GYAE6OF02JLUCY.3.12.B01.1.454.CMB.1.raw
  modified_base (196)..(196): a, c, t, g, unknown or other
  misc_feature (196)..(196): n is a, c, g, or t
  modified_base (476)..(476): a, c, t, g, unknown or other
  misc_feature (476)..(476): n is a, c, g, or t
  modified_base (527)..(527): a, c, t, g, unknown or other
  misc_feature (527)..(527): n is a, c, g, or t
  modified_base (576)..(576): a, c, t, g, unknown or other
  misc_feature (576)..(576): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaacagtgctgacgcagtctccagccacctgtctgtcgtctccgagggaanacgccacctctcctgcgacggccagtccgagtagtgttagtagactaacgttagccgttaggtaccaggctatatttcgttggccacggtcctccgacggtctccgtactatcgtagtggtcgccactcccgtacccggctacgtcggtacctcccgaggtccctaggttcgaggtacggtcgacggtttgggtaccgtcgacgtagacgttcaaccgtctaccacgtctcgagacctcggacccgtgggtaactcggtaacgaaacgtccttgtacgtntttagtttaacctttgacgtcgaacgtcgtaatttaattacgtttaccggnggtacgtacgggtcctacgggaacgaaggtaaccgtaggtacaacgtanaacggtcgtgacgggtcctagacctacgtacttcgttacgtcctacgttccgtacccg

SEQ ID NO: 46895 - DNA, 698 bp, Homo sapiens
  misc_feature: GYAE6OF02HLY17.3.12.B01.1.454.CMB.1.raw
  modified_base (146)..(146): a, c, t, g, unknown or other
  misc_feature (146)..(146): n is a, c, g, or t
  modified_base (199)..(199): a, c, t, g, unknown or other
  misc_feature (199)..(199): n is a, c, g, or t
  modified_base (366)..(366): a, c, t, g, unknown or other
  misc_feature (366)..(366): n is a, c, g, or t
tcagagacgcactccacgaccggtgctcgatttagtagtgtagattccgcggggggaactgctcagttaggacccagacggaaccatggaagccccagcgcagcttctcttcctcctgctactctgctcccagatatcactggaanaaacagtgctgacgcagtctccagccacctgtctgtgtctccgaaggggaaanacgccaccctctcctggacacgggccagtcaggtacgttgttacgtagactaacgttagccgtacggtaccagtacctaattacttcgttacggacctacggcctaccgaggtcctctctatcgtatggtcgactacgtcccggtacccggctaacggttcgtaccnccgtacgcgtaacggttcgacggtcggcgtagggtcgggttacctacggtacgagttacgtacctacgtcctaacgaacctatcgaagtcaaccggtcgtaaggtcgtacgacgtaaacgtctacggtacgtacttaagtttactcgttagagacgtagtaagttaaagttaacgttacgtccgtaccgggtacggtaaccggttacccgggaacggaaacggtaaccggtaagggacgttaaacgtacgtaaaacgttccggtaggtaccgggtactacccgtaaccgtaacgtactttaccggttcgttaccgttaccgtacgttacccg

SEQ ID NO: 46896 - DNA, 759 bp, Homo sapiens
  misc_feature: GYAE6OF02I56FL.3.12.B01.1.454.CMB.1.raw
  modified_base (156)..(156): a, c, t, g, unknown or other
  misc_feature (156)..(156): n is a, c, g, or t
  modified_base (165)..(165): a, c, t, g, unknown or other
  misc_feature (165)..(165): n is a, c, g, or t
  modified_base (207)..(207): a, c, t, g, unknown or other
  misc_feature (207)..(207): n is a, c, g, or t
tcagagacgcactccacgaccggtgctcgatttagtagtgtagatttccgcgggggggtaacgtgctcagttaggacccagacggaaccatggaagccccagccgcagcttctcttcctcctgctactctggctcccagatatcactggagaaacngtgctgacncagtcctccacgcccaccctgtctgttgtcctcgagggaaancgccaccctctcctgcgacgggccagcagagtgttagacgactaacgtacgccgtagtaccaggctaatacgtttccgttacggcccaacgggccccttaccccgacggtcccttcccgttcctacgtttccctaggttcgggtacgtaccgtaccggtaccccggaaccccggggtcctaccgttccggtaccctcccgaaggtcccgtaggttcgacggttcggcgtaacggggtttcgggtcccttacgggtacgtacggtaccgttacccgaccttaccctacctaaccgtaacctcgacgcaccggtcgtacgggtacttccggtaagtaacgtccgttcgtacggaccttttaaggtttacttcgtacgttactacggtacgtaagttaaccgttagtttcccggttacgggtaccgggttaaggtacccgggttacgaaaccggtaaccggtaaacgtaaggttaccggaacttacggtaaacccggtgttaacggcggtacgttaccgcttaccgttcttccgtacgtcttaccgtacttcccg

SEQ ID NO: 46897 - DNA, 647 bp, Homo sapiens
  misc_feature: GYAE6OF02FIPE9.3.12.B01.1.454.CMB.1.raw
  modified_base (199)..(199): a, c, t, g, unknown or other
  misc_feature (199)..(199): n is a, c, g, or t
  modified_base (469)..(469): a, c, t, g, unknown or other
  misc_feature (469)..(469): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacagtgctgacgcagtctccagccaccctgtctgtgtctccgaggggaaangcccacctctcctgcagggccagtcaagtagtgttagtagccaagttagcctaggtaccagacatattcttggccaggcctcccgtaaggccttcctacattactatgggtcaccgtaactcccggacccgggtccaacgtcggtaactccccgtaacgccgtaaggtttcaggttcggctaggtcgggtactcggacaggtacgttcacttcctcgaccagtccagctacgctaggatcgtgaacgtactcgtcggacttaagtttacncttacgtacgtagacgtaagttaacttacgttacggtaccggttaccggttaggttaaccgttcgggaaccgtaaaggggaacctaaacgggttggaaaccttaccggaaacggtaaccgttggaccgggtacacggtacctacccgtataccgttaggtttccttacgacttcccgg

SEQ ID NO: 46898 - DNA, 869 bp, Homo sapiens
  misc_feature: GYAE6OF02JNSZP.3.12.B01.1.454.CMB.1.raw
tcagagacgcactccacgaccggtgctcgatttagtagtgtagattccgcggggggaacgtgctcagttaggacccagacggaaccatggaacgccccagcgcagcttctcttcctcctgctactctggctcccagatatcactggagaaacagtgctagacgcagtcctccacgcccaccctgtctggtcgtcctaccgaagggggaaacgacgcccacccgttctccgtcggaccgacgggccgtagtccgaaggtaggttacgttacggtacgacctaacgttacggcccttacgggtaccaacggcctaatttacgtttccgttacgggacccgtacgggtaccccttaccccggacgggttccttaccccgttagactttaccgtttaggtccggttcgacccttaccggttacccccggaacccccgggggtactacccgttacgggtaaacccctccgtaaccgggtcccgttaaggggtttccgaacggttccgggtagtaacgggggttttcgggggtacctacccggggtaaacggcgggtttacgtttaacccctcggtttaaccccgcaaacccgtaactcgaaaccgggccgtaccggtaccggttagggttaaccgttacgtaacgggtaacccgtaaccgttccggtacggttacgtttaacgtttacttacgttacgtacgtacgtaacgtacttaagtacttaacggtccggtacggttaccgggtacggttaccggtaaccggaaagggtaacgtaacgggtacgtaactaacgggtaaccgtaacggttcgtaaccgggtcttaccgaacgttaccgacgtttcgtacgttccttaccgttccgttaccg

SEQ ID NO: 46899 - DNA, 842 bp, Homo sapiens
  misc_feature: GYAE6OF02I9DQP.3.12.B01.1.454.CMB.1.raw
tcagagacgcactccacgaccggtgctcgatttagtagtgtagattccggacgggggggggaactgctcagttaggacccagacggaaccatggaagccccagcgcagccttctcttcctcctgctactctggctcccagatatccactggaagaaacagtgctgacgcagtcctccacgcccaccctgtctgtctctccgaaggggaacacgccctaaccctcgtacctgacgacgggcccagtacacgtaggttggttaacggtacgaactaaccttacggacccgtaggtaaccctagcctaatttaagtttccgtttcgggaccgtacggtcccttacccgaacgggtcctacccgtaccctaacttccgttaaggttggtccgtactaccgttacccggaccccgggcttacggtcggtaccttcccgacgtccgtacggttacgcggttacggcgtacggtcgggtctacggacgtacggtacgttacacgtttcaaccgtaacctcgtaccggacgtaccgaccggtaccgtacgggtacggtttacgaacggttaacgtaaccgttccgttaccggtaacgtttacgttttaaccgtttacgtacgttacgtaacgtacgtaacgttttaacgttaaccttaccgggtacgggttcccggttacggggtaaccggtttacccgggaaccggttaaacggggtaaaccgtaagggggttaaccgaaccgtttaaccgggtaaaaccgtcggttaaccggtacgggttaaccctcggttaaccgtaccttacggtttacccggttctttacccgtacggtttaccctttacccccg

SEQ ID NO: 46900 - DNA, 932 bp, Homo sapiens
  misc_feature: GYAE6OF02IGJ0Z.3.12.B01.1.454.CMB.1.raw
tcagagacgcactccacgaccggtgctcgatttagtagtgtagattccgcgggggggaactgctcagttaggacccagacggaaccatggaagccccagcgcagcttctcttcctcctgctactctggctcccagatatcactaggaacgaaacaggtcgcttaggaccgctacgtcctccgacgacccacccgttgtccgttgtcgttaccgtaccgggaagggggaaactaccgccccgtaacccttccgttacccgtacggaccggtaaccgggtccgtacggtacgaacggttacggtttacggtaacggtaccgttaaccttaacgggtttaccgtccggtaaccggggttaaccacgggtacttaacgttttaaccgtttccggttaccgggtaacccgacggtccccgttaccccgaagggttccccccttacgtacccttattaccgtttaggcggttctaccgtacccgttaccccgggaccccggtacgttacgtacggtcctacccgtcgtaccggtagttccgtaagggtacgtcggtggttaccggttcgaccgaacgtagtaccgttccaccgttccgtacaccgtacgtccgagtacgcgtccggtaggtcgtaacgtcgtaactcgtactaccggtagtttacctttagtacgttactaaccggacgtttacgtttaaacgttacgtttaacgttaccgggtaccggttaccgggttaacccgggttaccgggttaacccgggtaaacgggtaaccgggttaaacccggtaacgggggttaaaccgtaaccgttaaaaccgggttaaccgggtaaaccggtttccgggttaaccgtaacggtttacccgaaccggttccgttaacggttttcccgtttacgggtttaccctttacccgggttacccgtttacccgg

SEQ ID NO: 46901 - DNA, 580 bp, Homo sapiens
  misc_feature: GYAE6OF02IXW5N.3.12.B01.1.454.CMB.1.raw
  modified_base (151)..(151): a, c, t, g, unknown or other
  misc_feature (151)..(151): n is a, c, g, or t
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
tcagagacgcactccacgaccggtgctcgatttagtagtgtagattccgcggggggaactgctcagttaggacccagacggaaccatggaagccccagcgcagcttctcttcctcctgctactctggctcccagatatcactggagaaacngtgctgacgcagtctccagccaccctgtctgtgtctcaggggaaangccaccctctcctgcagggccagtcagagtgttagtagctaacttgcctggtaccagcatattcttggccaggctcccaggctcctcatctagtggtcncatcccgacccgggccacgtggtactcccagccaggttcagtgcaggtcgggtctcggacagagttcactcgtaccaccatccgagcacgtcctgggactcgtgaacgtactctcggacttaggtttattaccgtgttcacgtactaagttattaagttacgtcggccgttgggtaccggtttcggaaccgtaacgggaacctaagggtaacgaagtaccgaaaacggtacgtaggtacggtctacgacgtaaccgtgttccgttgtacttacctagttccccg

SEQ ID NO: 46902 - DNA, 769 bp, Homo sapiens
  misc_feature: GYAE6OF02FWGL3.3.12.B01.1.454.CMB.1.raw
  modified_base (165)..(165): a, c, t, g, unknown or other
  misc_feature (165)..(165): n is a, c, g, or t
  modified_base (213)..(213): a, c, t, g, unknown or other
  misc_feature (213)..(213): n is a, c, g, or t
tcagagacgcactccacgaccggtgctcgatttagtagtgtagattccgtcggggggtaacgtgctcagttaggacccagaccggtaaccactggaagcccccaaggccgtccagtcgttctcttcctcctgctactctggctcccagatatcactggagaacgngtgctgacgtcagtctccagtccacctgtcctgtgtctccaggggaanagccacccgtgtcctgcgagggcctaggtccagacgtgggttacgtaggctaacttacgcccttgggtaccagcgactattcttggcctaggtccttacccgaggtcttccgtcagtcctagtggtcgcagtcccgaccccggggcaccgtggtacgtcccgacgaccgtaggttacaggtcgacgtaggttggggtacctacgggaacgaaggtacgtttacgacgttccgtacctaacccgtagtaccgaacgggccaacggtcccttacgggacttcccgttacggaaacgttacccgttacctacgacccgtttaaaggttttaactttacccgttagttaccctagtacctaaagttaaactttaacgttaaaccgttggggtaccccgtttaggggaaccggtttacccgggacccggtaaacggggaaccccgtaaggggtaccggtaaacgttaccggtaaaaccggttaacgttcgggttacgggaccgttacggacgtaacccgtaagttcccggtaccggtttaccgtttacgaccgtttcccgg

SEQ ID NO: 46903 - DNA, 659 bp, Homo sapiens
  misc_feature: GYAE6OF02HBXQK.3.12.B01.1.454.CMB.1.raw
  modified_base (199)..(199): a, c, t, g, unknown or other
  misc_feature (199)..(199): n is a, c, g, or t
tcagagacgcactccacgaccggtgctcgatttagtagtgtagattccgcgggggggaactgctcagttaggacccagacggaaccatggaagccccagcgcagcttctcttcctcctgctactctggctcccagatatcactggagaaacagtgctgacgcagtctccagccacctgtctgtgtctccgaggggaaancgccacctctcctgcagggccagtcagagtgttagagcaacttagccgtggtaccagcattattcgtggccaggcctccgaggcctcctacatctagtggtcgactacgtcccggaccccgggctacgttcggtacctcccgaggtcccgtacggttccaagggtcggtaccgtaggggttccgggtcgtacggaacgtacggtacgttaccacttcctaccgaactacgtcaacggtcacgccgttaggactcgtagaacgtacttcgtacgtcgttagtttactactcgttacgacgtcgtaattaagttaacgttccgtggtaccggttaggtaccgttccgggaacggaaacggtacgtaagggtacggaacttaccggtaaaacgtcggttacggttacggacgttacgaacctaccgtagttccgtaccggtttccttacgacccgtttccccg

SEQ ID NO: 46904 - DNA, 658 bp, Homo sapiens
  misc_feature: GYAE6OF02HA8AC.3.12.B01.1.454.CMB.1.raw
  modified_base (147)..(147): a, c, t, g, unknown or other
  misc_feature (147)..(147): n is a, c, g, or t
  modified_base (152)..(152): a, c, t, g, unknown or other
  misc_feature (152)..(152): n is a, c, g, or t
  modified_base (204)..(204): a, c, t, g, unknown or other
  misc_feature (204)..(204): n is a, c, g, or t
  modified_base (284)..(284): a, c, t, g, unknown or other
  misc_feature (284)..(284): n is a, c, g, or t
  modified_base (397)..(397): a, c, t, g, unknown or other
  misc_feature (397)..(397): n is a, c, g, or t
  modified_base (627)..(627): a, c, t, g, unknown or other
  misc_feature (627)..(627): n is a, c, g, or t
tcagagacgcactccacgaccggtgctcgatttagtagtgtagattccgcgggggggaactgctcagttaggacccagacggaaccatggaagccccagcgcagcttctcttcctcctgctactctgctcccagatatcactggaanaaacngtgctggacgcagtcaccagccaccctgtctgtgtccacggaaggggaaacncgccctaacctcgtcctaggacgacgggcctagtcgaggtacgtagttagtacgactaaaacgttcgccgttaggaaccngtacctattattcgtggacctaggccctccgaggtccttaccgtctaacgttcgttacgtggtcacctacgccccggaccggcctacggtcgacctccgaagtcccgtagtcnggtgacgtgggtacgccggtaaggatcggtattccacttcaaccgtacactacgacgacgtcgtacgtacgggtactacggtactaaagtccttacggttcgtaagttacgtttacgttaacggtcgtacgtacgtaggtaacttacgttagtacgtcggtacggtacgtaccggtagacgggaacgtacgagggtacaagtacgaacggtctagacggtacacgtaccncgttactcgtacgttacctcgtacttacccg

SEQ ID NO: 46905 - DNA, 532 bp, Homo sapiens
  misc_feature: GYAE6OF01B4AI2.38.16.B05.1.454.CMB.1.raw
  modified_base (527)..(527): a, c, t, g, unknown or other
  misc_feature (527)..(527): n is a, c, g, or t
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccgtggggggccgttcaccatcaccagagacaactccaggagcacactatatctacaaatgcacagcctgagagtcgaggacacggccgtgtattattgtgcgagagatccccaaggtgaccaccttggtgcttttgattttctgtggccaagggacaatggtcaccgtctcttcagcctccaccaagggcccatcggtcttccccctggccgccctgcctccaggacgcaccctccgagacgcacagccggcccgtgggcctgcctggtcgaaggtactacgttccacgtgactcgactgcgcgggntcggg

SEQ ID NO: 46906 - DNA, 754 bp, Homo sapiens
  misc_feature: GYAE6OF01B7K5Q.38.16.B05.1.454.CMB.1.raw
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccagggaaggggctggagtgggtctcagcaattaatgggtaggggtgattcaccatattacgcagactccggtgggggccgttcaccatcaccagagacaactccaggagcacactatatctaacaaatgaccacagcctgagagtcgaggacacgggccgtgtattattgtgcgagagactccccgaaacggtgaaccctaccgtttgggtcgttcctttttaggactttttctgggtacgggtacccgaaaaggggtacctaaagttcggggttaccctaacccgggtttccttaccgtttccaaccggtcccccttaccccgaaaccccgtaaaccgggggtcccccctaaaggtttcccccggggttaccccttttccccccccggtcggggccccgtccccccgttcggtccccgttacccgaacgggtaccgcccgtaaccccgttacccggaacggacgtacccgaaccgacggcccggtccccgtggggcccttcggcccgttagggtaccgtaaacgggtaccttaacccgtttcccgaaccggttgaaccgttaccggaccgttagggaaccgggtccggggtcggtacggg

SEQ ID NO: 46907 - DNA, 584 bp, Homo sapiens
  misc_feature: GYAE6OF01BGW41.38.16.B05.1.454.CMB.1.raw
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccaggggaaggggctgggagtgggtctcagcaattaatgggtaggggtgattcaccatattacgcagactccggtggggggccgttcaccatcaccagagacaactccaggagcacactatatctaacaaatgcacagcctgagagtcgaggacacggccgtgtattattgtgcgagagatccccaaggtcgaccaccttgggtgtctttttgattttcgtgtcggaccaagggacaagtggtccaccgtctcttcacgcctccaccgaacgggcccagtccggtccttcccccgtggcccgccctcgccctccgaggacgccacccgtccggagacgccacacggccgggcccgtgggcctcggcccgtggtacgaacggtacctaccgttccgacgttgacgtcggacgtaggacggccgggcgtcgggg

SEQ ID NO: 46908 - DNA, 716 bp, Homo sapiens
  misc_feature: GYAE6OF01BF871.38.16.B05.1.454.CMB.1.raw
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccgccaggctccagggaaggggctggagtgggtctcagcaattaatggtaggggtgattcaccatattacgcagactccggtggggggccgttcaccatcaccagagacaactccaggagcacactatatctaacaaatgcacagcctgagagtcgaggacacggccgtgtattattgtgcgagagtactacccgaacggtcgaccctaccgtttggtagtccttttgtattttccgtggttacggaccgaaaggggtacctaaagttcgggtacctacccgttctccttcgacgtccctacccgaacccgtaacgggcccctaacgttcccggttccctttcccccccgtcgggtccccgtccccgtccgtcccgtaccccggagggtaacccgacccgaaccccgttacccggaacggaccggacccgtaaccgaccgggccccgggtccccgtggggtcccgttccggacccggttcgggtaacccgaaacgggtacccttaacccgttcccgaccggttacgtaaccgttccggaacgttacgggaacgggtccggggtcgtaccgggg

SEQ ID NO: 46909 - DNA, 718 bp, Homo sapiens
  misc_feature: GYAE6OF01CFY35.38.16.B05.1.454.CMB.1.raw
  modified_base (277)..(277): a, c, t, g, unknown or other
  misc_feature (277)..(277): n is a, c, g, or t
tcagtcgatcacgtcacgaccggtgctcgatttagagctcacgtatttgggtttgggctgagctggtctttttcttgtggcttaattttaaaaggtgtccagtgtgaggtgcaggtgtcggagtctgggggaggcttggttcagccgtggggggtccctgagactctcctgtgcagtctctggtatttaacctttagtgactatgccatgatcgtgggtccgcaggctccgaggggaagggctggagtgggtctcagcaattaagtgggtaggggtnattcacctatattacgcagaccgtccgggtgggggtccgttcaccatccaccgagacgacaaccgtccgaaggacgaccaactactatactctaacaaatcgacacagtcctaggacgtaggtccggaaggaccacgggtcccgttagtttaagtttagttcgggtcggacggtaaggaacgtaccgtaccccgtaacgggtacgaacccgttaccgtttgggttcgttcgtttttgttacgttttcgtggttcggaccgtaagggactaaggttcggtacctacccggttcctcccgtacgtaccgtccctacccgaacccgaaccgggtcccgtaccgttacccggttccccgttccccccgtcggtaccccctccccgttcccctaacccgtaaccggtacgacccgtacccgttccggtcgggggccctaacccggg

SEQ ID NO: 46910 - DNA, 649 bp, Homo sapiens
  misc_feature: GYAE6OF01A69R5.38.16.B05.1.454.CMB.1.raw
  modified_base (640)..(640): a, c, t, g, unknown or other
  misc_feature (640)..(640): n is a, c, g, or t
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccagcctccagggaagggctggagtgggtggccagcattaaccaagatggacgtagaaaaatactatgtggactctgtgaagggccattcgccatcctccagagacaacgccaagaactcactgtgctgcacatgaacgcctgagaggcgacgacacggctgtgtacttctgtgcgagaccgcccccacgtggacgggacctacgagggtcgggacgtacgtaaccgtaacttttggaaccgttacggtcgggggacccgaacggggtaacccccttgggtaccgtacccggtccttccctccgaccgccccgtacccgaacccgaacgggcccctacgttcccggttcccgttccccccgtcggccctacccctccctacccgaacgaccgtcccacccgtccggtcggggacctacgacggccgccgtcgggccgtaccggccgtacggtccgaaggtaccttacctaccgtacgtcgtacgtacgacgtggngggcggtcg

SEQ ID NO: 46911 - DNA, 816 bp, Homo sapiens
  misc_feature: GYAE6OF01DX4SP.38.16.B05.1.454.CMB.1.raw
  modified_base (261)..(261): a, c, t, g, unknown or other
  misc_feature (261)..(261): n is a, c, g, or t
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccagggaaggggctggagtgggtctcagcaattaatggtagggtgattcaccatattacgcagactccggtggggggccgttcaccatcaccagagacaactccaggancacactatatctacaaatgcacagcctgagagtcgaggacacggccgtgtattattgtgacgagagactaccccgaagggtcgaacctaccgtttgggtgtctttttgactttttctggtcggacccaaaggggacctaaagttcgggttaccaacccggtttcttaccgtttaccgacggtacccctaccccgtaaaccccgtaaaccgggggtaccccctaaacgttcccgggttaccccgttttcccccccccgttacggggtcccccggtccccccgtttacggtcccctttaccccgaacggggtaaccggaccccgtaaacccccgttaccccgggaaaccgggaaccgggtacccgaaacccgacgggtaccccggggtaccccccggttacggggggaccccgttaccgggtccccgtttacggggttaccccggtaaaaacggggtaacccgtttaacccgtttaccccgaaaccgggtttcggaaaccgtttcccgggaaaccggttacgggaaacggggtcccggggggtccggttaccggggg

SEQ ID NO: 46912 - DNA, 646 bp, Homo sapiens
  misc_feature: GYAE6OF01DG5QJ.38.16.B05.1.454.CMB.1.raw
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccgccaggctccgagggaaggggctggagtgggtctcagcaattaatggtaggggtgattcaccatatacgcagactccggtggggggccgttcaccatcaccagagacaactccgaggacgcacactatatactaacaaatgacacagcctggagagtacgaggacacggccgtgtattagttgtgagagagactcccgaacggtgaccaccgttggtcgtcttttgattttctggtcggaccgaagggacaagttcggtaccaccggttctcgttccagtcccctaccgaccgtaacgggcccctagttcccggttaccccgtttcccccgtcgggcccgtcccccgtggtcccttcccgaacggaccgccctaacccgtccggagaccgccgaacgacggccggtcccgcgggtcctcggcccgttgggtaccgaaacgggtacttaccgttacccacggttcgaacgtcggaacgtgggacggtccggggtgtacgggg

SEQ ID NO: 46913 - DNA, 643 bp, Homo sapiens
  misc_feature: GYAE6OF01A1BJW.38.16.B05.1.454.CMB.1.raw
  modified_base (372)..(372): a, c, t, g, unknown or other
  misc_feature (372)..(372): n is a, c, g, or t
tcagtcgatcacgtcacgaccggtgctcgatttagagctcacgtattgggtctggggggaggcttggttcagcctgggggggtccctgagactctcctgtgcagtctctggattaacctttagtgactatgccatgatctgggtccgccaggctccaggggaaggggctggagtgggtctcagcaattaatggtaggggtgattcaccatattacgcagactccggtggggggccgttcaccatcaccagagacaactccaggagcacactatatctacaaatgcacagcctgagagtcgaggacacggccgtgtattattgtgcgagagatcccaacggtgaccaccgttggtcgtcttttgtacttttcnggtggaccaaggggacaagtggtcaccgttctcttcacgcctccaccgaacgggcccacgtccggttacccttccccctcgggcccgtccccgtcgccgtacccgacgggaccgcccacccgtacccggaggacgacaccgacggcccgggcccgtcggggtcctcggtcccgtcgggtaccgtaaaccgggtaccttaacccgttccccgaaccggttcggaacgttaccggaccgttacggggacgggtcccgggggtcgtaccggggg

SEQ ID NO: 46914 - DNA, 741 bp, Homo sapiens
  misc_feature: GYAE6OF01BI4ZT.38.16.B05.1.454.CMB.1.raw
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccaggggaaggggctggagtgggtctcagcaattaatgggtaggggtgattcaccatattacgcagactccggtggggggccgttcaccatcaccagagacaactccaggacgcacactatactctaacaaatgcacagcctgagagtcggaggaccgacggccgtgttatttagttggtgcgagacgactaccccgaacggtcgacctaccgtttgggtcgtcgtttttgactttttcgtggtcggacccgaaaggggaactaacggttcgggtccctacccggtttcttcccgtttacgaccggtccccttaccccgaacccggtaaaccgggtcccctaacggttccccgggtttaccccgtttcccccccgtcggggtccccgtcccccgttgtccccgttacccggaacgggtcgacccctacccgtaccggaacggtaccgaccgaaccgaccgggcccgggtccccgtcggggtacccgtcggttacccgtcggggttaacccgtaaacgggtaccctttacccgttccgtaacggttacgtaacggtccgtacgtacgggacggtccggggcgtaccgggg

SEQ ID NO: 46915 - DNA, 626 bp, Homo sapiens
  misc_feature: GYAE6OF01CMKOB.38.16.B05.1.454.CMB.1.raw
  modified_base (523)..(523): a, c, t, g, unknown or other
  misc_feature (523)..(523): n is a, c, g, or t
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtgattcaccatattacgcagactccggtggggggccgttcaccatcaccagagacaactccaggagcacactatatactaacaaatgacacagcctgagacgtcgaggacacggccgtatattattgcgacgagagactcccgaaacgggtcgaccctaccgtttggtcgttactttttgactttttcgtgggtcggtacccgaaagggtactaaagttcggtaccaccgttcttccttacgtaccgtccctaccgaccgtaacgggcccctacggttccggttacccttcccccgtggtcccgcccgtcgcctccgaggaccnccgacctccgagacgaccacgacgcccggccgtcggctcgccgtggaccgaacggtacctaccgttccgacgtgactcgacgtaggacggccgggtcgtcggg

SEQ ID NO: 46916 - DNA, 826 bp, Homo sapiens
  misc_feature: GYAE6OF01CUVMS.38.16.B05.1.454.CMB.1.raw
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccgagggaaggggctggagtgggtctcagcaattaagtggtaggggtgattcaccatattacgcagacgtccggtcggggggccgttcaccgatcacagacgacaactccgaggagcacactatactctaacaatcgacacacgtcctagagacggtacggaacggtaccgaccggtccgttagttaactttagtttggtcggacgaacggtaacgtaccgtaccccggtaaaacgggtcgtaacccctaaccgtttggggttacgttacgtttttacgtacgtttttcgtcgggtcggtaacccggaaaggggtaactaaacggttcggttacccgaaccgggtttcttacccgtttaccgaccggtacccccttacccgaaacccggtaacggggtacccctaacggtttaccccgggtcccctttccccccgtcgggtcccgtacccccgttcggacccttaccccggacgggggtaacccaccccgtaaccccggtacccgggaaccgaccgggacccgtaacccggacggtccccgggtcccggtaacggggcccgttccgggtccggttacggggaaccgtaacgggtaacccgttacccgtaccccggttaccggttaagtaccttcgggtaacgtacggggtacgggcccggggtcggtaacgggg

SEQ ID NO: 46917 - DNA, 772 bp, Homo sapiens
  misc_feature: GYAE6OF01DOJNN.38.16.B05.1.454.CMB.1.raw
  modified_base (145)..(145): a, c, t, g, unknown or other
  misc_feature (145)..(145): n is a, c, g, or t
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccncaggctccagggaaggggctggagtgggtctcagcaattaatgggtagggtgattcaccatattacgcagactccggtggggggccgttcaccatcaccagagacaactccaggacgcacactatatactacaaaatgacacagcctgagagtcggaggacacggccgtgtattattggtgcgtaggagtactccccgaaggtcacctaccgtttaggtcgttctttttgaacttttccgtggtacggacccgtaaaggggacctaaaggttcggtaccaacccggtttcttaccgtttccgaacgttcccccgttaacccgaacccggtaaacgggtccccctaacggttcccgggtttcccccgtttacccccccgttggggtcccccgtacccccgttcgggtaccccttacccgaacggggacctacccgtaacccccggttaccggaacggtaaccgccgaaaccggacggtcccgggtaccccggtggggtcccgttcggaccccggttacgggtaacccgtaaacgggttaaacccttacccgtttacccgtaaccgggttcggaaccgtttaccgggaacccgttagggaaccggggttccgggtccgttaaccggggg

SEQ ID NO: 46918 - DNA, 792 bp, Homo sapiens
  misc_feature: GYAE6OF01DRDQT.38.16.B05.1.454.CMB.1.raw
  modified_base (189)..(189): a, c, t, g, unknown or other
  misc_feature (189)..(189): n is a, c, g, or t
  modified_base (787)..(787): a, c, t, g, unknown or other
  misc_feature (787)..(787): n is a, c, g, or t
  modified_base (789)..(789): a, c, t, g, unknown or other
  misc_feature (789)..(789): n is a, c, g, or t
  modified_base (791)..(791): a, c, t, g, unknown or other
  misc_feature (791)..(791): n is a, c, g, or t
tcagtcgatcacgtcacgaccggtgctcgatttagagctcacgtattgggtctggggggaggcttggttcagcctgggggggtccctgagactctcctgtgcagtctctggatttaacctttagtgactatgccatgatctgggtccgccaggctccgagggacgggtctgggagtgggtctcacttancagtaatagtggtgtaccacattcgacgcagactccgtgaacgggcccgttcaccatcctccagagactaataccaagaaccacactactacctgacaaatcgaacgaccctgaagacgtccggaggacgaccggaccaatattacttacgtgtggtagggaaaggggcggacggggtcgaccgttccggtcgggaccggaccggtaaccccgtggtcccgtacccggttcccttccctaccggtaccgtccccgtacccgaacccggaaaccgggcccctacgggttcccggtttacccgttccccccgttcgggaccccctaccccgttacccctaacccgtaacggaaccgtaccccgtaacccggttcccggggttacggggggacccgaacgtaaccccggggtccccgggttaccccggttcggggtcccgttcccgggtaacccgggtttccggtaaccgggtaacccggttaacccgtttacccgtacccgttaaccgggttacgacccggttaccggtaacggcgggaccgggtaccgggtaccgggtacggaccggggaaccggccggtaaacctggacgcgacagcngngng

SEQ ID NO: 46919 - DNA, 210 bp, Homo sapiens
  misc_feature: GYAE6OF01CN2QC.38.16.B05.1.454.CMB.1.raw
  modified_base (155)..(155): a, c, t, g, unknown or other
  misc_feature (155)..(155): n is a, c, g, or t
  modified_base (177)..(210): a, c, t, g, unknown or other
  misc_feature (177)..(210): n is a, c, g, or t
tcagtcgatcacgtcacgaccggtgctcgatttagagctcacgtatgggtttggggggaagaggaagactgacggtcctgctccgaggagcacctccgagagcacagcggccctgggctgccctggtcaaggctagttccacgtgatcgactgancgggctggcaaggcgcatagcnnnnnnnnnnnnnnnnnnnnnnnnnnnnnnnnnn

SEQ ID NO: 46920 - DNA, 731 bp, Homo sapiens
  misc_feature: GYAE6OF01D33M1.38.16.B05.1.454.CMB.1.raw
  modified_base (151)..(151): a, c, t, g, unknown or other
  misc_feature (151)..(151): n is a, c, g, or t
  modified_base (217)..(217): a, c, t, g, unknown or other
  misc_feature (217)..(217): n is a, c, g, or t
  modified_base (277)..(277): a, c, t, g, unknown or other
  misc_feature (277)..(277): n is a, c, g, or t
  modified_base (721)..(721): a, c, t, g, unknown or other
  misc_feature (721)..(721): n is a, c, g, or t
tcagtcgatcacgtcacgaccggtgctcgatttagagctcacgtattgggtctgggggaggcttggttcagccgtggggggtccctgagactctcctgtgcagtctctggtatttaacctttagtgactatgccatgactcgtcgggtccnccgaggcctcgaagggggaaggggtctgggaggttgggtctcagactaagttaagtgggtagggtnacttccactatatacgcagacgtcgggtgggggcctcacatcacagacacactcgagacncaactcgtatataccaaacaagtcaccaacgctcgtaggacgtacggtacggaacggaccggaccggtccgttagttaatttacgttggacgacggtaagaacgtaccgtaccccgtaacggttccgaacccgtttacgttgggtttctttcgtttaggttcgttacgttaggtaccggaacggtaaagggtactaaggtccggttaccctaacgttccgttctcgaccgtcccgtaccgaacccgtacggtacccgtacgtccccgtccccgtttcccgcggtccccgttcccgtccgacccgtacggtaccggacctacccgtacccggtacgaaccggcctaccgaccggccggtaccgcccgggtcggtccgtccgtccggttaggtacgtaacccgttcgtaaccttccggacgtacggacgttcgaacgcggacgggngacggtacgg

SEQ ID NO: 46921 - DNA, 782 bp, Homo sapiens
  misc_feature: GYAE6OF01CSVYC.38.16.B05.1.454.CMB.1.raw
  modified_base (217)..(217): a, c, t, g, unknown or other
  misc_feature (217)..(217): n is a, c, g, or t
  modified_base (295)..(295): a, c, t, g, unknown or other
  misc_feature (295)..(295): n is a, c, g, or t
tcagtcgatcacgtcacgaccggtgctcgatttagagctcacgtattgggtcgtggggggaggcttggttcagccgtgggggggtccctgagactctcctgtgcagtctctggtattaacctttagtgactatgccatgatcgtgggtccgcgaggctaccgagggggaaggggcgtgggaggtggggtctcagctaaagttaagtgggtaggggtntattcacctattatacgcgaggaccgtccggggtcggggggacccgttcaaccataccaaccaggaacaacctaaccnccgaagggacacaactaactaatactactaacaaatgacacagcctagaggacgtcgaacggacgacggtcgtagtattagtgtgacgaaggagacctacccgaacggcgaaccgtacgttgggtcttcgttttagtacttttcgacgggtaggaccgaaaaggtacctaaggttcggtaccaccgttctaccttcgaccgtcccctaccgtaaccgaaccgggtccctacggttcccggttcccgtcccccggtggccccgtcccgtcgtacccgtacggaacggaccccgaccgttaccccgggaaccggtacggaaccgtacgaaaccggccgggtaccccgggtcccggtcgggacctaccgggtcccggttaacggttaaaccggaaacccgggttacccttaaccggttccccgtaaaccgggtgtaaaccggttcccgggaggttaaccggggaaccgggccggggtccggtaacggggg

SEQ ID NO: 46922 - DNA, 779 bp, Homo sapiens
  misc_feature: GYAE6OF01B175X.38.16.B05.1.454.CMB.1.raw
  modified_base (203)..(203): a, c, t, g, unknown or other
  misc_feature (203)..(203): n is a, c, g, or t
tcagtcgatcacgtcacgaccggtgctcgatttagagctcacgtattgggtctgggggaggcttggttcagcctgggggggtccctgagactctcctgtgcagtctctggatttaacctttagtgactatgccatgatcgtgggtccgccaggctccgaggggaagggctggagtgggtctcagctaattagtgggtagggtnacttcactatatacgcagaccgtcggtgggggccgttcaccatcacagacgacactcgagacgcaacactatatactaacaaatcgacctaacgacgtccgttaggaacgtacggtacggaacggaccgtaaccggtccgttagttacgtttagttggcgtacgagacgtacgtaccccgaaggtcgaaccgttacgttggttacttcttttgtagtttcctggacggtaccgaaagggacttagtcgtaccgtaccgttcttaccgttacgaccgtacccgtaccgaaacccggaccggtaccccgtaacggttccccgggttcccccttccccggtaccgggtccctacccccgttacgaccccgttaccggaacgggtacccgtcccgaacccgtaccggaaccggaccgtaccaaccggtccgggtccccgggtacccgtcggggtccccgtcgggtacccgtaccggggttaaccgtaaacccggtacccgttaccccgtttaaccccggacggttaacgacccggtttaaccggacggtttacgggcccgggtgggaccccgggtacggg

SEQ ID NO: 46923 - DNA, 938 bp, Homo sapiens
  misc_feature: GYAE6OF01COE5Q.38.16.B05.1.454.CMB.1.raw
  modified_base (911)..(911): a, c, t, g, unknown or other
  misc_feature (911)..(911): n is a, c, g, or t
tcagtcgatcacgtcacgaccggtgctcgatttagagctcacgtattgggtctgggggaggcttggttcagcctggggggtccctgagactctcctgtgcagtctctggactttaacctttagtgactatgccatgatcgtcgggtccgccaggcctccggaagggggaaggggcgtgggaggtgggtctacgacgtactaaagttaaggtggggtaggggttatacttaccaaccgtaatttacgttacgacgacggtacccggttcccgggggtcggggggggttacccgttaccaacccgtaatacccgaaacccgaaggtaacgtaacccgaaaccgtaccggaaggggaccaaccaaccttaacttattaactactaaacaaacgtcgaaccacgacggccgtaggacgtaaggaccggaacgaaccgtcggtaccgttagttagttaagttgacgggagacggtaacgtacctaccggtaaccgggtccgtaacctttaccggtttgggttactttacgttttacggtttagttttccggacgggtacggtaaaccgggtaacggtacgttaaaccggttcggtaaccccgttaccggtttccttaccgttaacccgtaccggttaccccgtaaccgaaccccgggtacccggttacccgttacccgggtttccccgtcccccgtttacccccggtaccgggtcccgttccccgtacccggtcctaacccggggtacgtaaccccggtccctaacccggaacgggaccgaacccgggaaccgacgtaacccggggtcccggttacccgggccgggtaacgttcccgggaaccggttacggaacccggtaaaccggttcccttaaccccgtaccgttacgggtacctaacggtcccgttaacgggnggtaccgggcgggttaacggtaccggg

SEQ ID NO: 46924 - DNA, 621 bp, Homo sapiens
  misc_feature: GYAE6OF01DLM9L.38.16.B05.1.454.CMB.1.raw
  modified_base (217)..(217): a, c, t, g, unknown or other
  misc_feature (217)..(217): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
  modified_base (493)..(493): a, c, t, g, unknown or other
  misc_feature (493)..(493): n is a, c, g, or t
tcagtcgatcacgtcacgaccggtgctcgatttagagctcacgtagtttggggtttgggcgtgagctggtcgtttttcttggtggctatttttaaaaggtgtccagtgtgtaggtgcagggtgtcgggagtctgggggaggcttggttcagcctggggggtccctgagactctcctgtgcagtctcgtggattaacctttgtgactatgccatgatntgggtccgccaggctccagggagggctggagtggtctcagcaagttaacnggtacgggtgacttcaacatattacgctagactcggacgggggtcgttcacgntccaccagactacacctcacgggntcacagtgtanactacaatgcacagtccgtggtagaggtacgaggacncggctcgtagttactgtgngangactccgacgngacacttgcgttcgtttgtattcgtagtggctaagggactacgttcgaccgttaccgtcttcgtaccncgtccctacccgaaccggtaaccggccgtaacgttccgggtcccttcccccggtaggtcccggtccccgttacggccctttacccgggacggtaaccgcccgtaaaccctcccgggtcgaaacccggg

SEQ ID NO: 46925 - DNA, 648 bp, Homo sapiens
  misc_feature: GYAE6OF01BRJJL.38.16.B05.1.454.CMB.1.raw
  modified_base (147)..(147): a, c, t, g, unknown or other
  misc_feature (147)..(147): n is a, c, g, or t
tcagtcgatcacgtcacgaccggtgctcgatttagagctcacgtattgggtctgggggaggcttgggttcagcctgggggggtccctgagactctcctgtgcagtctctggattaacctttagtgactatgccatgatctgggtccncaggctccagggaaggggctgggagtgggtctcagctaattatgggtagggtattcacatatacgcagacctccggtggggggccgttcaccatccaccagacgacaactccgaggagcacactatatctacaaatgacacacgcctgagacggtcgaggacacggccgtgttattagttggtcgacgagtacgactacccgaacggtcaacccgtcgtttgggtcttcgtttcgtatttcgtggtcggacgaacgggtactagttcggtctaccgttcttctcgacgtcctaccgaccgtaacggccctacgtccggtccccttccccgcgggtccccgtccgtcggtccctaccggtacgaccgccctacccgtccggaacgccgtaccgaccgaccggcccggtacccgtcgggcctccggtaccgtagggtaccgaaccgggttacttacccgtaccgacggtcaccgtcgacgtaggaccggtcgggtagaccggg

SEQ ID NO: 46926 - DNA, 695 bp, Homo sapiens
  misc_feature: GYAE6OF01CP4PE.38.16.B05.1.454.CMB.1.raw
  modified_base (312)..(312): a, c, t, g, unknown or other
  misc_feature (312)..(312): n is a, c, g, or t
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccgccaggctccaggggaaggggctggagtgggtctcagcaattaatggtaggggtgattcaccatattacgcagactccggtggggggccggttcaccagtcaccagagacaactccaggagcacactaatatctaacaaatgacacacgcctagagagtcgaggacncggccgtgtatttagtgtgcgaagagactaccccgaaggtcgacctacctttagggtgttccgttttgtacttttctggtggtaccgaaggggtaacaaacgtggtacctacccggttcttcccgtttacgacgtccccgttacccgaacccgtaaacgggtccccaacgtttacccgggttccctttccccccggagggttccccgaccccgttcggccctaccggaggtaccgccctaacccgtcggaagtaccgccacgacggcccggtaccgtcgggtcctacgggcccgtcgggtaccgaaacgggactttaacccgttcccggaccgttaagtacgtacccggacgtaccgggacgggtcccgggggtctacggggg

SEQ ID NO: 46927 - DNA, 660 bp, Homo sapiens
  misc_feature: GYAE6OF01D77J7.38.16.B05.1.454.CMB.1.raw
  modified_base (490)..(490): a, c, t, g, unknown or other
  misc_feature (490)..(490): n is a, c, g, or t
  modified_base (533)..(533): a, c, t, g, unknown or other
  misc_feature (533)..(533): n is a, c, g, or t
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtcccgccaggctccgaggggaaggggcgtgggagtgggtctcagcaattaagtgggtagggtgattcaccatattacgcagactccggtgggggccgttcaccatcaccagagacaactcgaggagcacactatatctaacaaatgacacacgcctagagagtcggaggacgaccgggtccgtgttatttagttggtgtcgagagactaccccgaacggtcgaaccccgtaccgtttggtcttcgttttgtattttcgtggtggacccgaagggactagtggtacctaccgttcttcttcacgccctaccaccgaacggcccagttccgtcccttcccccgtgggcccncccgtcgccgtaccgacggaccgaccgtcccgtacgacggacnccgtaaccgcgggccccggtacccggtgggtacccgtccggtccgttacgggtacccgtaacggttacccttaccgttacccgacggtgtaccgtaccggcgtacggacgggccgggcgtaacgggg

SEQ ID NO: 46928 - DNA, 678 bp, Homo sapiens
  misc_feature: GYAE6OF01E3L84.38.16.B05.1.454.CMB.1.raw
  modified_base (199)..(199): a, c, t, g, unknown or other
  misc_feature (199)..(199): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccgccaggctccgagggaggggctggagtgggtctcagcaattaatggtaggggtnattcaccatattacgcagaccgtcggtgggggccgttcacatcaccagagacaactcagagcacactatatcctacaaaattgacacagcctgagagtcgaggaccacggccgtgtattatgtgacgagagactccccaaggtnaccctacgttggtntcgtttttagattttcgtggtggcccgaaaagggtacaagtcggtcctaccgttcttcctcacgccctaccacccgaacggtcccacgttcccggtccttccccccgtacggtcccgtcccccgtgtcccgtacccacgggtacccgacctacccgttacccgggacgacgtaccgaaccggaaccgggtcccgggtacccccgtggggtacccggttcggacccgttcgggtacccgtaaacgggaccctttacccggtacccgttaccggttacgtaccgtaccggtaccctaggaccgggtccggggcgttaccgggg

SEQ ID NO: 46929 - DNA, 967 bp, Homo sapiens
  misc_feature: GYAE6OF01D9X63.38.16.B05.1.454.CMB.1.raw
tcagtcgatcacgtcacgaccggtgctcgatttagagctcacgtattgggtctggggggaggcttggttcagcctgggggggtccctgagactctcctgtgcagtctctggatttaacctttagtgactatcgccatgatcgtcgggtccgccaggcctaccgagggggaaggggctgggaggtgggtctcgagactaaagtttaagtgggtaggggtgtacttccacctattacgttacgacgacggtaccggttccggggtcgggggggtccgttaccaccgtactaccgaaccgaaggaacgaacctaaccgtccgaagggacgaccaacctaacttaagttaacttactaaacaaagttcgaccaacgtacgccgttaggaacggtaacggttaccgggaacgggaaccgtaaccggggttcccggtttaagggtttaacttttacggttaggtacgggaccgggtaaaggtaaacggttacccgttaacccccgggtaaaccggggttaacccgtaacccccggtttaacggttttacgggtttccggttttacgttttttaacggtacttttttccggtacggggtttaccggaacccggtaaaaggggtaacccttaagggttacccgggttaccttaccccggttacctttaccgttacccgaacccggttacccccgttaaccccgaaaccccgggtaaaccccgggttaccccgttaaccgggtttcccccgggttttacccccttcccccgggttacggtccccccggttccccgtaccgtccccggtacccggtaacgggaccccgtcccggtaaccccgtacccgggtaaggacccgacccgaccgggaccggccccggtaccggtcgggtcctccggtccgtacggtaccgtaacggttaccctaccgttccgtaacggtcgtacgtcgtacggaggtccggcggtcggacgg

SEQ ID NO: 46930 - DNA, 875 bp, Homo sapiens
  misc_feature: GYAE6OF01ADLRJ.38.16.B05.1.454.CMB.1.raw
  modified_base (214)..(214): a, c, t, g, unknown or other
  misc_feature (214)..(214): n is a, c, g, or t
tcagtcgatcacgtcacgaccggtgctcgatttagagctcacgtattgggtcgtgggggaggcttggttcagccgtggggggtccctgagactctcctgtgcagtctctggtatttaacctttagtgactatgccatgatcgtgggtccgcaggctaccgaggggaggggctgggaggtcggtctcgagactaaagttaaggtgggtaggggtntacttccgaacctattacgttacgacgacggtaccggtccggggtcggggggtcccgttacacctacgtccgaaccgaggaacgaccaaccgtaccgaagggtacaccaacctaactattaactaccgtaaactaaagtcgacaacgtacgaccgtaggaacgtacggtacggaacggacctaccggtcgtagttattacgtggacgacgagacgtacctaccggaacgtcgtaccgttacggttggttacgttccgtttagtcgtttcgtacggtcggtaccgaaaggtactaacggtcgtaacccgtccgttacctccgttaccgaccggtaccccttaaccggaaccggtaccccgggtacccttacggttcccccggtttaccccgttccccggtccgggtacccccgtcccggtaccgtacccggttacccggaaacgggtcccgtaacccccgaccgggttacccggaacgggtacccgtaaccggaccccgggtaccgggttcccccgggtcccgggttaaggtcccgtccgggtacccccggttaagggaaacccgttaacccggttaccgtttacccgtaccccggaacgggttacgtaaaccgggtccccgttaagggtcccggggaccggtcccgggttaaggacccggg

SEQ ID NO: 46931 - DNA, 765 bp, Homo sapiens
  misc_feature: GYAE6OF01C1YQJ.38.16.B05.1.454.CMB.1.raw
  modified_base (148)..(148): a, c, t, g, unknown or other
  misc_feature (148)..(148): n is a, c, g, or t
  modified_base (202)..(202): a, c, t, g, unknown or other
  misc_feature (202)..(202): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
tcagtcgatcacgtcacgaccggtgctcgatttagagctcacgtattgggtctgggggaggcttggttcagcctgggggggtccctgagactctcctgtgcagtctctggatttaacctttagtgactatgccatgatcgtgggtccnccaggctccgaggggaagggctggagtgggtctcagctaattagtggtagggtnattcacatatacgcagtacgtcggtgggggccgttcaccatccaccagagacaacncgagancacatatatactaacaaagtgaccacgacgccgtagacgacgtacggaagtaccgacgggtcgttagttaagtttagttggtacggacgaacgtaacggtaccttaccccggaaaacgggttcaaacccgttcggtttacgggtttacgtttacgttttagttacgttttcgtacgggtacggtaaccgaaaggggtaactaagggtttcggtaccgtacccggttcttaccgttaccgaaccggtccccttaacccggaaacccggaaccgggttcccctaacggtttccccggtttccccttaccccccgggtggccccggttccccgtggtccccgttaccgaacgggtacctaccccgtaacccgtacggaacgacgtacccgaacggccgggccccgggtccggtcgggaccttccggaccggttacggtaaccggtaaacggtccccgtttactcccggagttacgacgtacgacgtggacggcggtcgaacggg

SEQ ID NO: 46932 - DNA, 461 bp, Homo sapiens
  misc_feature: GYAE6OF01C5D5O.38.16.B05.1.454.CMB.1.raw
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
  modified_base (433)..(461): a, c, t, g, unknown or other
  misc_feature (433)..(461): n is a, c, g, or t
tcagtcgatcacgtcacgaccggtgctcgatttagagctcacgtatttggggtttgggtgccgaagttgctgggaggtcacggttcaccatcaccagagacaactccaggatcacactatatctacaaatgcacagcctgagagtcgagacacggcgtgtattattgtgcgagagtactccccaaagggttgaacccaccgttgggtcgtcttttgatttcgtggtacggaccgaaagggacctaaagtcggtaccaccgttctcttcacgtccctccaaccgacgggacccagtccggttccctccctcgaccgcctgcctccgagtacgccaccgtcgagacgccagacgccggcctgggactcggcctggtaccaacggtctacgtcctagtgactcgacnggacgcggtcngggacaaggcactnagcnnnnnnnnnnnnnnnnnnnnnnnnnnnnn

SEQ ID NO: 46933 - DNA, 176 bp, Homo sapiens
  misc_feature: GYAE6OF02G6BUI.38.16.B05.1.454.CMB.1.raw
  modified_base (175)..(176): a, c, t, g, unknown or other
  misc_feature (175)..(176): n is a, c, g, or t
tcagtcgatcacgtcacgaccggtgctcgatttagagctcacgtatcgggtttgggggaagaggaagactgacggtcctgctccaggagcacctccgagagcacagcggccctgggctgcctggtcaaggactacttccacgtgatcgactgagcgggctggcaaggcgcatagnn

SEQ ID NO: 46934 - DNA, 174 bp, Homo sapiens
  misc_feature: GYAE6OF02FR4CZ.38.16.B05.1.454.CMB.1.raw
  modified_base (174)..(174): a, c, t, g, unknown or other
  misc_feature (174)..(174): n is a, c, g, or t
tcagtcgatcacgtcacgaccggtgctcgatttagagctcacgtatcgggtttggggaagaggaagactgacggtcctgctccaggagcacctccgagagcacagcggccctgggctgcctggtcaaggactacttccacgtgatcgactgagcgggctggcaaggcgcatagn

SEQ ID NO: 46935 - DNA, 519 bp, Homo sapiens
  misc_feature: GYAE6OF02HEBRK.38.16.B05.1.454.CMB.1.raw
  modified_base (513)..(519): a, c, t, g, unknown or other
  misc_feature (513)..(519): n is a, c, g, or t
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccagggacgggtctggagtgggtctcacttatcagtaatagtggtggtaccacattcgacgcagactccgtgaagggccggttcaccatctccagagacaattccaagaacacactatacctgcaaatgaagaccctgagagccgaggacacggccatatattactgtgtgaaaggggcacggggtgactcctggggccagggaaccctggtcaccgtctcctcagcctccaccaagggcccatcggtctcccctggcaccctcctccaagagcacctctggggcacagcggccctgggctgcctggtcaaggactacttccacgtgatcgactgagcgggcgtggcaagggcgcgatagnnnnnnn

SEQ ID NO: 46936 - DNA, 175 bp, Homo sapiens
  misc_feature: GYAE6OF02GFV53.38.16.B05.1.454.CMB.1.raw
  modified_base (175)..(175): a, c, t, g, unknown or other
  misc_feature (175)..(175): n is a, c, g, or t
tcagtcgatcacgtcacgaccggtgctcgatttagagctcacgtatcgggtttgggggaagaggaagactgacggtcctgctccaggagcacctccgagagcacagcggccctgggctgcctggtcaaggactacttccacgtgatcgactgagcgggctggcaaggcgcatagn

SEQ ID NO: 46937 - DNA, 183 bp, Homo sapiens
  misc_feature: GYAE6OF02FYPXI.38.16.B05.1.454.CMB.1.raw
  modified_base (176)..(183): a, c, t, g, unknown or other
  misc_feature (176)..(183): n is a, c, g, or t
tcagtcgatcacgtcacgaccggtgctcgatttagagctcacgtagttgggtttgggggaagaggaagactgacggtcctgctccaggagcacctccgagagcacagcggccctgggctgcctggtcaaggactacttccacgtgatcgactgagcgggctggcaaggcgcatagnnnnnnnn

SEQ ID NO: 46938 - DNA, 657 bp, Homo sapiens
  misc_feature: GYAE6OF02G020W.38.16.B05.1.454.CMB.1.raw
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtggggggccgttcaccatcaccagagacaactccaggagcacactatatctaacaaatgcacagcctgagagtcgaggacacggccgtgtattattgtgcgagagactccccaacggtgaccctaccgtttgggtgtctttttgatttttcgtggttcgggacccaaagggggtaccaaagttcgggttaccaacccggtttcttcctttccacgtccccttacccaacccgaaacggggccccaacgttcccgggttccccttccccccgttcgggtcccgtcccccgttcgcccgtcccgacgggacgccacccgtccggacgacgccaccgacgccgggcccgtgggcctcggcccgttgggtaccgtaacgggaccttaccgttcccgtacggttcgacgtccggacgtcggacgggccgggtcgtcggg

SEQ ID NO: 46939 - DNA, 715 bp, Homo sapiens
  misc_feature: GYAE6OF02JKO58.38.16.B05.1.454.CMB.1.raw
  modified_base (710)..(710): a, c, t, g, unknown or other
  misc_feature (710)..(710): n is a, c, g, or t
tcagtcgatcacgtcacgaccggtgctcgatttagagctcacgtattgggtctgggggaggcttggttcagcctggggggtccctgagactcttcctgtgcagtctctggattaacctttagtgactatgccatggattcgtgggtccgccaggcgtccagggagggctggagttgggtctcgacttatcagtagtagtggtggtaccagattcgacggcaggtactccgtgaacgggtccggttcaccagtcgtccagacgactaattccaacgtaacacgacttactacctgacaaatcgaagccctgagacgaccggaggacgaccggccaagtactaacttacgcgtaggtacggaaaagggggccgtacgggggtacgaccgttaccggttagggggacccaagggtaaccccgtgggttaccaccggttacgtcccgttagacggtacctaccgaccgtaaggggccccctaagtttcccgggttcccgtttaccccggtacgggtacccgtaccccgttacccgttacccgaacgtaccgtaccgtaaccgtccgtacggggacctacgacgaccggcccgtacgggacctccggtcctcgggtaccgtaacggtaccgttaccgtccgtacgtcgtacgtaccgacgtcggacgaccgggtcgcggtacggacggccgtacgacgtacgcggagtcgtacgnacgtg

SEQ ID NO: 46940 - DNA, 602 bp, Homo sapiens
  misc_feature: GYAE6OF02JMSG9.38.16.B05.1.454.CMB.1.raw
  modified_base (278)..(278): a, c, t, g, unknown or other
  misc_feature (278)..(278): n is a, c, g, or t
  modified_base (545)..(545): a, c, t, g, unknown or other
  misc_feature (545)..(545): n is a, c, g, or t
  modified_base (547)..(549): a, c, t, g, unknown or other
  misc_feature (547)..(549): n is a, c, g, or t
tcagtcgatcacgtcacgaccggtgctcgatttagagctcacgtattgggtcgtggggaggcttggttcagcctgggggtccctgagactctcctgtgcagtctctggattaacctttagtgactatgccatgatcgtgggtccgccaggctccgagggaagggcgtggaggtgggttacgtcagacaattaagtgggtagggtgattcaccatattacgacagacgtccggtcggggccggttcgaccactacaccagacgacacctaccacggacngacacactactaactactacaactagacgacacgacgtagagagtacgacggacgacgtacgtagtagttagttgtagcgacgacgacgtaccgtaccgtacgtaccgtaccgttcggttcgtacgtttacgttacgtttacgttacggtacggtaccgaacggtaacgtaacgtacggtacgtaccgtaccgttacttacctacgaccgaccgacccgaacggaccgtaccgtaccggttccgttcccgtccgtccgcccgtcgcncnnncgacgaccgaccgtaccgaccgacgacgaccgaccggacggcccgtccggtcg

SEQ ID NO: 46941 - DNA, 571 bp, Homo sapiens
  misc_feature: GYAE6OF02IL4ST.38.16.B05.1.454.CMB.1.raw
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccagggaaggggctggagtgggtctcaagtgttagttggaacagtggtaccatagcctatgcggactctgtgaagggccgattcaccatctccagagacaacgccaagagctccctgtatctgcaaatgaacagtctgagacctgaggacacggccttctatttctgtgacaaaaggccccggtatggcagtagctaagaggttctttgactcgtggggccaggggaacccggtcaccgtctcctcacgcctccaccaacgggcccagtccggtccttcccccgtggccgccctcgcctccgaggacgccaccgtccgacgacgccacgacggccggcccgtggggcctcggcccgtggtccaacggtacctaccgttcccgacgtcgactcgacgtggacggcgggctggcgaacggg

SEQ ID NO: 46942 - DNA, 571 bp, Homo sapiens
  misc_feature: GYAE6OF02IEESU.38.16.B05.1.454.CMB.1.raw
  modified_base (353)..(353): a, c, t, g, unknown or other
  misc_feature (353)..(353): n is a, c, g, or t
tcagtcgatcacgtcacgaccggtgctcgatttagagctcacgtattgggtctgggggaggcttggttcagcctggggggtccctgagactctcctgtgcagtctctggatttaacctttagtgactatgccatgatctgggtccgccaggctccagggaaggggctggagtgggtctcagcaatttaatggtaggggtgattcaccatattacgcagactccgtgggggccgttcaccatcaccagagacaactccaggagcacactatatctacaaatgcacagcctgagagtcgaggacacggccgtgtatttattgtgcgagagatccccaaggtgaccaccttgggtntcttttgacttttctgtcggccaaagggactaagtggtcaccgttctcttcagcctcaccaaggcccagtcggtccttccccgtggccgccctgcctccgaggacgcacctccgagacgcacgacgccggcccgtgggctcgcccgttggtaccaaacgggtaccttaaccgttcccgaacgttgactccggaaccgttggacggtccgggctacggg

SEQ ID NO: 46943 - DNA, 519 bp, Homo sapiens
  misc_feature: GYAE6OF02HMZQ4.38.16.B05.1.454.CMB.1.raw
  modified_base (262)..(262): a, c, t, g, unknown or other
  misc_feature (262)..(262): n is a, c, g, or t
  modified_base (338)..(338): a, c, t, g, unknown or other
  misc_feature (338)..(338): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (387)..(387): a, c, t, g, unknown or other
  misc_feature (387)..(387): n is a, c, g, or t
  modified_base (436)..(436): a, c, t, g, unknown or other
  misc_feature (436)..(436): n is a, c, g, or t
  modified_base (515)..(515): a, c, t, g, unknown or other
  misc_feature (515)..(515): n is a, c, g, or t
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccgccaggctccagggaaggggctggagtgggtctcagcaattaatggtaggggtgattcaccatattacgcagactccgtggggggccgttcaccatcaccagagacaactccaggancacactatatctaacaaatgcacagcctgagagtcgaggacacggccgtgtattatgtgcgagagatcccaaggtnaccacttggtncttttgattttcngtggccaagggcaatggtcaccgtntcttcagcctcacaggccatcgtctccctgccgccctgcctccaggacncaccctccgagacgcaccagccggcctcgggctcgcctggcgaacggtactactccacgtgactcgactggagccgggntcgg

SEQ ID NO: 46944 - DNA, 703 bp, Homo sapiens
  misc_feature: GYAE6OF02H8ZCX.38.16.B05.1.454.CMB.1.raw
tcagtcgatcacgtcacgaccggtgctcgatttagagctcacgtattgggtctgggggaggcttggttcagcctggggggtccctgagactctcctgtgcagtctctggattaacctttagtgactatgccatgatctgggtccgccaggctccaggggaaggggctgggagtgggtctcagcaattaatgggtaggggtgattcaccatattacgcagactccggtgggggccgttcaccatcaccagagacaactccaggagcacactatatctaacaaatgacacagcctgagagtcgaggacacggccgtgtattattgtgcgagagactacccgaacggtcacctaccgtttgggtcgtcttttggatttttctggtcggtacccgtaaaggggtacctaaaggtcggtacctacccggtttcttacctttcgaccgtccccttaccccgaacccgtaaacgggcccctaacgttcccgggttccctttccccccggttcgggcccgtccccgttcggcccttacccgacgggtaccgtcccgtaacccgttcccgggacgtacggcccaaccgtacggcccggggccccttaggggcccgttacgtcccggttgggtacccgaacgggtaccctttaccgttcccgtacggttcgaacgttccggaaccgttggtaacgggtccggggtctacgggg

SEQ ID NO: 46945 - DNA, 582 bp, Homo sapiens
  misc_feature: GYAE6OF02GD7T1.38.16.B05.1.454.CMB.1.raw
  modified_base (482)..(482): a, c, t, g, unknown or other
  misc_feature (482)..(482): n is a, c, g, or t
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccgccaggctccagggaaggggctggagtgggtctcagcaattaatggtaggggtgattcaccatattacgcagactccggtggggggccgttcaccatcaccagagacaactccaggagcacactatatctaacaaatgacacagcctgagagtcgaggacacggccgtgtattattgtgcgagagactcccgaaggtcacctacgttggtgtcttttgattttctggtcggaccgaaagggacaagttcggtaccaaccgttctcttcacgccctaccaaccgaacgggcccagttccgggtcccttcccccgtggcccgcccgtgcctccgaggcnccaccgtccgacgacgccacgacgccggcccgtcgggcctcgccgtcggtaccgaaggtacctacgttccgacgtgactcgactggacggcggtctcggg

SEQ ID NO: 46946 - DNA, 608 bp, Homo sapiens
  misc_feature: GYAE6OF02FYROH.38.16.B05.1.454.CMB.1.raw
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
tcagtcgatcacgtcacgaccggtgctcgatttagagctcacgtattgggtctggggggaggcttggttcagcctgggggggtccctgagactctcctgtgcagtctctggattaacctttagtgactatgccatgatctgggtccgccaggctccagggaaggggctggagtgggtctcagcaattaatggtaggggtgattcaccatattacgcagactccggtggggggccgttcaccatcaccagagacaactccaggancacactatatctanaaatgcacagcctgagagtcgaggacgacggccgtgtattattgtgcgagagatcccaagggtnaccacttgggntcttttgattttctggtcggaccaaggggacaagttcggtaccaccgttctcttacacgtccctaccgaccaacgggccctacgttccggtacccttcccccgtcggccgtcccgttcgcctccgaggacgcccacctcgacgacgccgacgacgccggcccgtggggtcctcggtccgtacggtccgaaacgggtaccttaccggttacccgacggttagacgttaccggtacgtggacggtcgggtcgtcggg

SEQ ID NO: 46947 - DNA, 793 bp, Homo sapiens
  misc_feature: GYAE6OF02JHH87.38.16.B05.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (289)..(289): a, c, t, g, unknown or other
  misc_feature (289)..(289): n is a, c, g, or t
tcagtcgatcacgtcacgaccggtgctcgatttagagctcacgtagttgggttgggctgagcgtggcttttcttgtggctagtttaaaggtcgtcagtgtgaggtgcaggtgtcggatctgggggaggcttcggtcagcctggggggtccctgacgactcgtcctgtagcgagtctctggacttaacctttagngactatcgcatgatcgtcgggtccnccaggcctccgaggggaagggctcgggtagtcgggtacctcgagacctaattacgtggggtacggggtanacttcgaacctagtactaacgctacggtaccgttaccgggtggggggtacccgttacaccgtagtccgacctaggacgaccacgtccgtagacgacaacacctatataccgtaacaaagtcgacaaccgtagacctgaaggacggtcgaacggacccgacggtaccgtggttaactttcgtacggtcgaaccgtacggtaaccgtaccgttaccccggaaacgggttaccgtaaacccgtacccgggtttgggttaccgttacggtttttaccggtacttttccgttaccggggttcgaaacccgtaagggtaaccgtaacgttccgggtacctaccggtttacttccgttaccgaaccgtttccctaaccccggaagaacgggtcccccgtagttcccggtaccccgtttaaccccggttggcccccgttaaccccggttcgtaaccccgttcccgggaacgtcccggttaccccggaaccccgtttaccgggtaggacccgg

SEQ ID NO: 46948 - DNA, 651 bp, Homo sapiens
  misc_feature: GYAE6OF02JLB69.38.16.B05.1.454.CMB.1.raw
  modified_base (275)..(275): a, c, t, g, unknown or other
  misc_feature (275)..(275): n is a, c, g, or t
  modified_base (309)..(309): a, c, t, g, unknown or other
  misc_feature (309)..(309): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
  modified_base (568)..(568): a, c, t, g, unknown or other
  misc_feature (568)..(568): n is a, c, g, or t
tcagtcgatcacgtcacgaccggtgctcgatttagagctcacgtattgggtctgggggaggcgttggttcagccgtggggggtcccgtgagactctcctgtgcagtctctggattaacctttagtgactatgccatgatctgggtccgccaggctccagggaaggggctgggagtgggtctcgagcaattaagtgggtaggggtgattcaccatattacgcagactccggtgggggggccttcaccgatccaaccaggagaccaactccaggacncaacactatatctaacaaatgcactagccctganacggtcgaggacacggcctgtatattgtgacgaganactccaacggtnaccctaaccgttgggtactctttagacgttttcnggtacggtacccgaaagggaactacgttcgggtacctacccgtcgttcttcacgtccgtcccaccgtaacgggccctacgaccgttcccgttacccccgtcggtacccgccctcgtccctcgacggcgcccgtaccgacccgtagaccgccgacgaccggccgtcccgacggggtcnccggtcgaccggtacggaaccggtacttccgttacccgacgtacgacgtaccggaccgtacggacggtccggtcgtaccgggg

SEQ ID NO: 46949 - DNA, 795 bp, Homo sapiens
  misc_feature: GYAE6OF02FGAHF.38.16.B05.1.454.CMB.1.raw
  modified_base (146)..(146): a, c, t, g, unknown or other
  misc_feature (146)..(146): n is a, c, g, or t
  modified_base (205)..(205): a, c, t, g, unknown or other
  misc_feature (205)..(205): n is a, c, g, or t
tcagtcgatcacgtcacgaccggtgctcgatttagagctcacgtattgggtctgggggaggcttggttcagcctggggggtccctgagactctcctgtgcagtctctggattaacctttagtgactatgccatgatcgtgggtccnccaggctaccgagggaaggggctggaggtggtctcagctaagttaagtgggtaggggtnacttccaccatacgttacgcacgtaccgtccgggtcggggggtccgtcaccactccgaaccagacgaaccaccgtccgaggacgaccaacctactaatacgtacctaacaaacgttcgaccaccgacggtccaggtactacgggtacggacggaaccgtaccggttacgttattaacgttagttcggtcgacggtacgaacgtcccgtaccccggtaacggtccgtaaaccgttcgttgggttcttcgttttacgttactttcgtacgggacggtacggaacggtactacggtccggtaccaccgtcttccgtacgacctccgacccgtaaccggacccggtccctacggtcccggtaccccgttccccggccggtcccgtaccccgtcgtacccgtaccggtaccgggtaccgtacccgtacccggtaacggaccgaacgacccgaacggcccgggtccccgtaccgggttcggacccgttaccggtaccggtaccggtaccggtaaaccgtcccgttacccggtacccggttaaccggtcgtaccgtccggtaaccgggtaggcccgggtaccgggtcgtaacccggg

SEQ ID NO: 46950 - DNA, 712 bp, Homo sapiens
  misc_feature: GYAE6OF02IGYZP.38.16.B05.1.454.CMB.1.raw
  modified_base (523)..(523): a, c, t, g, unknown or other
  misc_feature (523)..(523): n is a, c, g, or t
tcagtcgatcacgtcacgaccggtgctcgatttagagctcacgtattgggtctgggggaggcttggttcagcctgggggggtccctgagactctcctgtgcagtctctggatttaacctttagtgactatgccatgatctgggtccgccaggctccagggaggggctggagtgggtctcagcaattaagtgggtaggggtgattcaccatatacgcagactccggtgggggccgttcacatcacagacgacactccaggacgcacactatatactaacaaatgacacacgcctaggaagagtacggaaggaccgaccggtaccggtgttatttacgttggtcgacggaagagtacctaccccgaaagggtcgaacccgtaccgtttgggtgtttcttttagtacttttcgtggtacggtaccgaagggtacctaaggttcggtacctacccggttcttcgttaccgacgtcccctacccgaaccggaccgggtccctacgttcccggttcccgtttcccccgngggtccctcccgtcgcccgtaccgaggaccgaccctacccgtaccggagaccgaccgaaccgacggcccggtacccggtcgggtaccttcggtcccggttcgggtaaccgtaaccgggtacccttacccggttaccgtacggttacgtacgtaccggtaccggtagggacgggtccgggtcgtaccggg

SEQ ID NO: 46951 - DNA, 710 bp, Homo sapiens
  misc_feature: GYAE6OF02HLYPE.38.16.B05.1.454.CMB.1.raw
  modified_base (287)..(287): a, c, t, g, unknown or other
  misc_feature (287)..(287): n is a, c, g, or t
  modified_base (374)..(374): a, c, t, g, unknown or other
  misc_feature (374)..(374): n is a, c, g, or t
  modified_base (489)..(489): a, c, t, g, unknown or other
  misc_feature (489)..(489): n is a, c, g, or t
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccgccaggctccagggaaggggctggagtgggtctcagcaattaatggtaggggtgattcaccatattacgcagactccggtggggggccgttcaccatcaccagagacaactccaggagcacactatatctaacaaatgacanagcctgagagtcgaggacacggccgtgtattattgtgcgagagactacccgaaggtcaccaccgttggtcgtcttttgatttttcgnggtacggaccgaaaggggactaagttcggtactacccgttctcgttaccgacgtccccttacccgaaccggtaaaccgggcccctaacgttcccgggttccctttacccccccgngggtaccccgtcccccgttacggtccctacccggacggtaccggcccgttaaccccgtacccgggaggaccggtaccgaaccgtaccgggcccgggtccccggtgggggcccttaccggcccgttacgggtaaccgtaaaccgggtaccctttacccgttacccggtaccggttacgtaccgttaccggacgttacgggacgggtccggggtcgtacgggg

SEQ ID NO: 46952 - DNA, 788 bp, Homo sapiens
  misc_feature: GYAE6OF02JUDTO.38.16.B05.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
tcagtcgatcacgtcacgaccggtgctcgatttagagctcacgtattgggtctgggggaggcttggttcagcctggggggtccctgagaccctcctgtgcagtctctggattaacctttagtgactatgccatgatctgggtccgccaggctccagggaaggggctggagtgggtctcagcaattaatgggtacgggggtnaacttcaccagtatttacggcagacctccggtggggggccgttacnccactcaccagagacctaactcagggatcactacatactctaacaaattgcacgancctagacgagtccgaggactacggcgtgtattattggtgacgagagacgtcccaaaggttcgaccttaaccgttggtcgtacgtttttgacttttctggtcgggtaccaaacgggggtactaacggttcggggtccctaacccggtttcctttacgttaccgtaaccggttaccccttaaccccgtaacccggtaaacccgggtaccccgttaaccgttacccgggtttacccgtttaccccccgttttccggaccccgttaccccgttacccctttacccgaaacccggttaacggacccctaacccggttccggttaccggggggacccaaccggtaaccgggtcccgggtacccggtaccgggcccgttaccggcccgggttaccgtaccgtaacgggtacctttacccgttacccggtaccgtacgtaaccgttccggagttacggtacgggcggtccggtacggtaccggtacggaccgg

SEQ ID NO: 46953 - DNA, 734 bp, Homo sapiens
  misc_feature: GYAE6OF02JH06U.38.16.B05.1.454.CMB.1.raw
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccgccaggctccagggaaggggctggagtgggtctcgagcaattaatgggtaggggtgattcacctatattacgcagacgtccggtggggggccgttcaccgatcaccagagacaactccaggacgcacactaatatcgtaacaactgactacaggacctagacgacggtacggacggaccaccgggccgttaggttaactttaagttcggtaggaccgtaaggacgtacgtaccccgaacgggtacgtaccctacggtttagggtcgttccttttaggtacttttcgttaggtcggaccgaaggggtaacctagtcgtccgtaccgttcgtacttacgacgtcccttaaccgaccggaaacgggtcctacgttccgggtacccttccccggcggccggtccccttacggacccgtccgtaaggaccgacctacccgtaccgggtacgacgtcctaccgacgggtcccgggcccgttacgggccgttaccggcccggttaggacccgtaaaccggggtaccttaccgttaacccggtacggttaccggacttaccggtaccggtacggacggggtaccggcggttaacggg

SEQ ID NO: 46954 - DNA, 678 bp, Homo sapiens
  misc_feature: GYAE6OF02IOVKW.38.16.B05.1.454.CMB.1.raw
  modified_base (329)..(329): a, c, t, g, unknown or other
  misc_feature (329)..(329): n is a, c, g, or t
tcagtcgatcacgtcacgaccggtgctcgatttagagctcacgtattgggtctgggggaggcttggttcagcctggggggtccctgagactctcctgtgcagtctctggattaacctttagtgactatgccatgatctggtccgccaggctccaggggaagggctggagtgggtctcagcaattaatgggtagggtgattcaccatattacgcagacgtcggtgggggccgttcaccatcacagagacactcagagcacatatatctaacaaatgcacagcctagagacgtcgaggacgacggccgtagtacttagttggtgacgaganactcccgaacggtcacctacgttggtcttcttttcggattttcgtggtcggaccgaagggtacaagttggccctaccgtcctcgtttccgaagtcccctaccgacccgtaaacgggcccctaacgttccggtcccctttcccccgtcggtccctaacccccgttcccgtaaccgaacgtaccggaccctacccgttcgggtaccggggacctacgaccgggtccggacccgttaggcccgttaggcccgttagggtacccgtaaacggtacccgttaaccgtttacccgtaaccgtagtaccgtaccgtagttacggacggtaccgggacgttacgggacgtaaccggg

SEQ ID NO: 46955 - DNA, 688 bp, Homo sapiens
  misc_feature: GYAE6OF02H2QG6.38.16.B05.1.454.CMB.1.raw
  modified_base (283)..(283): a, c, t, g, unknown or other
  misc_feature (283)..(283): n is a, c, g, or t
  modified_base (438)..(438): a, c, t, g, unknown or other
  misc_feature (438)..(438): n is a, c, g, or t
tcagtcgatcacgtcacgaccggtgctcgatttagagctcacgtattgggtctggggggaggcttggttcagccgtgggggggtccctgagactctcctgtgcagtctctggatttaaacctttagtgactatcgcatgatcgtcgggtcccgccgaggcctccgagggggaagggggcgtgggaggtgggtctcgagactaattaagtgggtagggtgtattcaccattatacgacagtacgtccgggtggggggtccgttcacctatcaccagagacaacncgaaggagacaacaactataatactaacaaatcgacaacacgccttaggaaggacgtacggacggaacgaccgggtcgttagttaagtttagtggtacgtacggaagacgtactacccgaacggtcaaccctacggttggtactttcgtttagtnttttacgtggtacggacgtaagggacctaacggtgtacctacgtcttctacacgtacctaccaacgaacggtcacgtcgttccctcccgtgtcccgcgtacgccgtacgaggccacgtaccgacgacgacgaaccgacgaccgccgggtaccggcggtaccgtacggtacccgtacggtaaccgtaacggtaccttaccgtaaccgacggttctaacggtcgaaccggttagcgggcgggtagtaccggg

SEQ ID NO: 46956 - DNA, 817 bp, Homo sapiens
  misc_feature: GYAE6OF02GQ6WQ.38.16.B05.1.454.CMB.1.raw
tcagtcgatcacgtcacgaccggtgctcgatttagagctcacgtattggggtcgtggggggaggcttggttcagcctggggggtccctggagactctcctgtgcagtctctggattaacctttagtgactatgccatgatcgtgggtccgccaggctccgagggaggggctggagtgggtctcagcaattaatggtagggtgattcgaccatattacgcagactccggtgggggccgttcaccatcaccagacgacaactccgagacgcaacactaatactctaacaaatcgacacgacgccgtgaagtacgtacggaacggaccacgggtccgttagtatttagtggtagcgaagacgacgtaccccgaagggtcaccgtacgttgggtcttcgttttagacttttcgtacggtcggaccgtaaacggggtacctaaagttccggggtacctaacccggttctttaccgttaccgtaccggtaccccgttaacccgaaacccgggtaaaccgggtccctaaccgggtttcccgggtttacccctttaccccccgggttagggtccccgtccccggtttacgtaccccgttaacccgtaacggggaccttacccgtaaacccggttcccgggaacggtaccggtacccgtaacgggtacccgggttacccgggtcccgggtacggggtccggttaccggtacccggttaagggtaacccgtaaacggggttaccctttaacccggtacccgtaacgggttaccgtacgttacccggtacggtttcgggaacccgggttccggggcgttaacccgggg

SEQ ID NO: 46957 - DNA, 901 bp, Homo sapiens
  misc_feature: GYAE6OF02FPRD6.38.16.B05.1.454.CMB.1.raw
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
  modified_base (336)..(336): a, c, t, g, unknown or other
  misc_feature (336)..(336): n is a, c, g, or t
  modified_base (414)..(414): a, c, t, g, unknown or other
  misc_feature (414)..(414): n is a, c, g, or t
tcagtcgatcacgtcacgaccggtgctcgatttagagctcacgtatttgggtttggggctgagctggtctttttcttgtggctattttaaaaggtgtccagtgtgaggtgcaggtgtcggagtctgggggaggcttggttcagccgtgggggggtccctgagactctcctgtgcagtctctggtatttaacctttagtgactatgccatgatcgtgggtccncgaggtctccgaggggaagggctgggagtgggtctacagactaaagttaagnggggttaggggtgtattcacccattattacggcaggacgtccggtaggggggccgtcaccgntcaccgagagaaccaacgtccgaggagacacgaaccttaatagtactaacgaaattcgacctacgacgtccgttaagnggtaacggtacggaacggacccgtaaccggggtacccgggttaggtttaacgtttttagtttacgggttcgggaaccggggtacgtaaaccgggtaaccgttaacccccgggttaaaccggggttaccgttaacccccggttaaacggttttccggggttacggttttaccgttttttacgggtttttacctttttaccggtgggttttaccgggtacccggggtaaaagggttaaacccggttaaacggtttagggttaccccgggtttaaaccccggtccgttttttaccccttaccgggtaccgttaccccccgttaccccggaacccggttaaccgggggtacccccttaccgggttcccggttttacccccgtttacccccccgggttaccgggtccccgtaccccccggttacgggtccccctaacccgggtaccgttaacccgggacccccgtaccccggtaacccgacggtaccccggg

SEQ ID NO: 46958 - DNA, 979 bp, Homo sapiens
  misc_feature: GYAE6OF02I3F6H.38.16.B05.1.454.CMB.1.raw
tcagtcgatcacgtcacgaccggtgctcgatttagagctcacgtattgggtctggggggaggctttggttcagcctgggggggtccctgagactctcctgtgcagtctctggatttaaccttttagtgactatgccatgatcgtcgggtccgccgaggctaccgagggggaaggggctagggaggttgggtctcgagactaagttaagtgggtaggggtgtagttcgaacctattacttacggcacggtaccgttccggggttcggggggggacccggtttacgaccctaacttccgaacccgaacggaacggaaccctaacctacccggaagggacgaccaacaacttaacttactacctaaacctaaagttacgaccaccgtaacgccgttacggagtaaggtaccggtaacggtaaccgggaccgggtacccggttaggtttaaattttacggttttggttacgggtacggtacggaacggtaaccgtaaccccgggtaaccggtttaaccggtaccccgttaacccggttttcgggggttacgttaccgttttttcggtttaacgtttttcgttacggggttaccggtaccggaaaacgggggttaaacctaaacgggttccgttaaccgtaacccgtttccggtttaccttaccgaccggttaccccgtaaccctaacccgggaaaccggggtcccctacggttaccccggtttcccccggtacccccggttaccgggttaccccggtccccgttacccggtcccgtaacccccggtagggtaccaaccccggttccccgaaccggacgtaaccgacccggtaaccgtaaccgggtccccgggtcccggttacggggtccgttcccgtaccggtttacggtacggtaaccggtaacccgtttaccggttaccgaccggtttaacgaccggtttacccggtaggacgggtaaccgggtccgggtaggtacccggg

SEQ ID NO: 46959 - DNA, 652 bp, Homo sapiens
  misc_feature: GYAE6OF02JVPS6.38.16.B05.1.454.CMB.1.raw
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (645)..(645): a, c, t, g, unknown or other
  misc_feature (645)..(645): n is a, c, g, or t
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccgccaggctccagggaaggggctggagtgggtctcagcaattatgggtaggggtgattcaccatattacgcagactccggtggggggccgttcaccatccacagagacaactcaggancacactatatactaacaaatcgacagcgcctgaagngtacggaggactacggccgtagtacttagttggtagtacggaagacgtaacgtacccgaacggttacgacccgtacgttgggtcttcgtttaggtcttttacgtggtacggaccggaaaggtaccaagttgggtaccctaccgttctcgtacgacgtccctacgaaccggtacgcctacgtccgttaccctcccgtcggcccgtcccacgtcccgaccgtaggacctaccgacccgtcgaacgcggtaccacgaccgtccggtcccggaggtccctacggccggtcgtacggaacggtacccttacgtcctaacggtcggaactccggacgtaggcgggaccgggtntaccggg

SEQ ID NO: 46960 - DNA, 827 bp, Homo sapiens
  misc_feature: GYAE6OF02GXD4F.38.16.B05.1.454.CMB.1.raw
  modified_base (269)..(269): a, c, t, g, unknown or other
  misc_feature (269)..(269): n is a, c, g, or t
tcagtcgatcacgtcacgaccggtgctcgatttagagctcacgtagttgggtttgggctgagctggcttttcttgtggctatttaaaaggtgtccagtgtgaggtgcaggtgtcggagtctgggggaggcttggttcagccgtggggggtccctgagactctccgtgtgcagtctctggtattaaccttagtgactatgccatgatcgtgggtccgcgaggctcgagggagggcgtgggagtggtctcagcaattaagtgggtagggtntatcgactattacttacgcagtacgtccggtggggggccgttcacccatccaacccgaggacggaaccgaaccgtaccgagggtacgcaaccgactaagtactctaaacgaaatcgacaacgacgtacctaggaaggtacgtacggagggtaaccgaccggggtacccggttaggttaaacttttacgtttcggtacggtaccggaaacgggtaagtaaaccccgttacccccggtaaaacggggttaccgtaaaaccccgtaaccggtttcgggggtactttaccggtttttaagggttaaccgtttttccggtaagggttccggggtaaacccggtaaaaacggggtaccaaaaggttttcccggggaacccttaaccccgggtttccttacccggttaaccgaacccgttccccgggtaacccctaaccggggtaaccggcccccgttagttacccccgggtttccccgttccccccggtagggtcccccgtacccgttcggtaccctacccgggagggaccgtacccgaaccccggttccggaacggtacccgg

SEQ ID NO: 46961 - DNA, 640 bp, Homo sapiens
  misc_feature: GYAE6OF02HQAKP.38.16.B05.1.454.CMB.1.raw
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (362)..(362): a, c, t, g, unknown or other
  misc_feature (362)..(362): n is a, c, g, or t
  modified_base (423)..(423): a, c, t, g, unknown or other
  misc_feature (423)..(423): n is a, c, g, or t
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccgccaggctccagggaagggctgggagtgggtctcagcaaattaatgggtagggtgattcaccatattacgcagactccggtgggggccgttcaccatcaccgagacgacactccaggancacactatatctacaaatcgcacagcctgacgngtcgaggacacggccgtgttattagttgtgacgagagactcccgaaagtcgacctacgtttggtntcttttgacttttcgtgtcggaccgaagggtaacagttcggtctaccgttcctcgttaccncgtaccccttaccgaacccgtaacgggccctaacgttcccgggttacccttcccccgaggtcccgcccttcgcctaccgacgacgtccacccgtcgagtaccgcacgaccggccgtccggtacggcctcggcccgtgggtaaccgaacgggtaccttaccggttacctaccggttagtaccgtaccgacggttacggacggtcggggcctaacgggg

SEQ ID NO: 46962 - DNA, 672 bp, Homo sapiens
  misc_feature: GYAE6OF02G5ZJA.38.16.B05.1.454.CMB.1.raw
  modified_base (146)..(146): a, c, t, g, unknown or other
  misc_feature (146)..(146): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (325)..(325): a, c, t, g, unknown or other
  misc_feature (325)..(325): n is a, c, g, or t
  modified_base (382)..(382): a, c, t, g, unknown or other
  misc_feature (382)..(382): n is a, c, g, or t
tcagtcgatcacgtcacgaccggtgctcgatttagagctcacgtattgggtctgggggaggcttggttcagcctgggggggtccctgagactctcctgtgcagtctctggattaacctttagtgactatgccatgatctgggtccnccaggctccgaggggaaggggctgggagtgggtctcagcaattaagtgggtaggggtgattcacatattacgcagactcggtgggggccgttcaccatcacagagacacncagncanatatatctaacaaagtcacacagcctagagagtacgaggaccgacggcgtagtattagttgngacgagagtactaccgaacggtcacctacgttggtcgttcgttttagactttttcgnggtacgacgaaggtacaagtcggtcctaccgtctcttcgacgtcctaccaaccgaacgggccctacgttccggttccccttccccgtacggccctcccgtacgacctaccgaaggaccgccctaccgacccggaacgtaccgccgtaaccgaacgggtcccggtaccccggtgggaccgttaccgggacccggttaccggggtaacccgtaaagggttaaccccgtttaccgttacccgaacggtttacgaactttcgggaaccgttggaaccgggcgggtaccgacggg

SEQ ID NO: 46963 - DNA, 193 bp, Homo sapiens
  misc_feature: GYAE6OF02JEUT0.4.25.C03.1.454.CMB.1.raw
  modified_base (183)..(193): a, c, t, g, unknown or other
  misc_feature (183)..(193): n is a, c, g, or t
tcagagcactgtagcacgaccggtgctcgatttagtagtgtagatttgggtttgggctttctctttaactgcaggttcagagatgccagcagactccatgctcctgggctggcaaggcgcatagctgcctggtcaaggactacttccctacagtgctctgagcgggctggcaaggcgcatagnnnnnnnnnnn

SEQ ID NO: 46964 - DNA, 126 bp, Homo sapiens
  misc_feature: GYAE6OF02GT5GK.4.25.C03.1.454.CMB.1.raw
  modified_base (109)..(109): a, c, t, g, unknown or other
  misc_feature (109)..(109): n is a, c, g, or t
  modified_base (125)..(126): a, c, t, g, unknown or other
  misc_feature (125)..(126): n is a, c, g, or t
tcagagcactgtagcacgaccggtgctcgatttagtagtgtagatttgggtttgggctttctctttaactgcaggttcagagatgccagcagactccatgctcccgggngtgcaaggcgcatagnn

SEQ ID NO: 46965 - DNA, 143 bp, Homo sapiens
  misc_feature: GYAE6OF01BFSIA.31.15.B04.1.454.CMB.1.raw
  modified_base (130)..(143): a, c, t, g, unknown or other
  misc_feature (130)..(143): n is a, c, g, or t
tcagcagtagacgtcacgaccggtgctcgatttagacagtatatatccgcgggtatatactaaatcgagcacatggcgcgagggaggcgatacgctgtcagtctctcgatggcgcgagggagcgatacgnnnnnnnnnnnnnn

SEQ ID NO: 46966 - DNA, 128 bp, Homo sapiens
  misc_feature: GYAE6OF01BBD1M.31.15.B04.1.454.CMB.1.raw
  modified_base (117)..(128): a, c, t, g, unknown or other
  misc_feature (117)..(128): n is a, c, g, or t
tcagcagtagacgtcacgaccggtgctcgatttagacagtatatatccgcgggcaccggtcggcgcgagggaggcgatacgctgtcagtctctcgatggcgcgagggagcgatacgnnnnnnnnnnnn

SEQ ID NO: 46967 - DNA, 290 bp, Homo sapiens
  misc_feature: GYAE6OF01CP79I.34.6.A06.1.454.CMB.1.raw
  modified_base (285)..(290): a, c, t, g, unknown or other
  misc_feature (285)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgcatctgaatcacgtgtactgagcgggctggcaaggcgcatagnnnnnn

SEQ ID NO: 46968 - DNA, 292 bp, Homo sapiens
  misc_feature: GYAE6OF01BAKA3.34.6.A06.1.454.CMB.1.raw
  modified_base (280)..(292): a, c, t, g, unknown or other
  misc_feature (280)..(292): n is a, c, g, or t
tcagtacacgtgatcacgaccggtgctcgatttagatctactgacagggccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtgaaatcaaacgactgtgctgcaccatctgtcttcatcttccgcatctgaatcacgtgtactgagcggctggcaaggcgcatagnnnnnnnnnnnnn

SEQ ID NO: 46969 - DNA, 317 bp, Homo sapiens
  misc_feature: GYAE6OF01C257N.34.6.A06.1.454.CMB.1.raw
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
  modified_base (300)..(317): a, c, t, g, unknown or other
  misc_feature (300)..(317): n is a, c, g, or t
tcagtacacgtgatcacgaccggtgctcgatttagatctactgacgaggccctggcatccctagacccactgccaactgaaccctgtctagggaccagacttcactctcacatcaccagactggagtcctgaagattttgcagtgtattactgtcaacagttgtctcacacacgtggactttcggccaagggaccaaggtggaaatcaaacgtaactgtggctgcaccatctagtcttacatcgttccgcatctgaaatcacgtntaactgagcggactggcaacggcgcaatagtcncnnnnnnnnnnnnnnnnnn

SEQ ID NO: 46970 - DNA, 439 bp, Homo sapiens
  misc_feature: GYAE6OF01ELHBK.34.6.A06.1.454.CMB.1.raw
  modified_base (396)..(396): a, c, t, g, unknown or other
  misc_feature (396)..(396): n is a, c, g, or t
  modified_base (398)..(399): a, c, t, g, unknown or other
  misc_feature (398)..(399): n is a, c, g, or t
  modified_base (401)..(402): a, c, t, g, unknown or other
  misc_feature (401)..(402): n is a, c, g, or t
  modified_base (404)..(439): a, c, t, g, unknown or other
  misc_feature (404)..(439): n is a, c, g, or t
tcagtacacgtgatcacgaccggtgctcgatttagatctactgacagggccaggtcagagtgttaatagcatctacttagcctggtaccagtcagaaacctggccagcctcccagactcctcattaagtggtgcatactacagggcccctggcatcccagacaggttcagttggcaggtgggtctggggacagacttcacgtctcaccatcaccagactggtagcctgaacgattttgcagtgtattactgtcaacagttggtactcgacacacgtggacgttcggccaagggaccaaggtgggaaatcgaaacgaacgtgtggctgcacctatctgtcttcagttcttccgcatctagtatcacgtgtactgagcgggctggcaaggcgcatagnannanntnnnnnnnnnnnnnnnnnnnnnnnnnnnnnnnnnnnn

SEQ ID NO: 46971 - DNA, 287 bp, Homo sapiens
  misc_feature: GYAE6OF01A6QMY.34.6.A06.1.454.CMB.1.raw
  modified_base (283)..(287): a, c, t, g, unknown or other
  misc_feature (283)..(287): n is a, c, g, or t
tcagtacacgtgatcacgaccggtgctcgatttagatctactgacagggccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatcttcccgcatctgaatcacgtgtactgagcggctggcaaggcgcatagnnnnn

SEQ ID NO: 46972 - DNA, 286 bp, Homo sapiens
  misc_feature: GYAE6OF01AUY69.34.6.A06.1.454.CMB.1.raw
  modified_base (282)..(286): a, c, t, g, unknown or other
  misc_feature (282)..(286): n is a, c, g, or t
tcagtacacgtgatcacgaccggtgctcgatttagatctactgacagggccctggcatcccagacaggttcagtggcagtgggtctgggacagacttcactctcaccatcaccagactggagcctgaagattttgcagtgtattactgtcaacagttggtctcacacacgtggacgttcggtcaagggaccaaggtggaaatcaaacgaactgtggctgcacatctgtcttcatcttccgcatctgaatcacgtgtactgagcggctggcaaggcgcatagnnnnn

SEQ ID NO: 46973 - DNA, 291 bp, Homo sapiens
  misc_feature: GYAE6OF01D1B7Z.34.6.A06.1.454.CMB.1.raw
  modified_base (286)..(291): a, c, t, g, unknown or other
  misc_feature (286)..(291): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnnn

SEQ ID NO: 46974 - DNA, 287 bp, Homo sapiens
  misc_feature: GYAE6OF01EA039.34.6.A06.1.454.CMB.1.raw
  modified_base (285)..(287): a, c, t, g, unknown or other
  misc_feature (285)..(287): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgccatctgaatcacgtgtactgagcggctggcaaggcgcatagnnn

SEQ ID NO: 46975 - DNA, 290 bp, Homo sapiens
  misc_feature: GYAE6OF01AEWNW.34.6.A06.1.454.CMB.1.raw
  modified_base (284)..(290): a, c, t, g, unknown or other
  misc_feature (284)..(290): n is a, c, g, or t
tcagtacacgtgatcacgaccggtgctcgatttagatctactgacagggccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcgcatagnnnnnnn

SEQ ID NO: 46976 - DNA, 288 bp, Homo sapiens
  misc_feature: GYAE6OF01D73H2.34.6.A06.1.454.CMB.1.raw
  modified_base (285)..(288): a, c, t, g, unknown or other
  misc_feature (285)..(288): n is a, c, g, or t
tcagtacacgtgatcacgaccggtgctcgatttagatctactgacagggccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnn

SEQ ID NO: 46977 - DNA, 293 bp, Homo sapiens
  misc_feature: GYAE6OF01BKWW6.34.6.A06.1.454.CMB.1.raw
  modified_base (291)..(293): a, c, t, g, unknown or other
  misc_feature (291)..(293): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaaagggaccaaaggtggaaaatcaaaacgaactgtggctgcaccatctgtcttcatcttcccgccatctgaatcacgtgtactgagcgggctggcaaggcgcatagnnn

SEQ ID NO: 46978 - DNA, 290 bp, Homo sapiens
  misc_feature: GYAE6OF01CTX5G.34.6.A06.1.454.CMB.1.raw
  modified_base (286)..(290): a, c, t, g, unknown or other
  misc_feature (286)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaaatcaaacgaactgtggctgcaccatctgtcttcatcttcccgcatctgaatcacgtgtactgagcggctggcaaggcgcatagnnnnn

SEQ ID NO: 46979 - DNA, 384 bp, Homo sapiens
  misc_feature: GYAE6OF01B68W0.34.6.A06.1.454.CMB.1.raw
  modified_base (378)..(384): a, c, t, g, unknown or other
  misc_feature (378)..(384): n is a, c, g, or t
tcagtacacgtgatcacgaccggtgctcgatttagatctactgacagggccagtcagagtgttaatagcatctacttagcctggtaccagcagaaacctggccagactcccagactcctcatctatgctacatccaccagggccactgctattccagccaggttcagtggcagtgggtctgggacagagttcactctcaccatcagcagcctgcagtctgaagattctgcactttattactgtcagcagtctaataagtggccgtggacgttcggccaagggaccaaggtggaaatcaaacgactgtggctgcaccatctgtcttcatcttcccgcatctgaatcacgtgtactgagcgggctggcaaggcgcatagnnnnnnn

SEQ ID NO: 46980 - DNA, 287 bp, Homo sapiens
  misc_feature: GYAE6OF01BEC51.34.6.A06.1.454.CMB.1.raw
  modified_base (283)..(287): a, c, t, g, unknown or other
  misc_feature (283)..(287): n is a, c, g, or t
tcagtacacgtgatcacgaccggtgctcgatttagatctactgacagggccctggcatcccagacccactgccactgaacctgtctgggacagacttcactctcaccatcaccagactggagcctgaagattttgcagtgtattactgtcaacagttggtctcacacacgtggacgttcggccaagggaccaaggtgaaatcaaacgactgtggctgcaccatctgtcttcatcttcccgcatctgaatcacgtgtactgagcgggctggcaaggcgcatagnnnnn

SEQ ID NO: 46981 - DNA, 314 bp, Homo sapiens
  misc_feature: GYAE6OF01BPRAQ.34.6.A06.1.454.CMB.1.raw
  modified_base (264)..(264): a, c, t, g, unknown or other
  misc_feature (264)..(264): n is a, c, g, or t
  modified_base (292)..(314): a, c, t, g, unknown or other
  misc_feature (292)..(314): n is a, c, g, or t
tcagtacacgtgatcacgaccggtgctcgatttagatctactgacagggccccgtggcatcccaggacccactgccactgaacctgtctgggacagacttcactctcaccatcaccagactggagcctgaagattttgcagtgtattactgtcaacagttggtctcacacacgtggacgttcggccaaagggaccaaaggtggaaatcaaaacgaactgtggctgcaccatctgtcttcatcttcccgccatctgaatcacgtntactgagcgggctggcaaggcgcatagnnnnnnnnnnnnnnnnnnnnnnn

SEQ ID NO: 46982 - DNA, 389 bp, Homo sapiens
  misc_feature: GYAE6OF01DPR9O.34.6.A06.1.454.CMB.1.raw
  modified_base (383)..(389): a, c, t, g, unknown or other
  misc_feature (383)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcaacacacgtggacgttcggccaagggaccaaggtggaaaatcaaacgaactgtggctgcaccatctgtcttcatcttcccgccatctgaatcacgtgtactgagcgggctgggcaaggcgcatagnnnnnnn

SEQ ID NO: 46983 - DNA, 290 bp, Homo sapiens
  misc_feature: GYAE6OF01A1256.34.6.A06.1.454.CMB.1.raw
  modified_base (285)..(290): a, c, t, g, unknown or other
  misc_feature (285)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcgaccaagggaccaaggtggaaatcaaacgactgtggctgcaccatctgtcttcatcttcccgcatctgaatcacgtgtactgagcgggctggcaaggcgcatagnnnnnn

SEQ ID NO: 46984 - DNA, 290 bp, Homo sapiens
  misc_feature: GYAE6OF01DWFD0.34.6.A06.1.454.CMB.1.raw
  modified_base (285)..(290): a, c, t, g, unknown or other
  misc_feature (285)..(290): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcgcatagnnnnnn

SEQ ID NO: 46985 - DNA, 381 bp, Homo sapiens
  misc_feature: GYAE6OF01DVHQ4.34.6.A06.1.454.CMB.1.raw
  modified_base (379)..(381): a, c, t, g, unknown or other
  misc_feature (379)..(381): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaaatcaaacgaactgtggctgcaccatctgtcttcatcttccgcatctgaatcacgtgtactgagcgggctggcaaggcgcatagnnn

SEQ ID NO: 46986 - DNA, 490 bp, Homo sapiens
  misc_feature: GYAE6OF01DEIL1.34.6.A06.1.454.CMB.1.raw
  modified_base (166)..(166): a, c, t, g, unknown or other
  misc_feature (166)..(166): n is a, c, g, or t
  modified_base (380)..(380): a, c, t, g, unknown or other
  misc_feature (380)..(380): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaanagccacctctcctgcagggccagtcagagtgttaatagcatctacttagcctggtaccagcagaacctggccagcctccagactcctcattaatggtgcatactacagggcccctggcatccagacaggttcagtggcagtggtctgggacagacttcactctcaccatcaccagactggagcctgaagattttgcagtgtattactgtcaacngttggtctcacacacgtggacgttcggcaagggaccaaggtgaatcaaacgactgtgctgcacatctgtcttcatcttcccgctatctgaactcacgtntactgngtcgg

SEQ ID NO: 46987 - DNA, 288 bp, Homo sapiens
  misc_feature: GYAE6OF01EXSZV.34.6.A06.1.454.CMB.1.raw
  modified_base (284)..(288): a, c, t, g, unknown or other
  misc_feature (284)..(288): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaaatcaaacgaactgtggctgcacatctgtcttcatcttccgcatctgaatcacgtgtactgagcggctggcaaggcgcatagnnnnn

SEQ ID NO: 46988 - DNA, 628 bp, Homo sapiens
  misc_feature: GYAE6OF01BXH5R.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtcctcaggcacctgttctttgtctccgaagggaaagacgccaccctctcctgcgacgggccagtcagagttagttaatagcatctacttagcctggtaccagcaacgaaaccgtcggccagccctaccagacctcctctaattaagtggtgctatactacgacggtccctggacactccagacgtaggttcaggtggacaggtggtcgtgggacagtacttcactctacactactcacagacgtggacgtccgtagaacgttagtttcgactaggtagttacttactcgttaaccgtaacgtaggtttcggtctacaacgtacgtacgggtcggtaccggttccggaccgaacgggaaccgtaagggtacggaaactacgaaaccgtaacgtcggtacggactcgaccaccgtatcgttacgttccttacgtacgtttcccgttcccgacgtacttaccgtacgtaacttcgacgttacgtacgtggacggtccggg

SEQ ID NO: 46989 - DNA, 381 bp, Homo sapiens
  misc_feature: GYAE6OF01BXVTK.34.6.A06.1.454.CMB.1.raw
  modified_base (371)..(371): a, c, t, g, unknown or other
  misc_feature (371)..(371): n is a, c, g, or t
  modified_base (377)..(381): a, c, t, g, unknown or other
  misc_feature (377)..(381): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatcttcccgcatctgaatcacgtgtactgagcggctggcaaggcncatagnnnnn

SEQ ID NO: 46990 - DNA, 381 bp, Homo sapiens
  misc_feature: GYAE6OF01D48YR.34.6.A06.1.454.CMB.1.raw
  modified_base (379)..(381): a, c, t, g, unknown or other
  misc_feature (379)..(381): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgccatctgaatcacgtgtactgagcgggctggcaaggcgcatagnnn

SEQ ID NO: 46991 - DNA, 308 bp, Homo sapiens
  misc_feature: GYAE6OF01D6I07.34.6.A06.1.454.CMB.1.raw
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (291)..(308): a, c, t, g, unknown or other
  misc_feature (291)..(308): n is a, c, g, or t
tcagtacacgtgatcacgaccggtgctcgatttagatctactgacagggcccctggcatcccagaccaggttcagtggcaacgtgggtctgggacagacttcactctcaccatcaccagactggagcctgaagattttgcagtgtattactgtcaacagttggtctcacacacgtggacgttcggccaagggaccaaggtggaaatcgaaacgaactgtggctgcaccatctgtcttcatcttcccgcatctgaattcacgtntactgagcgggntggcaaggcgcatagnnnnnnnnnnnnnnnnnn

SEQ ID NO: 46992 - DNA, 385 bp, Homo sapiens
  misc_feature: GYAE6OF01C2UM1.34.6.A06.1.454.CMB.1.raw
  modified_base (381)..(385): a, c, t, g, unknown or other
  misc_feature (381)..(385): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaaatcaaacgaactgtggctgcaccatctgtcttcatcttcccgcatctgaatcacgtgtactgagcgggctgggcaaggcgcatagnnnnn

SEQ ID NO: 46993 - DNA, 291 bp, Homo sapiens
  misc_feature: GYAE6OF01ANLX6.34.6.A06.1.454.CMB.1.raw
  modified_base (286)..(291): a, c, t, g, unknown or other
  misc_feature (286)..(291): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnnn

SEQ ID NO: 46994 - DNA, 303 bp, Homo sapiens
  misc_feature: GYAE6OF01ECQKP.34.6.A06.1.454.CMB.1.raw
  modified_base (288)..(303): a, c, t, g, unknown or other
  misc_feature (288)..(303): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaaacgaactgtggctgcaccatctgtcttcatcttcccgcatctgaatcacgtgtactgagcgggctggcaaggcgcagtagnnnnnnnnnnnnnnnn

SEQ ID NO: 46995 - DNA, 831 bp, Homo sapiens
  misc_feature: GYAE6OF01EL8YQ.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcacctcgtcttgttctccacgggaaaggaagcaccctcctcctcgtcgacgggaccggacgtacgtacgaagtaggttaagttaaggacactacttaacctttaacgtaccgtcggttaccgtaacgacgacgaaaacccgtacggtccgacgaccgtccccacgactcctccacttaattaggtggtcatactactaacggcccgtccggtcgatcccacgacacggttcgtacgtagggcgacgtgggtcgtcgggtacgagacgttctactcctctaccaactactacccaacgacgtacgggtacggacctacgaaggtaaactttttggttccgaacggtttaggttaacgttttaacctttacgggttccgtaaaacctaaacgggttttggggtttccttaccctaaaccgaaccgtaacccgggtttggggtaaccgggttttaccccgggtaccccggaaaacgggggtaaaccccggaaacggggttaagggggtaaaaacttaccgtaaaaacccgggaaaacgtttcggttaggggacccgttaacgggcccgtaaacccctaagtttaccgttcgggtttacccttttaccgtaaaccttcccgttttacccccgaccccgtaattccgttagtaaacttacccgtaaccgttacggtttacttggagggtcccggggg

SEQ ID NO: 46996 - DNA, 516 bp, Homo sapiens
  misc_feature: GYAE6OF01CDCKB.34.6.A06.1.454.CMB.1.raw
  modified_base (510)..(510): a, c, t, g, unknown or other
  misc_feature (510)..(510): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaacctggccagcctccagactcctcattaatggtgcatactacagggcccctggcatcccagacaggttcagtggcagtgggtctgggacagacttcactctcaccatcaccagactggagccctagaagtaattttgactagtgtattactagtcaactagttggtctcaacacacgtggacgttcggccaagggaccaagggtagaaatacaaacgaacgtgtaggctagcacatctgtcttcactccttcccgcctatctgaatcacgtgtactggngtcggg

SEQ ID NO: 46997 - DNA, 383 bp, Homo sapiens
  misc_feature: GYAE6OF01E3461.34.6.A06.1.454.CMB.1.raw
  modified_base (379)..(383): a, c, t, g, unknown or other
  misc_feature (379)..(383): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnn

SEQ ID NO: 46998 - DNA, 292 bp, Homo sapiens
  misc_feature: GYAE6OF01EP6VC.34.6.A06.1.454.CMB.1.raw
  modified_base (286)..(292): a, c, t, g, unknown or other
  misc_feature (286)..(292): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnnnn

SEQ ID NO: 46999 - DNA, 381 bp, Homo sapiens
  misc_feature: GYAE6OF01EFA85.34.6.A06.1.454.CMB.1.raw
  modified_base (376)..(381): a, c, t, g, unknown or other
  misc_feature (376)..(381): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatctccgcatctgaatcacgtgtactgagcgggctggcaaggcgcatagnnnnnn

SEQ ID NO: 47000 - DNA, 293 bp, Homo sapiens
  misc_feature: GYAE6OF01AK4OK.34.6.A06.1.454.CMB.1.raw
  modified_base (289)..(293): a, c, t, g, unknown or other
  misc_feature (289)..(293): n is a, c, g, or t
tcagtacacgtgatcacgaccggtgctcgatttagatctactgacagggcccctggcatcccagaccaggttcagtggcagtgggtctgggacagacttcgacctctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagccggctggcaaggcgcatagnnnnn

SEQ ID NO: 47001 - DNA, 638 bp, Homo sapiens
  misc_feature: GYAE6OF01CQG0F.34.6.A06.1.454.CMB.1.raw
  modified_base (310)..(310): a, c, t, g, unknown or other
  misc_feature (310)..(310): n is a, c, g, or t
  modified_base (551)..(551): a, c, t, g, unknown or other
  misc_feature (551)..(551): n is a, c, g, or t
  modified_base (556)..(557): a, c, t, g, unknown or other
  misc_feature (556)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
  modified_base (638)..(638): a, c, t, g, unknown or other
  misc_feature (638)..(638): n is a, c, g, or t
tcagtacacgtgatcacgaccggtgctcgatttagatctactgactagggtccggagtcagagtggttaatacgtcactcgtacttacgaccgtcggttacccagtcgagaaacctggaccagcctcccagacctcctacagttaaatggtacgctagtaacttacggacgggtcccctaggcctagtttcccctagtacacggtttacttaggtagggctagtggggtctgggactaggacttacacgtcgtcaccaggtcgacctaggacctggacgtccgggtcgaagattttcgctagtgtatacngtcacagttgtctactagacacgtgtacgttcggccgaagggaccgaacggtcggaaattccgaaaaccggaacggtagggtcggtcggtaggaccggtaacccgaactaccgtagttaccgttacggaaggtttccgtttaccccgggaacctaaaattcttaggaattaccacggttgtacgtgggacgtcgggtacctacgggactaacgggccgacgaacgtacggacacaaatcangtacnnanangcgcngngagacgacgacgngngtntatntgtgngngagagtatatagtagtagtagtagtagtagtagtatgtgtn

SEQ ID NO: 47002 - DNA, 295 bp, Homo sapiens
  misc_feature: GYAE6OF01DID00.34.6.A06.1.454.CMB.1.raw
  modified_base (286)..(295): a, c, t, g, unknown or other
  misc_feature (286)..(295): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagtattttgcagtgtattactgtcaacagttggtctcacacacgtggacgttcggccaagggaccaaggtggaaatcaaacgaactgtggctgcaccatctgtcttcatctcccgcatctgaatcacgtgtactgagcgggctggcaaggcgcatagnnnnnnnnnn

SEQ ID NO: 47003 - DNA, 290 bp, Homo sapiens
  misc_feature: GYAE6OF01EDKST.34.6.A06.1.454.CMB.1.raw
  modified_base (288)..(290): a, c, t, g, unknown or other
  misc_feature (288)..(290): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatccttcccgccatctgaatcacgtgtactgagcgggctggcaaggcgcatagnnn

SEQ ID NO: 47004 - DNA, 382 bp, Homo sapiens
  misc_feature: GYAE6OF01A37E1.34.6.A06.1.454.CMB.1.raw
  modified_base (373)..(373): a, c, t, g, unknown or other
  misc_feature (373)..(373): n is a, c, g, or t
  modified_base (379)..(382): a, c, t, g, unknown or other
  misc_feature (379)..(382): n is a, c, g, or t
tcagtacacgtgatcacgaccggtgctcgatttagatctactgacagggccgagtcagagtgttaatagcatctacttagcctggtaccagccagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtctcatcttcccgcatctgaatcacgtgtactgagcggctggcaaggcncatagnnnn

SEQ ID NO: 47005 - DNA, 295 bp, Homo sapiens
  misc_feature: GYAE6OF01CSP2T.34.6.A06.1.454.CMB.1.raw
  modified_base (277)..(277): a, c, t, g, unknown or other
  misc_feature (277)..(277): n is a, c, g, or t
  modified_base (283)..(295): a, c, t, g, unknown or other
  misc_feature (283)..(295): n is a, c, g, or t
tcagtacacgtgatcacgaccggtgctcgatttagatctactgacagggcccgtggcatcccagacccactgccactgaacctgtctgggacagacttcactctcaccatcaccagactggagctgaagtatttgcagtgtattactgtcaacagttgtctcacacacgtggacgttcggccaagggaccaaggtggaaatcaaacgactgtggctgcacctatctgtcttcattcttccgcatctgaatcacgtgtactgacgcggctggcaaggncatagnnnnnnnnnnnnn

SEQ ID NO: 47006 - DNA, 297 bp, Homo sapiens
  misc_feature: GYAE6OF01CXJMP.34.6.A06.1.454.CMB.1.raw
  modified_base (234)..(234): a, c, t, g, unknown or other
  misc_feature (234)..(234): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (288)..(297): a, c, t, g, unknown or other
  misc_feature (288)..(297): n is a, c, g, or t
tcagtacacgtgatcacgaccggtgctcgatttagatctactgacagggccccgtgggcatcccagacaggttcagtggcagtgggtctgggacagacttcactctcacatcaccagactggagcctgaagtatttgcagtgtattactgtcaactagttggtactcacacacgtggacgttcggaccaagggaccaaggtggaaaatcgaaacgactgtggctgcaccgatcngtcttcatctccgcatctgaatcacgtgtactgagcggctggcaaggcncangnnnnnnnnnn

SEQ ID NO: 47007 - DNA, 502 bp, Homo sapiens
  misc_feature: GYAE6OF01ADHZG.34.6.A06.1.454.CMB.1.raw
tcagtacacgtgatcacgaccggtgctcgatttagatctactgacagggaaccatggaaaccccagcgaagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggtcg

SEQ ID NO: 47008 - DNA, 383 bp, Homo sapiens
  misc_feature: GYAE6OF01BJ9JO.34.6.A06.1.454.CMB.1.raw
  modified_base (378)..(383): a, c, t, g, unknown or other
  misc_feature (378)..(383): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgcatctgaatcacgtgtactgagcgggctggcaaggcgcatagnnnnnn

SEQ ID NO: 47009 - DNA, 293 bp, Homo sapiens
  misc_feature: GYAE6OF01BDQ2Y.34.6.A06.1.454.CMB.1.raw
  modified_base (287)..(293): a, c, t, g, unknown or other
  misc_feature (287)..(293): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgcatagnnnnnnn

SEQ ID NO: 47010 - DNA, 389 bp, Homo sapiens
  misc_feature: GYAE6OF01DU2RZ.34.6.A06.1.454.CMB.1.raw
  modified_base (377)..(377): a, c, t, g, unknown or other
  misc_feature (377)..(377): n is a, c, g, or t
  modified_base (382)..(389): a, c, t, g, unknown or other
  misc_feature (382)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgctagtgtattactgtcaactagttggtctcacacacgtggacgttcggccaagggaccaaggtggaaaatcaaacgaactgtggctgcacatctgtcttcatctccgcatctgaatcacgtgtactgacgcgggctggacaaggcanatagnnnnnnnn

SEQ ID NO: 47011 - DNA, 378 bp, Homo sapiens
  misc_feature: GYAE6OF01D9V61.34.6.A06.1.454.CMB.1.raw
  modified_base (376)..(378): a, c, t, g, unknown or other
  misc_feature (376)..(378): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtctcatctcccgcatctgaatcacgtgtactgagcgggctggcaaggcgcatagnnn

SEQ ID NO: 47012 - DNA, 290 bp, Homo sapiens
  misc_feature: GYAE6OF01CJOQU.34.6.A06.1.454.CMB.1.raw
  modified_base (287)..(290): a, c, t, g, unknown or other
  misc_feature (287)..(290): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattattgtcagcagcatcatcggtcaccgtacacttttggccaggggaccaagctggagatcaaacgaactgtggctgcaccatctgtcttcatcttcccgccatctgaatcacgtgtactgagcgggctggcaaggcgcatagnnnn

SEQ ID NO: 47013 - DNA, 400 bp, Homo sapiens
  misc_feature: GYAE6OF01A6KDR.34.6.A06.1.454.CMB.1.raw
  modified_base (380)..(382): a, c, t, g, unknown or other
  misc_feature (380)..(382): n is a, c, g, or t
  modified_base (384)..(400): a, c, t, g, unknown or other
  misc_feature (384)..(400): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacgttcactctcaccatcaccagactggagcctgaagattttgctagtgtattactgtcaacagttggtcctcacacacgtggacgttcggccaagggtaccaaggtggaaaatcaaacgactgtggctgcaccatctgtctcatctcccgcatcctgaatcacgtgtactgagcggctggcaaggcgcatgnnntnnnnnnnnnnnnnnnnn

SEQ ID NO: 47014 - DNA, 289 bp, Homo sapiens
  misc_feature: GYAE6OF01ACICT.34.6.A06.1.454.CMB.1.raw
  modified_base (285)..(289): a, c, t, g, unknown or other
  misc_feature (285)..(289): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatccttcccgcatctgaatcacgtgtactgagcggctggcaaggcgcatgnnnnn

SEQ ID NO: 47015 - DNA, 289 bp, Homo sapiens
  misc_feature: GYAE6OF01BUY17.34.6.A06.1.454.CMB.1.raw
  modified_base (286)..(289): a, c, t, g, unknown or other
  misc_feature (286)..(289): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnn

SEQ ID NO: 47016 - DNA, 501 bp, Homo sapiens
  misc_feature: GYAE6OF01DVGNM.34.6.A06.1.454.CMB.1.raw
  modified_base (494)..(494): a, c, t, g, unknown or other
  misc_feature (494)..(494): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacagggcccctggcatcccagacaggttcagtggcagtggtctgggacagacttcactctcacatcaccagactggagcctgaagtatttgctagtgtattactgtcaactagttgtctcacacacgtggacgttcggacaagggaccaaggtagaatcaaacgactgtgctgcacatctgtcttcactccttcccgctctctagaactctacgtgtactgnggtcggg

SEQ ID NO: 47017 - DNA, 381 bp, Homo sapiens
  misc_feature: GYAE6OF01BR8GY.34.6.A06.1.454.CMB.1.raw
  modified_base (349)..(349): a, c, t, g, unknown or other
  misc_feature (349)..(349): n is a, c, g, or t
  modified_base (376)..(381): a, c, t, g, unknown or other
  misc_feature (376)..(381): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtctcatcttccgcatctgaatcacgtntactgagcggctggcaaggcgcatagnnnnnn

SEQ ID NO: 47018 - DNA, 529 bp, Homo sapiens
  misc_feature: GYAE6OF01EGPME.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacaggcccctggcatcccagacaggttcagtggcaggtgggtctgggacagacttcactctcaccatcaccagactggacgcctagaagtatttgctagttgtattactgtacaatagttgtctcacacgacgtggacgttcggaccgaagggaccaagggtagaaactacgaaacgtacgtgtagctagacactatcgtctcttactacgttccttcccgctactctagactccgacgtagtactggcggtcggg

SEQ ID NO: 47019 - DNA, 385 bp, Homo sapiens
  misc_feature: GYAE6OF01E2RPY.34.6.A06.1.454.CMB.1.raw
  modified_base (379)..(385): a, c, t, g, unknown or other
  misc_feature (379)..(385): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnnnn

SEQ ID NO: 47020 - DNA, 288 bp, Homo sapiens
  misc_feature: GYAE6OF01BX2IM.34.6.A06.1.454.CMB.1.raw
  modified_base (287)..(288): a, c, t, g, unknown or other
  misc_feature (287)..(288): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgcatagnn

SEQ ID NO: 47021 - DNA, 290 bp, Homo sapiens
  misc_feature: GYAE6OF01CIELJ.34.6.A06.1.454.CMB.1.raw
  modified_base (258)..(258): a, c, t, g, unknown or other
  misc_feature (258)..(258): n is a, c, g, or t
  modified_base (285)..(290): a, c, t, g, unknown or other
  misc_feature (285)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtntactgagcggctggcaaggcgcatagnnnnnn

SEQ ID NO: 47022 - DNA, 509 bp, Homo sapiens
  misc_feature: GYAE6OF01D4VTN.34.6.A06.1.454.CMB.1.raw
  modified_base (501)..(501): a, c, t, g, unknown or other
  misc_feature (501)..(501): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtatttgcaagttgtattactgtacaactagttgtctacacacacgtggtacgttcggcaagggaccaaggtaggaatcaaacgatgtggctgcacatctgtcttcactccttcccgcatcctgaacttcacgttgtactgnggtccggg

SEQ ID NO: 47023 - DNA, 301 bp, Homo sapiens
  misc_feature: GYAE6OF01DPBEY.34.6.A06.1.454.CMB.1.raw
  modified_base (289)..(301): a, c, t, g, unknown or other
  misc_feature (289)..(301): n is a, c, g, or t
tcagtacacgtgatcacgaccggtgctcgatttagatctactgacagggccccctggcatccccagaccaggttcacgtggcagtgggtctgggacagaccttcgacctctcaccatccaccagactggagcctgaagattttgcagtgtattactgtcaacagttggtctcacacacgtgacgttcgccaaggaccaaggtggaaatcaaacgactgtgctgcacatctgtcttcatcctcccgcatctgaactcacgtgtactgacgcggctggcaaggcgcatagnnnnnnnnnnnnn

SEQ ID NO: 47024 - DNA, 289 bp, Homo sapiens
  misc_feature: GYAE6OF01BP58Y.34.6.A06.1.454.CMB.1.raw
  modified_base (279)..(279): a, c, t, g, unknown or other
  misc_feature (279)..(279): n is a, c, g, or t
  modified_base (285)..(289): a, c, t, g, unknown or other
  misc_feature (285)..(289): n is a, c, g, or t
tcagtacacgtgatcacgaccggtgctcgatttagatctactgacagggccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaaacgaactgtggctgcaccatctgtcttcatcttccgcatctgaatcacgtgtactgagcgggctggcaaggcncatagnnnnn

SEQ ID NO: 47025 - DNA, 480 bp, Homo sapiens
  misc_feature: GYAE6OF01BGW25.34.6.A06.1.454.CMB.1.raw
  modified_base (124)..(124): a, c, t, g, unknown or other
  misc_feature (124)..(124): n is a, c, g, or t
  modified_base (285)..(288): a, c, t, g, unknown or other
  misc_feature (285)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (319)..(320): a, c, t, g, unknown or other
  misc_feature (319)..(320): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (472)..(472): a, c, t, g, unknown or other
  misc_feature (472)..(472): n is a, c, g, or t
tcagtacacgtgatcacgaccggtgctcgatttagatctactgacagggccccgtggcatcccagacccactgccactgaaactgtctgggacagacttcactctcaccatcaccagactggancctgaagattttgcagtgtattactgtcaacagttggtctcacacacgtggacgttcggccaagggccaaggtggaaatcgaaacgactgtggctgcaccgatctgtcttcatcttccgcatctgaatcacgtgactgagcgggctggcaaggcgcatagnnnngncngtagcatgacngctgnacngtacntanngtcngcagcantgctcgatcatcntcncgtncatngntnatntagtctgctacnagtcatcgntacgtccgtanacgtcttaacgngttaaccggcgtagtacgtaaccgttcgacgttacggacggtacttacggacccgtagttacccgnggttaccg

SEQ ID NO: 47026 - DNA, 289 bp, Homo sapiens
  misc_feature: GYAE6OF01BPXY2.34.6.A06.1.454.CMB.1.raw
  modified_base (284)..(289): a, c, t, g, unknown or other
  misc_feature (284)..(289): n is a, c, g, or t
tcagtacacgtgatcacgaccggtgctcgatttagatctactgacagggccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcgcatagnnnnnn

SEQ ID NO: 47027 - DNA, 383 bp, Homo sapiens
  misc_feature: GYAE6OF01AP493.34.6.A06.1.454.CMB.1.raw
  modified_base (375)..(383): a, c, t, g, unknown or other
  misc_feature (375)..(383): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtctcatctccgcatctgaatcacgtgtactgagcggctggcaaggcgcatagnnnnnnnnn

SEQ ID NO: 47028 - DNA, 505 bp, Homo sapiens
  misc_feature: GYAE6OF01A0P8Q.34.6.A06.1.454.CMB.1.raw
  modified_base (266)..(266): a, c, t, g, unknown or other
  misc_feature (266)..(266): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtncatactacagggccccctggcatcccagacaggttcagtggcagtgggtctgggacagacttcactctcaccatcaccagactggagcctgaagtattttgcagtgtattactgtcaactagttggtctcacacacgtggacgttcggaccaagggaccaagggtagaaatcgaaacgactgtgctgcaccatctgtcttcatcctcccgctatctgaactcacgtntactgngtcggg

SEQ ID NO: 47029 - DNA, 385 bp, Homo sapiens
  misc_feature: GYAE6OF01CL6KX.34.6.A06.1.454.CMB.1.raw
  modified_base (377)..(385): a, c, t, g, unknown or other
  misc_feature (377)..(385): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcacatctgtctcatcttccgcatctgaatcacgtgtactgagcgggctggcaaggcgacatagnnnnnnnnn

SEQ ID NO: 47030 - DNA, 289 bp, Homo sapiens; identical to SEQ ID NO: 47015
  misc_feature: GYAE6OF01E3TBK.34.6.A06.1.454.CMB.1.raw
  modified_base (286)..(289): a, c, t, g, unknown or other
  misc_feature (286)..(289): n is a, c, g, or t

SEQ ID NO: 47031 - DNA, 514 bp, Homo sapiens
  misc_feature: GYAE6OF01B7TJQ.34.6.A06.1.454.CMB.1.raw
  modified_base (168)..(168): a, c, t, g, unknown or other
  misc_feature (168)..(168): n is a, c, g, or t
  modified_base (204)..(204): a, c, t, g, unknown or other
  misc_feature (204)..(204): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaagggggaaangccaccctctcctgcagggccagtcagagtgttaanagcatctacttagcctggtaccagcagaaacctggccagcctccagactcctcattaatggtgcatactacagggcccctggcactcccagacccactcgccactcgaacctgtctgggacagacttcactctcaccatcaccagactggagcctagaacgtattttgctagtatacttactgtcagcaatatcgagacgcactgtggcgttcggacaagggaccaaggtgaaatcgaaacgaactgtagacgtgacacactctgtcttctatccttccgcctattctcgtaactacacttgtcgtacgg

SEQ ID NO: 47032 - DNA, 301 bp, Homo sapiens
  misc_feature: GYAE6OF01CLJIW.34.6.A06.1.454.CMB.1.raw
  modified_base (271)..(271): a, c, t, g, unknown or other
  misc_feature (271)..(271): n is a, c, g, or t
  modified_base (287)..(301): a, c, t, g, unknown or other
  misc_feature (287)..(301): n is a, c, g, or t
tcagtacacgtgatcacgaccggtgctcgatttagatctactgacagggccctggcatcccagacccactgccactgaacctgtctgggacagacttcactctcaccatcaccagactggagcctgaagattttgcagtgtattactgtcaacagttggtctcacacacgtggacgttcggccaaagggaccaaggtggaaaatcaaaacgaactgtggctgcaccatctgtcttcatcttccgcatctgaatcacgtgtactgagcgggntggcaaggcgcatagnnnnnnnnnnnnnnn

SEQ ID NO: 47033 - DNA, 299 bp, Homo sapiens
  misc_feature: GYAE6OF01DKC8I.34.6.A06.1.454.CMB.1.raw
  modified_base (282)..(282): a, c, t, g, unknown or other
  misc_feature (282)..(282): n is a, c, g, or t
  modified_base (287)..(299): a, c, t, g, unknown or other
  misc_feature (287)..(299): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagtattttgcagtgtattactgtcaacagttggtctcacacacgtggacgttcggccaagggaccaaggtggaaaatcaaacgaactgtggctgcacatctgtcttcatccttccgcatctagaatcacgtgtactgagcggctggcaaggcgnatagnnnnnnnnnnnnn

SEQ ID NO: 47034 - DNA, 298 bp, Homo sapiens
  misc_feature: GYAE6OF01C9UD9.34.6.A06.1.454.CMB.1.raw
  modified_base (287)..(298): a, c, t, g, unknown or other
  misc_feature (287)..(298): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaaatcaaacgaactgtggctgcaccatctgtcttcatcttcccgcatctgaatcacgtgtactgagcgggctggcaaggcacatagnnnnnnnnnnnn

SEQ ID NO: 47035 - DNA, 537 bp, Homo sapiens
  misc_feature: GYAE6OF01D7G7A.34.6.A06.1.454.CMB.1.raw
  modified_base (531)..(531): a, c, t, g, unknown or other
  misc_feature (531)..(531): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacaggcccctggcactccagacaggttcagtggcaggtgggtcgtgggacagtacttcactctacaccatcacagacgtggacgcctgaagtatttgactagtagttattactgtacaacgtagttcgtctacacacgacgtacggtacgttcggaccgaagggacgaaggtaggaatacgaaacgtacgtaggtagcgtagacaccgtatctcgtctcgacttcctacccgctctctagaactcgacgtagtactggngtcggg

SEQ ID NO: 47036 - DNA, 293 bp, Homo sapiens
  misc_feature: GYAE6OF01BDMJ4.34.6.A06.1.454.CMB.1.raw
  modified_base (285)..(293): a, c, t, g, unknown or other
  misc_feature (285)..(293): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaataaaacgaactgtggctgcaccatctgtcttcatcttccgcatctgaatcacgtgtactgagcggctggacaaggctcatagnnnnnnnnn

SEQ ID NO: 47037 - DNA, 290 bp, Homo sapiens
  misc_feature: GYAE6OF01E4XBO.34.6.A06.1.454.CMB.1.raw
  modified_base (279)..(279): a, c, t, g, unknown or other
  misc_feature (279)..(279): n is a, c, g, or t
  modified_base (285)..(290): a, c, t, g, unknown or other
  misc_feature (285)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagtattttgcagtgtattactgtcaacagttggtctcacacacgtggacgttcggccaagggaccaaggtggaaatcaaacgaactgtggctgcaccatctgtcttcatctcccgcatctgaatcacgtgtactgagcggctggcaaggcncatagnnnnnn

SEQ ID NO: 47038 - DNA, 382 bp, Homo sapiens
  misc_feature: GYAE6OF01AKOL4.34.6.A06.1.454.CMB.1.raw
  modified_base (375)..(382): a, c, t, g, unknown or other
  misc_feature (375)..(382): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcacatctgtctcatctccgcatctgaatcacgtgtactgagcggctggcaaggcgacatagnnnnnnnn

SEQ ID NO: 47039 - DNA, 505 bp, Homo sapiens
  misc_feature: GYAE6OF01CRF72.34.6.A06.1.454.CMB.1.raw
  modified_base (482)..(482): a, c, t, g, unknown or other
  misc_feature (482)..(482): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacagggcccctggcatcccagacaggttcagtggcagtgggtctgggacagacttcactctcaccatcaccagactggagcctgaagtattttgcagtgtattactgtcaatagttggtctcacactacgtggacgttcggcctaagggaccaagggtggaaatcgaaacgaactggtgctgcacatctgtcttcatcttcccgcatctnaactcacgtgtactgagtccggg

SEQ ID NO: 47040 - DNA, 298 bp, Homo sapiens
  misc_feature: GYAE6OF01EH18E.34.6.A06.1.454.CMB.1.raw
  modified_base (282)..(298): a, c, t, g, unknown or other
  misc_feature (282)..(298): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaactagttgtactcacacacgtggacgttcggccaagggaccaaggtggaaatcaaacgactgtgctgcacatctgtcttcatctccgcatctgaatcacgtgtactgagcggctggacaaggcgcatagnnnnnnnnnnnnnnnnn

SEQ ID NO: 47041 - DNA, 332 bp, Homo sapiens
  misc_feature: GYAE6OF01DYO4S.34.6.A06.1.454.CMB.1.raw
  modified_base (288)..(288): a, c, t, g, unknown or other
  misc_feature (288)..(288): n is a, c, g, or t
  modified_base (290)..(332): a, c, t, g, unknown or other
  misc_feature (290)..(332): n is a, c, g, or t
tcagtacacgtgatcacgaccggtgctcgatttagatctactgacagggtccccgtggcatacccagacaggtttcagtggacagtcgggtctgggacagacttcactctcaccatcagcagacttgagccttgaagattttgcagtatattactgtcagcaatatcgagacgcactgtgggcgttcggccaagggccaaggtggaaatcgaaacgactgtggctgcaccatctgtctcatcttccgcatctgaatcagtgtactgagcggctggcaaggcgcatagngnnnnnnnnnnnnnnnnnnnnnnnnnnnnnnnnnnnnnnnnnnn

SEQ ID NO: 47042 - DNA, 382 bp, Homo sapiens
  misc_feature: GYAE6OF01C99SR.34.6.A06.1.454.CMB.1.raw
  modified_base (372)..(372): a, c, t, g, unknown or other
  misc_feature (372)..(372): n is a, c, g, or t
  modified_base (378)..(382): a, c, t, g, unknown or other
  misc_feature (378)..(382): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcncatagnnnnn

SEQ ID NO: 47043 - DNA, 388 bp, Homo sapiens
  misc_feature: GYAE6OF01DZ9RA.34.6.A06.1.454.CMB.1.raw
  modified_base (382)..(388): a, c, t, g, unknown or other
  misc_feature (382)..(388): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaaggggaccaaggtggaaaatcaaaacgaactgtggctgcaccatctgtcttcatcttcccgcatctgaatcacgtgtactgagcgggctggcaaggcgcatagnnnnnnn

SEQ ID NO: 47044 - DNA, 291 bp, Homo sapiens
  misc_feature: GYAE6OF01C15TV.34.6.A06.1.454.CMB.1.raw
  modified_base (287)..(291): a, c, t, g, unknown or other
  misc_feature (287)..(291): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgcatagnnnnn

SEQ ID NO: 47045 - DNA, 389 bp, Homo sapiens
  misc_feature: GYAE6OF01D57JY.34.6.A06.1.454.CMB.1.raw
  modified_base (378)..(389): a, c, t, g, unknown or other
  misc_feature (378)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtctcatcttcccgcatctgaatcacgtgtactgagcgggctggcaaggcgcaatgnnnnnnnnnnnn

SEQ ID NO: 47046 - DNA, 286 bp, Homo sapiens
  misc_feature: GYAE6OF01EBDIG.34.6.A06.1.454.CMB.1.raw
  modified_base (274)..(274): a, c, t, g, unknown or other
  misc_feature (274)..(274): n is a, c, g, or t
  modified_base (280)..(286): a, c, t, g, unknown or other
  misc_feature (280)..(286): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtgaaatcaaacgactgtggctgcacatctgtctcatcttcccgctctgaatcacgtgtactgagcggctggcaaggcncatagnnnnnnn

SEQ ID NO: 47047 - DNA, 302 bp, Homo sapiens
  misc_feature: GYAE6OF01AL3M8.34.6.A06.1.454.CMB.1.raw
  modified_base (264)..(264): a, c, t, g, unknown or other
  misc_feature (264)..(264): n is a, c, g, or t
  modified_base (288)..(302): a, c, t, g, unknown or other
  misc_feature (288)..(302): n is a, c, g, or t
tcagtacacgtgatcacgaccggtgctcgatttagatctactgacagggcccctggcatcccagaccaggttcagtggcagtgggtctgggacagacttcgacctctcaccatcaccagactggagcctgaagattttgcagtgtattactgtcaacagttggtctcacacacgtggacgttcggccaagggaccaaggtggaaatcaaacgactgtgctgcaccatctgtctcatccttcccgcatctgaactcacgtgtacngagcgggctggcaaggcgcatagnnnnnnnnnnnnnnn

SEQ ID NO: 47048 - DNA, 384 bp, Homo sapiens
  misc_feature: GYAE6OF01DG55T.34.6.A06.1.454.CMB.1.raw
  modified_base (373)..(373): a, c, t, g, unknown or other
  misc_feature (373)..(373): n is a, c, g, or t
  modified_base (378)..(384): a, c, t, g, unknown or other
  misc_feature (378)..(384): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtctcatcttcccgctatctgaatcacgtgtactgagcgggtctggcaaggcncatgnnnnnnn

SEQ ID NO: 47049 - DNA, 296 bp, Homo sapiens
  misc_feature: GYAE6OF01AJDY0.34.6.A06.1.454.CMB.1.raw
  modified_base (281)..(281): a, c, t, g, unknown or other
  misc_feature (281)..(281): n is a, c, g, or t
  modified_base (287)..(296): a, c, t, g, unknown or other
  misc_feature (287)..(296): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcncatagnnnnnnnnnn

SEQ ID NO: 47050 - DNA, 504 bp, Homo sapiens
  misc_feature: GYAE6OF01BU845.34.6.A06.1.454.CMB.1.raw
  modified_base (478)..(478): a, c, t, g, unknown or other
  misc_feature (478)..(478): n is a, c, g, or t
  modified_base (492)..(492): a, c, t, g, unknown or other
  misc_feature (492)..(492): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacagggcccctggcatcccagacaggttcagtggcagtgggtctgggacagacttcactctcaccatcaccagactggagcctgaagattttgctagtgtattactgtcaactagttggtctcacacacgtggacgttcggaccaagggaccaaggtggaaatcaaacgactgtggctgcaccatctgtcttcatccttcccgctntctgaactcacgtntactgagtcggg

SEQ ID NO: 47051 - DNA, 307 bp, Homo sapiens
  misc_feature: GYAE6OF01CLQW8.34.6.A06.1.454.CMB.1.raw
  modified_base (290)..(307): a, c, t, g, unknown or other
  misc_feature (290)..(307): n is a, c, g, or t
tcagtacacgtgatcacgaccggtgctcgatttagatctactgacagggcccctggcatcccagaccaggttcagtggcagtgggtctgggacagacttcgacctctcaccatcaccagactggagcctgaagattttgcagtgtattactgtcaacagttggtctcacacacgtggacgtttcggccaagggaccaaggtgaaatcaaacgactgtggctgcaccatctgtcttcatccttcccgcatctgaactcacgtgtactgacgcggctggcaaggcgcatagnnnnnnnnnnnnnnnnnn

SEQ ID NO: 47052 - DNA, 300 bp, Homo sapiens
  misc_feature: GYAE6OF01BT1HE.34.6.A06.1.454.CMB.1.raw
  modified_base (287)..(300): a, c, t, g, unknown or other
  misc_feature (287)..(300): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcgccaagggaccaaggtggaaatcaaacgaactgtggctgcacatctgtcttcatccttcccgcatctgaatcacgtgtactgaggcggctggcaaggcgacagtagnnnnnnnnnnnnnn

SEQ ID NO: 47053 - DNA, 382 bp, Homo sapiens
  misc_feature: GYAE6OF01C7XQJ.34.6.A06.1.454.CMB.1.raw
  modified_base (378)..(382): a, c, t, g, unknown or other
  misc_feature (378)..(382): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtctcatcttccgcatctgaatcacgtgtactgagcgggctggacaaggcgacatagnnnnn

SEQ ID NO: 47054 - DNA, 489 bp, Homo sapiens
  misc_feature: GYAE6OF01BDN9O.34.6.A06.1.454.CMB.1.raw
  modified_base (234)..(234): a, c, t, g, unknown or other
  misc_feature (234)..(234): n is a, c, g, or t
  modified_base (391)..(391): a, c, t, g, unknown or other
  misc_feature (391)..(391): n is a, c, g, or t
  modified_base (427)..(428): a, c, t, g, unknown or other
  misc_feature (427)..(428): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (437)..(438): a, c, t, g, unknown or other
  misc_feature (437)..(438): n is a, c, g, or t
  modified_base (440)..(442): a, c, t, g, unknown or other
  misc_feature (440)..(442): n is a, c, g, or t
  modified_base (445)..(446): a, c, t, g, unknown or other
  misc_feature (445)..(446): n is a, c, g, or t
  modified_base (448)..(451): a, c, t, g, unknown or other
  misc_feature (448)..(451): n is a, c, g, or t
  modified_base (453)..(454): a, c, t, g, unknown or other
  misc_feature (453)..(454): n is a, c, g, or t
  modified_base (456)..(456): a, c, t, g, unknown or other
  misc_feature (456)..(456): n is a, c, g, or t
  modified_base (458)..(459): a, c, t, g, unknown or other
  misc_feature (458)..(459): n is a, c, g, or t
  modified_base (461)..(465): a, c, t, g, unknown or other
  misc_feature (461)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (475)..(476): a, c, t, g, unknown or other
  misc_feature (475)..(476): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
tcagtacacgtgatcacgaccggtgctcgatttagatctactgacagggcccagtccagagtcgttaatagcatcctacttagcctggtaccagaccagaaaccgtggccgagccgtcccgagaccttccctttcgagttaatgggtgcatactacgaggggccccctggccagtcccagtacaggttcagtggcgagtggtcgtgggacagacttcgactctcacatctaccngactggagtcctgaagattttgctagtgtattactgtctaacagttggtcgtcacacacggtcggacgttcggcctaagggaccaagggtcggaaagtcgaaacggaactggtcggctgccacatctgtcttcatcttccgctatctgaatcacgtntactgagcggctcggcaacgggcgacaataggctanngagtngngnngnnnagnngnnnntnngngnngnnnnngngngngntnncgcgngncngtgc

SEQ ID NO: 47055 - DNA, 557 bp, Homo sapiens
  misc_feature: GYAE6OF01CVJT5.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatgcatctacttagcctggtaccagcagaaacctggccagcctccagactcctcattaatggtgcatactacagggcccctggcatcccagacaggttcagtggcagtgggtctgggacaggacttcactctcaccatcagcaagtacttgagcctgaagtattttgctagtatattactgtcagacaatatcgagacgctacgtgtcgggtcgttcggccgaagggacgaaagggtacgggaaataaccgaaacgaacgtaggtacggcgtacggacaaccctagtacctcggttcctttactacttccttaccccgcctaacgttccttagaacttccaacgttcgttaaccgg

SEQ ID NO: 47056 - DNA, 398 bp, Homo sapiens
  misc_feature: GYAE6OF01CTX3L.34.6.A06.1.454.CMB.1.raw
  modified_base (389)..(398): a, c, t, g, unknown or other
  misc_feature (389)..(398): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgcagtgtattactgtcaactagttggtctcaacacacgtggacgttcggaccaagggaccaaggtggaaatcaaaacgactgtggctgcacatctgtcttcatcttcccgcatctgaactcaacgtgtactgacggcgggctggacaaggcgcaagtagnnnnnnnnnn

SEQ ID NO: 47057 - DNA, 582 bp, Homo sapiens
  misc_feature: GYAE6OF01CG9UG.34.6.A06.1.454.CMB.1.raw
  modified_base (532)..(537): a, c, t, g, unknown or other
  misc_feature (532)..(537): n is a, c, g, or t
  modified_base (539)..(539): a, c, t, g, unknown or other
  misc_feature (539)..(539): n is a, c, g, or t
  modified_base (541)..(544): a, c, t, g, unknown or other
  misc_feature (541)..(544): n is a, c, g, or t
  modified_base (546)..(546): a, c, t, g, unknown or other
  misc_feature (546)..(546): n is a, c, g, or t
  modified_base (548)..(549): a, c, t, g, unknown or other
  misc_feature (548)..(549): n is a, c, g, or t
  modified_base (551)..(552): a, c, t, g, unknown or other
  misc_feature (551)..(552): n is a, c, g, or t
  modified_base (554)..(554): a, c, t, g, unknown or other
  misc_feature (554)..(554): n is a, c, g, or t
  modified_base (556)..(563): a, c, t, g, unknown or other
  misc_feature (556)..(563): n is a, c, g, or t
  modified_base (565)..(566): a, c, t, g, unknown or other
  misc_feature (565)..(566): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(577): a, c, t, g, unknown or other
  misc_feature (576)..(577): n is a, c, g, or t
  modified_base (579)..(582): a, c, t, g, unknown or other
  misc_feature (579)..(582): n is a, c, g, or t
tcagtacacgtgatcacgaccggtgctcgatttagatctactgacaagggccagtacggagaggtgttaatagccaatcgtacttagcctggtaccaggcagaaacctgggcccagcctcccagacctcctcgattaatggtgcatacctacgagggcccctggcatcccagacaggttcagtggcagtgggtctgggacagaccttcacctcctcaccatccaccagactgggagcctagaaagactttttcgacctagttagttagttaccgtgtacaaaccgagtttcggtacttcaactactacggtggtacgtttccggacctaaggggacctaaagggtagggaaaactaaccgaaaacgggaacctaggtaccggaccttcggacaccctattccgtgttccttcaacttccctttaccccggacctaagttccgtacgaacttacgtaacggttagtaccgttaggaacgggtcgggtcttcggggacgtaaacgggtcggtacttaacgttacggcagcagcnnnnnngnannnnananntnnanannnnnnnncnngngngngngnnannnn

SEQ ID NO: 47058 - DNA, 532 bp, Homo sapiens
  misc_feature: GYAE6OF01EAKN6.34.6.A06.1.454.CMB.1.raw
  modified_base (501)..(501): a, c, t, g, unknown or other
  misc_feature (501)..(501): n is a, c, g, or t
  modified_base (524)..(524): a, c, t, g, unknown or other
  misc_feature (524)..(524): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacagggcccctggcatcccagacaggttcagtggcagtgggtctgggacagacttcactctcaccatcaccagactggagcctagaagtattttgctagttgtatttactgtactaacgtagttggtctacactaccgtacggtcggtacgttccggaccgaagggaccaagggtaggaaatcgaaacgactgtaggctagacaccatctgtctcactccttcccgctntcctagaactcacgtagtactgnggtccggg

SEQ ID NO: 47059 - DNA, 384 bp, Homo sapiens
  misc_feature: GYAE6OF01BTEEC.34.6.A06.1.454.CMB.1.raw
  modified_base (373)..(373): a, c, t, g, unknown or other
  misc_feature (373)..(373): n is a, c, g, or t
  modified_base (379)..(384): a, c, t, g, unknown or other
  misc_feature (379)..(384): n is a, c, g, or t
tcagtacacgtgatcacgaccggtgctcgatttagatctactgacaggaccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcacatctgtctcatcttccgccatcctgaactcacgtgtactgagcgggctggcaaggcncatagnnnnnn

SEQ ID NO: 47060 - DNA, 652 bp, Homo sapiens
  misc_feature: GYAE6OF01CWQ63.34.6.A06.1.454.CMB.1.raw
  modified_base (166)..(166): a, c, t, g, unknown or other
  misc_feature (166)..(166): n is a, c, g, or t
  modified_base (265)..(265): a, c, t, g, unknown or other
  misc_feature (265)..(265): n is a, c, g, or t
  modified_base (355)..(355): a, c, t, g, unknown or other
  misc_feature (355)..(355): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaanagccaccctctcctgcagggccagtcagagtgttaatagcatctacttagcctggtaccagcagaacctggccagcctccagactcctcattaatggtncatactacgacggcccctggcactcccagactaggttcagtgctaggtggtctagggacagacttcactctacacatcacagactggacnctagaagtatttgactagttgtattacgtgtactaacgtagttggtacctacaacgtacgtacggtagggtaccgttaccgggaaccgtaaacggggaaccgtaaagggtaagggaaaaccgtacgtaaaaccggtacgttacgggtacggtaccgttacgacccgtaacccgtaagttccgttacggttaccctttaccgtaccgtttcccgttacccccgccgttaactttacccgtagttaaaccgttccgtaaccggttaggttaacccggttgggaccgggttacccggggg

SEQ ID NO: 47061 - DNA, 293 bp, Homo sapiens
  misc_feature: GYAE6OF01DVYVP.34.6.A06.1.454.CMB.1.raw
  modified_base (286)..(293): a, c, t, g, unknown or other
  misc_feature (286)..(293): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaaacgaactgtggctgcaccatctgtcttcacttcccgcatctgaatcacgtgtactgagcgggctggcaaggcgcatagnnnnnnnn

SEQ ID NO: 47062 - DNA, 625 bp, Homo sapiens
  misc_feature: GYAE6OF01DANCE.34.6.A06.1.454.CMB.1.raw
  modified_base (266)..(266): a, c, t, g, unknown or other
  misc_feature (266)..(266): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaagagccaccctctcctgcagggccagtcagagtgttaatagcatctacttagcctggtaccagcagaacctggccagcctccagactcctcattaatggtncatactacacgggcccctggcactcccagacaggttcaggtggcaggtgggtctgggacagacttcactctacaccatccaccagacgtggacgtcctaggtaagtattttgactaggttgtaatttactgtactaacgtaggtttcggtactacgaactaccgtacggtacgggtaccgtttaccggaccgtaacggggacccgtaaagggtacggtaaacgtaccgaaacggtaaccgttaggtacggacgttcgaccgtaacctacgttccgttcgttaccttactacgttccgttaccccgtacctacgttacctacgtaacttccgtaacgttagttaacgtggacggtccggg

SEQ ID NO: 47063 - DNA, 511 bp, Homo sapiens
  misc_feature: GYAE6OF01DW2J8.34.6.A06.1.454.CMB.1.raw
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatgtgcatactacacggccctggcatcccagacaggttcagtggcaggtgggtctgggacagacttcactctcaccatcacagactggacgcctgaagtatttgactagtgtattactgtacaactagttgtcacacacacgtggacgttcgaccgaagggacaaggtagaaatacgaaacgtaactgtggctagacacctatctgtcttcatccttcccgctatctgaactctaacgtgtacngngcggg

SEQ ID NO: 47064 - DNA, 660 bp, Homo sapiens
  misc_feature: GYAE6OF01EFJHM.34.6.A06.1.454.CMB.1.raw
  modified_base (264)..(264): a, c, t, g, unknown or other
  misc_feature (264)..(264): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaacctggccagcctccagactcctcattaatggncatactacgacgggcccctggcatccccagactaggttcagtgctaggtggtcgtgggacagacttcactcacacatcacagactggactctaggtaagtactttgactagttagttattacgtgtactaacgtaggtttcggacctacgaacgtaccggtacggtacgggtaacccgtttaccgggaacccggtaaacggggtacccgtaaaggggttacgggaaaaccgttaaccggaaaaccgggtacgttacggggtacggtaccgttacgaccctaaccgtacgttccggttaccgttaccttaccgtaccgtttcccgttacccccgacttacttaccgttacgtaaacgttccgtaaccggttattaccggtcgggacgggtacccggg

SEQ ID NO: 47065 - DNA, 284 bp, Homo sapiens
  misc_feature: GYAE6OF01B20SP.34.6.A06.1.454.CMB.1.raw
  modified_base (281)..(284): a, c, t, g, unknown or other
  misc_feature (281)..(284): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttgtctcacacacgtggacgttcggccaagggaccaaggtggaaatcaaacgactgtgctgcaccatctgtcttcatctcccgcatctgaatcacgtgtactgagcggctggcaaggcgcatagnnnn

SEQ ID NO: 47066 - DNA, 546 bp, Homo sapiens
  misc_feature: GYAE6OF01A4V5Y.34.6.A06.1.454.CMB.1.raw
  modified_base (267)..(267): a, c, t, g, unknown or other
  misc_feature (267)..(267): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagactcccaggctcctcatctatggtncatccaccagggccactggtactcccgaggcaggttcaggtggcaggtgggtctgggacagagttcactctcaccatcagcagtctgcagtctagaagtattttgctagtttattactgtcagtcactaataagtagtcggcctccgatcctaccgttacggaccgaagggacaacgacgtagggaagtaacgttaaacgaacgtggtcggctcgacctaacctagttccgttgttccttctaccttccttcccgctacttactacgtaactcgtacgg

SEQ ID NO: 47067 - DNA, 388 bp, Homo sapiens
  misc_feature: GYAE6OF01DGSW0.34.6.A06.1.454.CMB.1.raw
  modified_base (378)..(378): a, c, t, g, unknown or other
  misc_feature (378)..(378): n is a, c, g, or t
  modified_base (384)..(388): a, c, t, g, unknown or other
  misc_feature (384)..(388): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaaatcaaaacgaactgtggctgcaccatctgtcttcattcttcccgccatctgaaatcacgtgtactgagcgggctggcaaggcncatagnnnnn

SEQ ID NO: 47068 - DNA, 297 bp, Homo sapiens
  misc_feature: GYAE6OF01DX7JK.34.6.A06.1.454.CMB.1.raw
  modified_base (286)..(297): a, c, t, g, unknown or other
  misc_feature (286)..(297): n is a, c, g, or t
tcagtacacgtgatcacgaccggtgctcgatttagatctactgacagggcccctggcatcccagacaggttcagtggcagtgggtctggggacagacttcgacctctcaccatcaccagactggagcctgaagattttgcagtgtattactgtcaacagttggtctcacacacgtggacgttcggccaagggaccaaggtggaaatcaaacgactgtggctgcaccatctgtcttcatcttcccgcatctgaatcacggtactgagcggctggcaaggcgcatagnnnnnnnnnnnn

SEQ ID NO: 47069 - DNA, 290 bp, Homo sapiens
  misc_feature: GYAE6OF01EJHJX.34.6.A06.1.454.CMB.1.raw
  modified_base (268)..(268): a, c, t, g, unknown or other
  misc_feature (268)..(268): n is a, c, g, or t
  modified_base (284)..(290): a, c, t, g, unknown or other
  misc_feature (284)..(290): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgtaccatctgtcttcatcttccgcatctgaatcacgtgtactgagcggntggcaaggcgcatagnnnnnnn

SEQ ID NO: 47070 - DNA, 455 bp, Homo sapiens
  misc_feature: GYAE6OF01A3FAK.34.6.A06.1.454.CMB.1.raw
  modified_base (410)..(411): a, c, t, g, unknown or other
  misc_feature (410)..(411): n is a, c, g, or t
  modified_base (413)..(413): a, c, t, g, unknown or other
  misc_feature (413)..(413): n is a, c, g, or t
  modified_base (416)..(419): a, c, t, g, unknown or other
  misc_feature (416)..(419): n is a, c, g, or t
  modified_base (421)..(455): a, c, t, g, unknown or other
  misc_feature (421)..(455): n is a, c, g, or t
tcagtacacgtgatcacgaccggtgctcgatttagatctactgacagggccagtacgagagtgttaatagcatctacttaggcctggtaccagccagaaacctggccagcctcccctagactcctcattaatggtgccatactacagggcccctggcaattcccagacaggttcagtggcagtgggtctgggacagacttcactctcgaccgatccaccagacctgggagccgtcgaagatttttgcaggttggtattacgtagtcaaccagttggtctcacacacgtcggacgttccggccaagggaccaaggtcgaaatcaaacgaactgtggctggccacatctcgtcttcgatcttcccgccatcgtgaatcacgtgtactgagcggctggcaaggccgcatagcnncnatnnnntnnnnnnnnnnnnnnnnnnnnnnnnnnnnnnnnnnn

SEQ ID NO: 47071 - DNA, 389 bp, Homo sapiens
  misc_feature: GYAE6OF01CGZKD.34.6.A06.1.454.CMB.1.raw
  modified_base (352)..(352): a, c, t, g, unknown or other
  misc_feature (352)..(352): n is a, c, g, or t
  modified_base (383)..(389): a, c, t, g, unknown or other
  misc_feature (383)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtgaaatcaaaacgaactgtggctgcaccatctgtcttcactcttcccgcatctgaatcacgtntactgaggcgggctggcaaggcgacagtagnnnnnnn

SEQ ID NO: 47072 - DNA, 386 bp, Homo sapiens
  misc_feature: GYAE6OF01DPVWS.34.6.A06.1.454.CMB.1.raw
  modified_base (374)..(374): a, c, t, g, unknown or other
  misc_feature (374)..(374): n is a, c, g, or t
  modified_base (380)..(386): a, c, t, g, unknown or other
  misc_feature (380)..(386): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaaatcaaacgaactgtggctgcaccatctagtcttcatcttcccgcatctgaatcacgtgtactgagcggctggcaaggcncaatgnnnnnnn

SEQ ID NO: 47073 - DNA, 413 bp, Homo sapiens
  misc_feature: GYAE6OF01BKDND.34.6.A06.1.454.CMB.1.raw
  modified_base (338)..(338): a, c, t, g, unknown or other
  misc_feature (338)..(338): n is a, c, g, or t
  modified_base (402)..(413): a, c, t, g, unknown or other
  misc_feature (402)..(413): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgctagtgttattactgtacaactagttggtctcacacacgtggacgttcggaccaagggaccgaaaggtggaaaatcgaaaacgacgtgtaggctgcaccatctgtcttnactctcccgctatctagaatcacgtgtactcggaggcgggtctcgggacaagggcgacagtagnnnnnnnnnnnn

SEQ ID NO: 47074 - DNA, 384 bp, Homo sapiens
  misc_feature: GYAE6OF01BKG81.34.6.A06.1.454.CMB.1.raw
  modified_base (373)..(373): a, c, t, g, unknown or other
  misc_feature (373)..(373): n is a, c, g, or t
  modified_base (379)..(384): a, c, t, g, unknown or other
  misc_feature (379)..(384): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgcatctgaatcacgtgtactgagcgggctggcaagggcncatagnnnnnn

SEQ ID NO: 47075 - DNA, 292 bp, Homo sapiens; identical to SEQ ID NO: 46998
  misc_feature: GYAE6OF01B8W49.34.6.A06.1.454.CMB.1.raw
  modified_base (286)..(292): a, c, t, g, unknown or other
  misc_feature (286)..(292): n is a, c, g, or t

SEQ ID NO: 47076 - DNA, 521 bp, Homo sapiens
  misc_feature: GYAE6OF01CBBMO.34.6.A06.1.454.CMB.1.raw
  modified_base (289)..(289): a, c, t, g, unknown or other
  misc_feature (289)..(289): n is a, c, g, or t
  modified_base (491)..(491): a, c, t, g, unknown or other
  misc_feature (491)..(491): n is a, c, g, or t
  modified_base (514)..(514): a, c, t, g, unknown or other
  misc_feature (514)..(514): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccagggggaaagagccaccctctcctgcagggccagtcagagtgttaatagcatctacttagcctggtaccagcagaaacctggccagcctccagactcctcattaatggtgcatactacagggcccctggcanccctttttagacaggttcagtggcagtgggtctgggacagacttcactctcaccatcaccagactggagcctgaagtatttgctagttgtattactgtacaactagttggtctcacacacgtggtacgttcggccgaagggaccgaaggtaggaatacgaaacgaacgtgtggctgcaccatctgtcttctactccttcccncctctctgactcacgtgtactgnggtcggg

SEQ ID NO: 47077 - DNA, 630 bp, Homo sapiens
  misc_feature: GYAE6OF01BRNY4.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaacctggccagccctccagacctcctcattaatggtgcatactacgacgggcccctggcactcccagacaggttcagtggcaggtgggtctgggacagacttcactctcacactcaaccagactggagcctagaacgtattttgcgtagttgtattacgtgtactaactaggttgtctacactacgtacggtacggtaccggttccggaccgtaacggggaaccgtaagggtacggtaaacgttaccgaaaacggtaaccgttagggtacggacgttacggacctaccgtagtccttggttaccttaccgtaaccgttcccgttacccccggtacctacgttccgttacggtaacgttaccgtacggttacgttaaccgttcgggacgggtacccggggg

SEQ ID NO: 47078 - DNA, 311 bp, Homo sapiens
  misc_feature: GYAE6OF01CT1IY.34.6.A06.1.454.CMB.1.raw
  modified_base (220)..(220): a, c, t, g, unknown or other
  misc_feature (220)..(220): n is a, c, g, or t
  modified_base (303)..(311): a, c, t, g, unknown or other
  misc_feature (303)..(311): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggaccgaaagggaccaaggtagaaaatcaaaacgaactgnggctgcaccatctgtcttcactcttcccgctatcctagaactcacgtgtaactggacgcgggctggaccaaggcgtacatagnnnnnnnnn

SEQ ID NO: 47079 - DNA, 302 bp, Homo sapiens
  misc_feature: GYAE6OF01EE67E.34.6.A06.1.454.CMB.1.raw
  modified_base (295)..(302): a, c, t, g, unknown or other
  misc_feature (295)..(302): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcaattttattactgtcagctgcgtagcaactggcctcccttgagcgccttcggccgagggacacgactggagattaaacgactgtggctgcaccatctgtcttcatccttcccgccatctgaatcacgtgtactgacgcgggctggcaaggcgcatagnnnnnnnn

SEQ ID NO: 47080 - DNA, 389 bp, Homo sapiens
  misc_feature: GYAE6OF01EUOB4.34.6.A06.1.454.CMB.1.raw
  modified_base (375)..(389): a, c, t, g, unknown or other
  misc_feature (375)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtctcatctccgcatctgaatcacgtgtactgagcggctggcaaggcgcatagnnnnnnnnnnnnnnn

SEQ ID NO: 47081 - DNA, 309 bp, Homo sapiens
  misc_feature: GYAE6OF01DKFA1.34.6.A06.1.454.CMB.1.raw
  modified_base (297)..(309): a, c, t, g, unknown or other
  misc_feature (297)..(309): n is a, c, g, or t
tcagtacacgtgatcacgaccggtgctcgatttagatctactgacagggcccctggcatcccagaccaggttcacgtggcacgtgggtctggggacagaccttcgacctctcaccatcaccagactggagcctgaagtatttgcagtgtattactgtcaacagttggtctcacacacgtggacgtttcggccaagggccaaggtgaaatcaaacgactgtggctgacaccatctgtcttcatccttacccgccatctgaactcacgtgtactgagcgggctggcaaggcgcagtagnnnnnnnnnnnnn

SEQ ID NO: 47082 - DNA, 389 bp, Homo sapiens
  misc_feature: GYAE6OF01D56ER.34.6.A06.1.454.CMB.1.raw
  modified_base (380)..(389): a, c, t, g, unknown or other
  misc_feature (380)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgcagtgtattactgtcaacagttggtctcacacacgtggacgttcggccaaaggggaccaaggtggaaatacaaacgaactgtggctgcacatctgtctcatcttccgcatctgaatcacgtgtactgacgcggctggcaaggcacatagnnnnnnnnnn

SEQ ID NO: 47083 - DNA, 319 bp, Homo sapiens
  misc_feature: GYAE6OF01B5JJY.34.6.A06.1.454.CMB.1.raw
  modified_base (297)..(319): a, c, t, g, unknown or other
  misc_feature (297)..(319): n is a, c, g, or t
tcagtacacgtgatcacgaccggtgctcgatttagatctactgacagggcccctggcatcccagacccactgccactgaacctgtcgtgggacagacttcactcgtcaccatcaccagactggagcctgaagattttgcagtgtattactgtcaacagttggtctcacacacgtggacgttcggccaagggaccaaggtggaaaatcaaaacgaactgtggctgcaccgatctagtcttcatcttcccgctatctgaattcacgtgtaactgagacgggctaggcaaggcgcatagnnnnnnnnnnnnnnnnnnnnnnn

SEQ ID NO: 47084 - DNA, 307 bp, Homo sapiens
  misc_feature: GYAE6OF01CFP6U.34.6.A06.1.454.CMB.1.raw
  modified_base (285)..(307): a, c, t, g, unknown or other
  misc_feature (285)..(307): n is a, c, g, or t
tcagtacacgtgatcacgaccggtgctcgatttagatctactgacagggcccctggcatcccagaccaggttcagtggcagtgggtctgggacagacttcgactctcaccatcaccagactggagcctgaagattttgcagtgtattactgtcaacagttggtctcacacacgtggacgttcggccaagggaccaaggtggaaatcaaacgactgtggctgcacatctgtcttcatctcccgcatctgaatcacgtgaactgagcgggctggcaaggcgcatagnnnnnnnnnnnnnnnnnnnnnnn

SEQ ID NO: 47085 - DNA, 386 bp, Homo sapiens
  misc_feature: GYAE6OF01ANPNJ.34.6.A06.1.454.CMB.1.raw
  modified_base (378)..(386): a, c, t, g, unknown or other
  misc_feature (378)..(386): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcgcatagnnnnnnnnn

SEQ ID NO: 47086 - DNA, 519 bp, Homo sapiens
  misc_feature: GYAE6OF01EVJUT.34.6.A06.1.454.CMB.1.raw
  modified_base (370)..(370): a, c, t, g, unknown or other
  misc_feature (370)..(370): n is a, c, g, or t
  modified_base (406)..(406): a, c, t, g, unknown or other
  misc_feature (406)..(406): n is a, c, g, or t
  modified_base (484)..(484): a, c, t, g, unknown or other
  misc_feature (484)..(484): n is a, c, g, or t
tcagtacacgtgatcacgaccggtgctcgatttagatctactgacagggaaccatggaaaccccagcgcagcttctcttcctcctgctactctggctcccagacaccactggagaaatagtgatgacgcagtctccagccaccctgtctgtgtctccaggggaaagagccaccctctcctgcagggccagtcagagtgttagcggctacttagcctggtaccagcagaaacctggccaggctcccaggctcctcatctatgatgcgtccaacgagggccacgtggcactcccagccaggttcagtcggcgagtgggtctgggccagaccttcactctcacctatcagcagcctaggacgaccgtaaagtnttttagacttaatttattactgtctagtctgcgtancactcgcctcctgacgcgtccgttcgggccgaggacacggcgtaggagtattaaacgactggtggtctcgctaccgtntctgtcttctcttccttcccgactatctgtatccg

SEQ ID NO: 47087 - DNA, 557 bp, Homo sapiens
  misc_feature: GYAE6OF01A8J1L.34.6.A06.1.454.CMB.1.raw
  modified_base (164)..(164): a, c, t, g, unknown or other
  misc_feature (164)..(164): n is a, c, g, or t
  modified_base (174)..(174): a, c, t, g, unknown or other
  misc_feature (174)..(174): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctcaggggaanagccaccctntcctgcagggccagtcagagtgttaatagcatctacttagcctggtaccagcagaaacctggccagcctccagacctcctcattaatggtgcatactacgacgggcccctggcatcccagacaggttcagtggcaggtgggtctgggacagtacttcactcctacaccatcacagactggacgtctagaagtgtttgactagttcgttattactgtacaactggttcgtctacacacgacggtcggtacgtccggacgaacgggtactaagggtagaataccgaaacgtacgtggtcgatcgactaccagttctacgttcctactacgttccgttacccgactacttctagaacttcgtacgttacgtacgtggacggtcggg

SEQ ID NO: 47088 - DNA, 299 bp, Homo sapiens
  misc_feature: GYAE6OF01AIVGP.34.6.A06.1.454.CMB.1.raw
  modified_base (284)..(284): a, c, t, g, unknown or other
  misc_feature (284)..(284): n is a, c, g, or t
  modified_base (290)..(299): a, c, t, g, unknown or other
  misc_feature (290)..(299): n is a, c, g, or t
tcagtacacgtgatcacgaccggtgctcgatttagatctactgacagggcccctggcatcccagaccaggttcagtggcagtgggtctggggacagacttcgacctctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaggcncatagnnnnnnnnnn

SEQ ID NO: 47089 - DNA, 402 bp, Homo sapiens
  misc_feature: GYAE6OF01DO462.34.6.A06.1.454.CMB.1.raw
  modified_base (324)..(324): a, c, t, g, unknown or other
  misc_feature (324)..(324): n is a, c, g, or t
  modified_base (391)..(402): a, c, t, g, unknown or other
  misc_feature (391)..(402): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgctagtgtattactgtcaacagttggtctcacacacgtggacgttcggccaagggaccaaggtaggaaatcaaaacgaactggtaggctgcaccntctgtctcattcctccgcatctgaactcacgtgtactgacgcgggctgggacaaggcgacaagtagnnnnnnnnnnnn

SEQ ID NO: 47090 - DNA, 844 bp, Homo sapiens
  misc_feature: GYAE6OF01BR3QG.34.6.A06.1.454.CMB.1.raw
  modified_base (181)..(181): a, c, t, g, unknown or other
  misc_feature (181)..(181): n is a, c, g, or t
tcagtacacgtgatcacgaccggtgctcgatttagatctactgacagggaaccatggaaacccagcgcagcttctcttcctcctgctactctggcctcccagacaccactggaagaaatagtgatgacgcagtctccacgccacctgtctgtgtctccgaagggaaagcgccaccctctcngcgacgggccagtcgagtgtgttggcagctaactagccgtggaaccagacaagaaaccgtggccgacggtcctacccgaagtaccgttccactactcctaatcgtactaacactaccgaccgacgggccaacgtcgccttaacttccacggtcccgtaaggttcgacggtcggtacgaaggggttcgggttccgtaggggaacctaggttaacgtttaccgaaccttaccgtaccaaccgtactaccggaacgtccgaacgtccgtacggtactacgttaccggtaacgtaagttcctttaccggtactaaccgtttaacgtttttaacttaacgttcggtaacctaacggttacgtaaaccgggtttaaatttaaacgggtaaccgggttaccgggtaccgggttaacgggtaacccgggtttaacccgggaaaccccgggtaaaggggttaaaaccccgggtaaaggggtttaaaaccggggaaaaaacgttaaacccccggtaaaaaagggttaaccggttacgggtttaaccgggaacgtttccggaaaacccgtaaacccgttacgtttccgttaacccgtttacgttaaccgttacccgttaccccttaaccgtacccttaacgtagtttaacccgaaacgtttccggttaaacggg

SEQ ID NO: 47091 - DNA, 290 bp, Homo sapiens
  misc_feature: GYAE6OF01BECYC.34.6.A06.1.454.CMB.1.raw
  modified_base (283)..(290): a, c, t, g, unknown or other
  misc_feature (283)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatctccgcatctgaatcacgtgtactgagcgggctggcaaggcgcatagnnnnnnnn

SEQ ID NO: 47092 - DNA, 425 bp, Homo sapiens
  misc_feature: GYAE6OF01CK6GD.34.6.A06.1.454.CMB.1.raw
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
  modified_base (342)..(342): a, c, t, g, unknown or other
  misc_feature (342)..(342): n is a, c, g, or t
  modified_base (405)..(425): a, c, t, g, unknown or other
  misc_feature (405)..(425): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactcncaccatcaccagactgganctgaagattttgcagtgtattactgtcaacgtagttggtctacacacacgtggacgttcggaccaaaggggaccaaaggtaggaaaatccaaaaacggaactggtagctagcaaccatctgtcttnactccttccgctatctgaaatcaatgtaactggacgcgggtctaggacaaggcgacaagtagnnnnnnnnnnnnnnnnnnnnn

SEQ ID NO: 47093 - DNA, 351 bp, Homo sapiens
  misc_feature: GYAE6OF01C2CT3.34.6.A06.1.454.CMB.1.raw
  modified_base (275)..(275): a, c, t, g, unknown or other
  misc_feature (275)..(275): n is a, c, g, or t
  modified_base (305)..(351): a, c, t, g, unknown or other
  misc_feature (305)..(351): n is a, c, g, or t
tcagtacacgtgatcacgaccggtgctcgatttagatctactgacagggccccctggcatccccagaccaggttcacgtggcacgtgggtctggggacagaccttcgacctctcaccatcaccagactggagcctgaagattttgcagtgtattactgtcaacagttggtctcacacacgtggaccgtttcggccaagggaccaaggtggaaatcaaaacgaactgtggctgcaccatctgtcttcattcctcccgcatctgaatcacgtgtacngacgcgggctggacaaggccgacagtacgnnnnnnnnnnnnnnnnnnnnnnnnnnnnnnnnnnnnnnnnnnnnnnn

SEQ ID NO: 47094 - DNA, 382 bp, Homo sapiens
  misc_feature: GYAE6OF01CEAS6.34.6.A06.1.454.CMB.1.raw
  modified_base (372)..(372): a, c, t, g, unknown or other
  misc_feature (372)..(372): n is a, c, g, or t
  modified_base (378)..(382): a, c, t, g, unknown or other
  misc_feature (378)..(382): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgcatctgaatcacgtgtactgagcgggctggcaaggcncatagnnnnn

SEQ ID NO: 47095 - DNA, 384 bp, Homo sapiens
  misc_feature: GYAE6OF01CWS0E.34.6.A06.1.454.CMB.1.raw
  modified_base (379)..(384): a, c, t, g, unknown or other
  misc_feature (379)..(384): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtaggctgcaccatctgtctcatcttcccgcatctgaatcacgtgtactgagcgggctggcaaggcgcatagnnnnnn

SEQ ID NO: 47096 - DNA, 609 bp, Homo sapiens
  misc_feature: GYAE6OF01B8JFF.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaagtggtgcatactacgacggcccctggcactcccagacaggttcagtggcaggtgggtctagggacagacttcactctcaccatccaccagacgtggacgctagaagtatttgctagtgttatactgtacgtaactgttggtctacactaccgtacgtgggtaccgttacggaccgaagggtaaccgtaagggtacgaaacgtaccgtaaaacggacgtagggttacggacgtacgacgtacctagtacgttacgtacctttaccgaccgtttccttaccccggtacctacgttacccttaggtaaaccttacgtaaccggttagtttaccgagggtcgggtaccgggg

SEQ ID NO: 47097 - DNA, 389 bp, Homo sapiens
  misc_feature: GYAE6OF01DTEZX.34.6.A06.1.454.CMB.1.raw
  modified_base (383)..(389): a, c, t, g, unknown or other
  misc_feature (383)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctagaagtattttgctagtgtattactgtcaactagttggtctcacacacgtggacgttcggaccaagggaccaaggtagaaatcgaaacgactgtgctgcacatctgtctcacttcctccgctatctagactcacgtgtactgagcggctggcaaggcacatagnnnnnnn

SEQ ID NO: 47098 - DNA, 393 bp, Homo sapiens
  misc_feature: GYAE6OF01BRKTH.34.6.A06.1.454.CMB.1.raw
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (384)..(393): a, c, t, g, unknown or other
  misc_feature (384)..(393): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaaacgaactgtggctgcaccatctgtcttcatcttcccgcatctgaatcacgtgtactgagcgggntgggacaaggcncgataggnnnnnnnnnn

SEQ ID NO: 47099 - DNA, 708 bp, Homo sapiens
  misc_feature: GYAE6OF01BXAGC.34.6.A06.1.454.CMB.1.raw
tcagtacacgtgatcacgaccggtgctcgatttagatctactgacgagggccagtcagagtgttaatagcatctacttagcctggtaccagcagaaacctggccagcctcccagactcctcattaatggtgcatacgtacagggcccctggcatcccagacaggttcagtgcagtggtctgggacagacttcactctcacatcaccagactggagcctagaagtagttttgctaggtagttattaccgtgtacaacgtagttaggtctacacaacgtaccggttacggaaccggtttccggaccgtaaaggggaaccctaaagggttaggaaaacttaccgaaaaaccgtaacgttcggttacggtacttacgggacctaacccgtaacgtttccgttacggttacctttaccgtaacgtttcccgtttaccccggaccttaacgttaccgttaacgtaaacgtttacccgttaaccggttacgttaaccgtacgggtaaacggtcccggggtacgttacggggacccttaaagggggccctaacgtaaggttaacggactacgagtacgatagtacgtagtagtacgtagtagtacgtactactactactactacgtacgtacgtacgtacgacgacgacgtacgtacgtagtacgtacgtacgtacgacgtcgacgacgacgtacgtacgtatacgtcgtcgtacg

SEQ ID NO: 47100 - DNA, 643 bp, Homo sapiens
  misc_feature: GYAE6OF01DON2R.34.6.A06.1.454.CMB.1.raw
  modified_base (268)..(268): a, c, t, g, unknown or other
  misc_feature (268)..(268): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccatcaagaaacctggccagcctccagacctcctcattaatggtncatactacgaggcccctggcatcccagacaggttcagtggcgagtgggtctgggacacgtacttcactcctacaaccactaccacgacgacgtaggactcgtagaaagtgttttgctagtagttattacgtgtacaacgtgttcggtactcacaacgtacgtcggtaacgttccggacgaaacgggacgtaaaggtagggaaactaacgaaacggtaacgtagtacgggaccgttacggacctaaccgtacgttaccgttacggttacccttacgtaaaccgtttccccgttaaccccgtacccgtttaacgtccttaaaggaacccgttacggtaacccggttagtttaacggtcgggacgggttacccggggg

SEQ ID NO: 47101 - DNA, 826 bp, Homo sapiens
  misc_feature: GYAE6OF01AOC06.34.6.A06.1.454.CMB.1.raw
  modified_base (166)..(166): a, c, t, g, unknown or other
  misc_feature (166)..(166): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaanagccacctctcctgcagggccagtcagagttgttaatagcatctacttagcctggtaccagcagaacctggccagccctcccagtacctcctactagttaagtggtacgactactacctaccggaccggggccccctagggacctacgtaccccgaaggaccgtacggtttcaggttcgggacgtagggttcggggtaccgtaggggaacctacggtacctttaccgaaccttcctaccaacctacgtacccaaccgtaacggtacgtacgggacggtcccgttaaggtaaacgttcgtttttacggacgttaaggtttacgttaacgtttaaccgttacgttaaccgtaaacgttacgggtttacggttacctacgtaaccgtaaccggttaaccggggttacgggtaccgggtttacccgggtaacccggtaaacgggggtaacccgtaaaggggttaacgggtaaaacgttaaccggtaaaaccggtaacggttacgggtacgggtaccgttacgggtaccctaaccgttacgttaccgtttacgttacccttaccgttaccgttaccccgtttaccccggacccttaacgttccgtaaggtaaccttacccggttaacggttacgtttaaccgggtgggttaccgggtacccgggg

SEQ ID NO: 47102 - DNA, 337 bp, Homo sapiens
  misc_feature: GYAE6OF01DCX05.34.6.A06.1.454.CMB.1.raw
  modified_base (298)..(299): a, c, t, g, unknown or other
  misc_feature (298)..(299): n is a, c, g, or t
  modified_base (301)..(308): a, c, t, g, unknown or other
  misc_feature (301)..(308): n is a, c, g, or t
  modified_base (310)..(337): a, c, t, g, unknown or other
  misc_feature (310)..(337): n is a, c, g, or t
tcagtacacgtgatcacgaccggtgctcgatttagatctactgacagggcccctggcgatcccagacccactgccactgaacctgtactgggacagacttcactctcaccatcaccagactgggagcctgaacgattttgcaggtgtaattacctgtacaacagttggtctcacacacgtggacgttcggccaagggaccaaggtaggaaatcgaaacgactgtggctgcaccatctagtcttcatcttccgcatctgaattcacgtgtactgagcgggctggaccaaggcgcatagnncnnnnnnnncnnnnnnnnnnnnnnnnnnnnnnnnnnnn

SEQ ID NO: 47103 - DNA, 384 bp, Homo sapiens
  misc_feature: GYAE6OF01EN3JH.34.6.A06.1.454.CMB.1.raw
  modified_base (355)..(355): a, c, t, g, unknown or other
  misc_feature (355)..(355): n is a, c, g, or t
  modified_base (379)..(384): a, c, t, g, unknown or other
  misc_feature (379)..(384): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacaggcccctggcatcccagacaggttcagtggcagtgggtctgggacagacttcactctcaccatcaccagactggagcctgaagtattttgcagtgtattactgtcaacagttggtctcacacacgtggacgttcggccaagggaccaaggtggaaatcgaaacgaactgtggctgcacatctgtcttcatcttcccgcatctgaatcacgtgtacngagcggctggcaaggccacatagnnnnnn

SEQ ID NO: 47104 - DNA, 425 bp, Homo sapiens
  misc_feature: GYAE6OF01A12Q2.34.6.A06.1.454.CMB.1.raw
  modified_base (319)..(319): a, c, t, g, unknown or other
  misc_feature (319)..(319): n is a, c, g, or t
  modified_base (362)..(362): a, c, t, g, unknown or other
  misc_feature (362)..(362): n is a, c, g, or t
  modified_base (392)..(393): a, c, t, g, unknown or other
  misc_feature (392)..(393): n is a, c, g, or t
  modified_base (395)..(400): a, c, t, g, unknown or other
  misc_feature (395)..(400): n is a, c, g, or t
  modified_base (402)..(425): a, c, t, g, unknown or other
  misc_feature (402)..(425): n is a, c, g, or t
tcagtacacgtgatcacgaccggtgctcgattttagatctactgacgagggccagtcagagtgttaatagcagtctacttagcctggtaccagcagaaacctggccagccctcccagactcctcattaatggtgcatactacagggcccctggcatcccagacaggttcagtggcagtgggtctgggacagacttcactctcaccatcaccagactggagcctgaagattttgcagtagtatttactgtctaacagttggtctcacacacgtggacgttcggccaagggaccaagggtggaaatcgaaaacgacttggnggctgcaccatctgtcttcatcttcccgcatctgaatcacgtntacgtgacgcgggctggcaaggcgcatagnngnnnnnntnnnnnnnnnnnnnnnnnnnnnnnn

SEQ ID NO: 47105 - DNA, 291 bp, Homo sapiens
  misc_feature: GYAE6OF01EFH75.34.6.A06.1.454.CMB.1.raw
  modified_base (280)..(280): a, c, t, g, unknown or other
  misc_feature (280)..(280): n is a, c, g, or t
  modified_base (286)..(291): a, c, t, g, unknown or other
  misc_feature (286)..(291): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatctcccgcatctgaatcacgtgtactgagcgggctggacaaggcncatagnnnnnn

SEQ ID NO: 47106 - DNA, 426 bp, Homo sapiens
  misc_feature: GYAE6OF01AIXJ0.34.6.A06.1.454.CMB.1.raw
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (399)..(417): a, c, t, g, unknown or other
  misc_feature (399)..(417): n is a, c, g, or t
  modified_base (422)..(426): a, c, t, g, unknown or other
  misc_feature (422)..(426): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctggggacagacttcactctcaccatcaccagactggagcctgaagattttgcagtgtattactgtcaacagttggtctcacacacgtggacgttcggccaagggaccaaggtggaaatcaaacgaactggtggctgcaccatctgtcttcatccttcccgctatctagaactcacgttgtactgaggcggctgggacaacgggcnctaagtagcacangnnnnnnnnnnnnnnnnnnnccccnnnnn

SEQ ID NO: 47107 - DNA, 583 bp, Homo sapiens
  misc_feature: GYAE6OF01C1ECQ.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaacctggccagcctccagactcctcattaatggtgcatactacagggcccctggcatcccagacaggttcagtggcagtgggtctgggacagactcactctcaccatcaccagactggagcctagaagtatttgctagttgtattactcgtacaacgtagttggtctacgacaccgacggtcggtacgttccggaccgaacggggaccgaagggtacggaaaactacgaaaacgaacgttggtacgacctagaccaccgaattcctacggttccttaccgactttcccttacccccgacctaacttccgtagtaaacctccgtaacggttgttaacctgggacggtcccgggg

SEQ ID NO: 47108 - DNA, 530 bp, Homo sapiens
  misc_feature: GYAE6OF01ETM3H.34.6.A06.1.454.CMB.1.raw
  modified_base (522)..(522): a, c, t, g, unknown or other
  misc_feature (522)..(522): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagacctcctcattaatggtgcatactacagggcccctggcatcccagacaggttcagtggcaggtgggtctgggacagacttcactctcaccatcaccagactggagcctagaagtattttgctagttgtattactgtacaactagttggtctcacacacgtggacgttcggaccaagggaccaagggtgaaatcgaaacgaacgtgtaggctcgacaccatctgttcttactacttccttcccgcctatccgtagaactcgacgttgtactgnggtccggg

SEQ ID NO: 47109 - DNA, 632 bp, Homo sapiens
  misc_feature: GYAE6OF01BKYCX.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgctatactacgacgggcccctggccatcccagacaggttcaggtggcaggtgggtctgggacagacttcactctacaccactcaccagacgtggacgcctagaacgtattttgctagtgttattacgtgtactaacgtagtttcggtactacactaccgtacggttacgggtaccggttaccgggacccgtaacgggaacccgtaagggtaacggtaaacgtaaccgaaaacggtaacgttacggtacgggtacctaggacccaccgtaacttccgttcgttacctttaccgtacgttcccgttaccccgccttacttccgtagtaaaccgttccgtaacggttagttaccgtggacgggtcccggg

SEQ ID NO: 47110 - DNA, 394 bp, Homo sapiens
  misc_feature: GYAE6OF01EWR3E.34.6.A06.1.454.CMB.1.raw
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
  modified_base (374)..(394): a, c, t, g, unknown or other
  misc_feature (374)..(394): n is a, c, g, or t
tcagtacacgtgatcacgaccggtgctcgatttagatctactgacagggccgagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtgacgttcggcaagggacaaggnggaaatcaaacgactgnggctgcacatctgtcttcatcttcccgcatcagatcacgtgtactgaggcggctggcaaggcacagtgnnnnnnnnnnnnnnnnnnnnn

SEQ ID NO: 47111 - DNA, 287 bp, Homo sapiens
  misc_feature: GYAE6OF01D4111.34.6.A06.1.454.CMB.1.raw
  modified_base (280)..(287): a, c, t, g, unknown or other
  misc_feature (280)..(287): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggccaaggtggaaatcaaacgactgtgctgcaccatctgtctcatctcccgcatctgaatcacgtgtactgagcggctggcaaggcgcatagnnnnnnnn

SEQ ID NO: 47112 - DNA, 397 bp, Homo sapiens
  misc_feature: GYAE6OF01BCAF7.34.6.A06.1.454.CMB.1.raw
  modified_base (375)..(375): a, c, t, g, unknown or other
  misc_feature (375)..(375): n is a, c, g, or t
  modified_base (381)..(383): a, c, t, g, unknown or other
  misc_feature (381)..(383): n is a, c, g, or t
  modified_base (385)..(397): a, c, t, g, unknown or other
  misc_feature (385)..(397): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggacccaagggtggaaatcaaacgaactgtggctgcaccatctgtcttcatcttccgccatctgaatcacgtgtactgagcgggctggcaaggcncatagnnngnnnnnnnnnnnnn

SEQ ID NO: 47113 - DNA, 382 bp, Homo sapiens
  misc_feature: GYAE6OF01D68QY.34.6.A06.1.454.CMB.1.raw
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (318)..(319): a, c, t, g, unknown or other
  misc_feature (318)..(319): n is a, c, g, or t
  modified_base (321)..(321): a, c, t, g, unknown or other
  misc_feature (321)..(321): n is a, c, g, or t
  modified_base (323)..(324): a, c, t, g, unknown or other
  misc_feature (323)..(324): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (330)..(338): a, c, t, g, unknown or other
  misc_feature (330)..(338): n is a, c, g, or t
  modified_base (340)..(340): a, c, t, g, unknown or other
  misc_feature (340)..(340): n is a, c, g, or t
  modified_base (342)..(374): a, c, t, g, unknown or other
  misc_feature (342)..(374): n is a, c, g, or t
  modified_base (376)..(382): a, c, t, g, unknown or other
  misc_feature (376)..(382): n is a, c, g, or t
tcagtacacgtgatcacgaccggtgctcgattttagatctactgacggagggcccctggccatcccagacaggttcagtggcagttgggtctgggacagacttcactctcaccatcaccagactgggatccgtgaagatttttgctagttgttattactgttacaaacgtgtttggtctcacacgacggtggacgtttcggccaaaggggaccaagggtgggaaaatccgaaaacggactgtggctgccacatctgtcttnatccttcccgcatctnaactcaacgttgtacngagcgggctggcaaggccncatagnngngnngngngnnnnnnnnnanannnnnnnnnnnnnnnnnnnnnnnnnnnnnnnnngnnnnnnn

SEQ ID NO: 47114 - DNA, 388 bp, Homo sapiens
  misc_feature: GYAE6OF01A7L1J.34.6.A06.1.454.CMB.1.raw
  modified_base (374)..(374): a, c, t, g, unknown or other
  misc_feature (374)..(374): n is a, c, g, or t
  modified_base (380)..(388): a, c, t, g, unknown or other
  misc_feature (380)..(388): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcgaaacgactgtggctgcacatctgtcttcatctcccgcatcctgaactcacgtgtactggagcgggctggcaaggcncatagnnnnnnnnn

SEQ ID NO: 47115 - DNA, 650 bp, Homo sapiens
  misc_feature: GYAE6OF01C9KLY.34.6.A06.1.454.CMB.1.raw
  modified_base (167)..(167): a, c, t, g, unknown or other
  misc_feature (167)..(167): n is a, c, g, or t
  modified_base (352)..(352): a, c, t, g, unknown or other
  misc_feature (352)..(352): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaanacgccaccctctcctgcagggccagtcagagtgtaatagcatctacttagcctggtaccagcaagaacctggccagccctccagacctcctcattaactggtgacataccgtacgacggcccctggcactcccagactaggttcagtggcaggtgggtctagggacagtacttcactctcaaccntccacagactcggagtcctagagtattttgactagttgttattactgtactaacgtagttcggtcttacgaacctacgtaacggtgggtaaccggtttaccgggacccgtaaaggggaacccgtaaagggtaacggaaaagttaccgaaaacggtaaccgtacggtacgggtaccttaggacctaccgtagttcccgttacggttaccttaccgtacctttacccgttccccgtaccgtaccttccgtaacgtaacttaccgtaaccggtttagtaccgttaggccgggtacccgggg

SEQ ID NO: 47116 - DNA, 294 bp, Homo sapiens
  misc_feature: GYAE6OF01A3ZWN.34.6.A06.1.454.CMB.1.raw
  modified_base (277)..(277): a, c, t, g, unknown or other
  misc_feature (277)..(277): n is a, c, g, or t
  modified_base (284)..(294): a, c, t, g, unknown or other
  misc_feature (284)..(294): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatctccgcatctgaatcacgtgtactgagcggctggcaaggcncagtagnnnnnnnnnnn

SEQ ID NO: 47117 - DNA, 383 bp, Homo sapiens
  misc_feature: GYAE6OF01D6CKY.34.6.A06.1.454.CMB.1.raw
  modified_base (375)..(383): a, c, t, g, unknown or other
  misc_feature (375)..(383): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgcagtgtattactgtcaacagttggtctcacacacgtggacgttcggccaagggaccaaggtgaaatcaaacgactgtggctgcaccatctgtcttcatctccgcatctgatcacgtgtactgagcggctggacaaggcacatagnnnnnnnnn

SEQ ID NO: 47118 - DNA, 758 bp, Homo sapiens
  misc_feature: GYAE6OF01A619Z.34.6.A06.1.454.CMB.1.raw
  modified_base (605)..(605): a, c, t, g, unknown or other
  misc_feature (605)..(605): n is a, c, g, or t
tcagtacacgtgatcacgaccggtgctcgatttagatctactgacgaaggggccagtcgagtagtgttaatagcatctacttagcctggtaccagccagaaacctggccagcctcccgagactcctacattaatggtgcactactaccagggcccctggcatcccagacaggttcagtggcacgtggtctgggacagacttcacgtctcaccgactcacagacctggagcctgaagtattttgacagtgtattacgtgtacaactaggtttaggtaccttactaactacgtaccggttagggtaaccggtttccggacccgaaaagggggtaccctaaaagggggttcgggaaaaacgttcccgaaaaaccggtaaccgttacgggttacgggaccgttaccgggtaccctaaaccctaaacgttccgttacggtttacccttttaccttaaccgtttacccgtttacccccggccctaacgtttacccgttacggtaaacgtttaccgtaaccggttaccggtttaaacccttagggtaaccgggtaccggggtacgttacggggaccgttaaaggggcccggttaaccggaagttaaaccggntacgacgtagacgtagacgaggtacggacgtagtcgtagtagtagtacgtagtacgtagtacgtacgtacgtacgacgacgacgtacgtacgtacgtaccgtaccgtacgtacgacggtacggacgtacgacgtacacgagtacgtgtgtacg

SEQ ID NO: 47119 - DNA, 290 bp, Homo sapiens
  misc_feature: GYAE6OF01C4811.34.6.A06.1.454.CMB.1.raw
  modified_base (287)..(290): a, c, t, g, unknown or other
  misc_feature (287)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgacatagnnnn

SEQ ID NO: 47120 - DNA, 459 bp, Homo sapiens
  misc_feature: GYAE6OF01CEJF6.34.6.A06.1.454.CMB.1.raw
  modified_base (265)..(265): a, c, t, g, unknown or other
  misc_feature (265)..(265): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (415)..(416): a, c, t, g, unknown or other
  misc_feature (415)..(416): n is a, c, g, or t
  modified_base (420)..(445): a, c, t, g, unknown or other
  misc_feature (420)..(445): n is a, c, g, or t
  modified_base (447)..(459): a, c, t, g, unknown or other
  misc_feature (447)..(459): n is a, c, g, or t
tcagtacacgtgatcacgaccggtgctcgatttagatctactgacaggggccaggtcacgagtgttaatagcagtctactttagccttgggtaccagcagaaacctggccaagcctcccagactcctcattaatggttggcatactacaggggtcccctggcatccctagacaggttcagtggcagtgggtctgggacagacttcgacggtctcgaccatcaccgagacctggagcctgacgattttgcagtgtatactgtcaanttggtctacacacacgtgacgttcggccaagggaccaaggtcggaaacgtcgaaaacggaactggtaggctgcacattctgtctcatctccgcatctgaatcacgtctctgaggacgggcttggccaagggtcnccgtaataacgntnannaacnnnnnnnnnnnnnnnnnnnnnnnnnngnnnnnnnnnnnnn

SEQ ID NO: 47121 - DNA, 294 bp, Homo sapiens
  misc_feature: GYAE6OF01CQQP7.34.6.A06.1.454.CMB.1.raw
  modified_base (287)..(294): a, c, t, g, unknown or other
  misc_feature (287)..(294): n is a, c, g, or t
tcagtacacgtgatcacgaccggtgctcgatttagatctactgacagggcccctggcatccccagaccaggttcacgtggcagtgggtctgggacagacttcgacctctcaccatccaccagactggagcctgaagattttgcagtgtattactgtcaacagttggtctcacacacgtggacgttcggccaagggaccaaggtgaaatcaaacgactgtggctgcacatctgtcttcatcctccgcatctgatcacgtgtactgagcgggctggcaaggcgcatagnnnnnnnn

SEQ ID NO: 47122 - DNA, 376 bp, Homo sapiens
  misc_feature: GYAE6OF01D7MWO.34.6.A06.1.454.CMB.1.raw
  modified_base (157)..(157): a, c, t, g, unknown or other
  misc_feature (157)..(157): n is a, c, g, or t
  modified_base (309)..(309): a, c, t, g, unknown or other
  misc_feature (309)..(309): n is a, c, g, or t
  modified_base (320)..(325): a, c, t, g, unknown or other
  misc_feature (320)..(325): n is a, c, g, or t
  modified_base (327)..(376): a, c, t, g, unknown or other
  misc_feature (327)..(376): n is a, c, g, or t
tcagtacacgtgatcacgaccggtgctcgatttagatctactgacagggccccctggcatcccagacaggttcagtggcagtgggtctgggacagacttcactctcaccatcaccagactggagcctgaagattttgcagtgtattactgtctaacngttggtctcacactacgtggacgttcggccaaagggaccaaaggtggaaaatcgaaaacgaactggtggctgcaaccatcgtgtcttcatccttcccgctagtctagaatccgacgttgtaactggacgcgggtctggaccaagggccgtanagtaggctgtnnnnnngnnnnnnnnnnnnnnnnnnnnnnnnnnnnnnnnnnnnnnnnnnnnnnnnnn

SEQ ID NO: 47123 - DNA, 584 bp, Homo sapiens
  misc_feature: GYAE6OF01A1Y9E.34.6.A06.1.454.CMB.1.raw
  modified_base (382)..(382): a, c, t, g, unknown or other
  misc_feature (382)..(382): n is a, c, g, or t
tcagtacacgtgatcacgaccggtgctcgatttagatctactgacagggaaccatggaaaccccagcgcagcttctcttcctcctgctactctggctcccagataccaccggagaaattgtgttgacacagtctccagacaccctgtctctgtctccaggggaaagagccaccctctcctgcagggtcagtcagcgttctaacaccgacttcttcgcctggtaccagcagacgacctggccaggcctacccgaggcctcctcattcgtttggtcgccgtccaccgacggggccactggccatcccgagacaggttcaggtggcaggtgggtctgggacagacttcactctccaccatcagcagtacttgacgcctagaagtnttttgactagttattattactgtacagactaagtactacgagacgctacgtggtcgggtcgttcggaccgtaacgggacgtaagggtaggaaactacgaaacgtacgtgtacggctacgaccacgtatccgtgttccgttccgtacttcccgttcccgacctaacgttccgtacgtaactccgtaacgttgttacgtacggg

SEQ ID NO: 47124 - DNA, 624 bp, Homo sapiens
  misc_feature: GYAE6OF01D0044.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaacctggccagccctccagactcctcattaatgtgcatactacacggccctggcactcccagacgtaggttcagtggcaggtggtcgtgggacagtactcactctcacactcaccacgacgtggacgccgtagaagtagttttgacgtagtgttaattacgtgtacaacgtagttcggttctactactaccgtacggttcggaccggtttaccgggacgtaacgggaaccgtaacgggtaaggaaacgtaccgaaaacggtaacgttacgggtcggtacgtcgtaacctaccgtacgttaccgttcgttaccttaccttaccgttcccttaccccgacctacgttacgttacgtaaactccgtaacgttacgtaaccgttggacggtaccgggg

SEQ ID NO: 47125 - DNA, 714 bp, Homo sapiens
  misc_feature: GYAE6OF01BWU2E.34.6.A06.1.454.CMB.1.raw
tcagtacacgtgatcacgaccggtgctcgatttagatctactgacagggaaccatggaaaccccagcgcagcttctcttcctcctgctaatctggctcccagatatcaccggagaaattgtgttgacacagtctccaggcaccctgtctttgtctccgaggggaaagacgccaccctctcctgcagggccagtccagagtgttaatagcatctacttagcctggtaccagcagaaacctggccagcctccagacctcctcattaatggtgacatacctacgacgggtcccctggcactcccagacgtacggttcaggtgcgtaggtcgggtcgtggggactaggtacttcactcctacaccactaccgaccagtaccgtggacgtcgtacgaaagttcttttaggctaggttacgtttattaccgttagtacctaacgttacggtttcggtactaccgtaaccgtaccggtacgggttacgggtacccggtttacccgggacccggtaaacggggtaaccgtaaacggggttaagggtaaaccgtaccgaaaaccggttaaccggttagggtaccggtaccgtacgtacccgtaacgtacgttaccgttcggtttaccttaccggtaacctttccccgttaccccgaccttaccgttccgttaacggtaaaccttccgtaacgggtttacgtaccgtgggtaccgggtccgggg

SEQ ID NO: 47126 - DNA, 550 bp, Homo sapiens
  misc_feature: GYAE6OF01CBZIQ.34.6.A06.1.454.CMB.1.raw
  modified_base (541)..(541): a, c, t, g, unknown or other
  misc_feature (541)..(541): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacacgggccctggcatcccagacaggttcagtggcaggtgggtctgggacagacttcactctcaccatcacagactggagcctagaagtattttgctaggttgtaattactgtacaactagttggtcttacacacacggtggtaccgttcggaccgaagggaccaaggtaggaatacgaaacgaacgtggtacggactgaccacctagttctcggtccttactacgttcccgttcccgcctatctagaactctaacgttgtaacctggnggtccgggg

SEQ ID NO: 47127 - DNA, 798 bp, Homo sapiens
  misc_feature: GYAE6OF01EPPYA.34.6.A06.1.454.CMB.1.raw
  modified_base (171)..(171): a, c, t, g, unknown or other
  misc_feature (171)..(171): n is a, c, g, or t
  modified_base (200)..(200): a, c, t, g, unknown or other
  misc_feature (200)..(200): n is a, c, g, or t
tcagtacacgtgatcacgaccggtgctcgatttagatctactgacaggggaaccatggaaaccccagcgcagcttctcttcctcctgctactcctggctcccacgatactcaccggagaaattgtgttgacacagtctccaggcaccgtgtctttgctccgaaggggaaancgcccacctctcgtgcagggccagtcagngtgtaatgcatctacgtacgcctggtaccagactacgaaacctggaccaacggtccctcccgaagtaccttcctactaacttaagtcgggtacacctaattaaccgtacggaccggggtccccctgggacctaaccgtccccgaaggtaaccgtaaggggtttccagggttcggacgtacgggttggggttaccgtggggtaacctaggtaccgttaccgacgttccggtaccaaccgtacttacgaacccgaggtaccgtaggggaaccgtccgttaagggtaaacgtttacggtttcgaccgttaagggttacgtttaaccgttacgtacgtaaccgtaacgttacggtttacggtacctaacgtaccgtaacgtacgggtacgggtaccgtttaccggaaccgtaaacggggtactaagggtacgtaaaactacccggaaaacgtacgttcgggtaaccggtacgtacgtaacccgacgttacttcggtacgtttaccgtaaccgttaccggttccccgtttacccgacgtttaccggtacgttaacgttaacgttccgtaaacgggttcgtaaccgtcggtacgggtacccggg

SEQ ID NO: 47128 - DNA, 288 bp, Homo sapiens
  misc_feature: GYAE6OF01DRMFL.34.6.A06.1.454.CMB.1.raw
  modified_base (286)..(288): a, c, t, g, unknown or other
  misc_feature (286)..(288): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnn

SEQ ID NO: 47129 - DNA, 722 bp, Homo sapiens
  misc_feature: GYAE6OF01DI8S1.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgttctttgtctccgaggggaaagacgccaccctctcctgcgacgggccagtcagagtagttaatagcatctacttagcctggtaccagcagaaccgtcggccacgccctccacgacctcctacaatttaacgtggtgactaataccgtacgacgggcccctggcctactcccgagactacggttcaggtggactaggtgggtcgtagggactaggtacttccgactcctacacctataccaacccaaggtaccgtgggacgtccgtagtaaacgttacgttttacggacgttaggtttagttaacgtttacgtaggttacctaaacggttcggtttcgtaacttaccgaaccgtacgtacgggttaggtaaccggtttccgggaccggtaaccgggaacgtaagggtaacggtaaactaaccggaaaccgttacggtagggtcggtaccgtacgtaccgaaccgttacgttaccgttgttaccctttacgtaccgttccccgttaccccgaccttaccgttaccgttacgtaaccgttacctacggtttacggtaccgtggtaccgggtacccgggg

SEQ ID NO: 47130 - DNA, 501 bp, Homo sapiens
  misc_feature: GYAE6OF01BWUH7.34.6.A06.1.454.CMB.1.raw
  modified_base (166)..(166): a, c, t, g, unknown or other
  misc_feature (166)..(166): n is a, c, g, or t
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaanagccaccctctcctgcagggccagtcagagtgttaanagcatctacttagcctggtaccagcagaaacctggccagcctccagactcctcattaatggtgcatactacagggcccctggcatcccagacaggttcagtgcagtgggtctgggacagacttcactctcaccatcgaccagactggagcctgaagtattttcgctagtgtatactgtcaacagttgtctnacacacgtggacttcggaccaagggacaaggtagaaactcaaacgactgtagctgcacatctgtctcatcttcccgctatctgactcacgttgtactgaggtccggg

SEQ ID NO: 47131 - DNA, 295 bp, Homo sapiens
  misc_feature: GYAE6OF01AYMY0.34.6.A06.1.454.CMB.1.raw
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (292)..(295): a, c, t, g, unknown or other
  misc_feature (292)..(295): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcaatttattactgtcagctgcgtagcaactggcctcccttgagcgccttcggccgagggacacgactggagattaaaacgaactgtggctgcaccatctgtcttcatcttcccgcatctgaatcacgtntactgagcgggctggcaaggcnatagnnnn

SEQ ID NO: 47132 - DNA, 292 bp, Homo sapiens
  misc_feature: GYAE6OF01BQGLP.34.6.A06.1.454.CMB.1.raw
  modified_base (286)..(292): a, c, t, g, unknown or other
  misc_feature (286)..(292): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgactgtggctgcacatctgtcttcatctcccgcatctgaactcacgtgtactgacgcgggctggacaaggcgcatagnnnnnnn

SEQ ID NO: 47133 - DNA, 580 bp, Homo sapiens
  misc_feature: GYAE6OF01AKOSQ.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaacctggccagcctccagacctcctcattaatggtgcatactacacgggcccctggcactcccagacaggttcaggtggcaggtgggtctgggacagacttcgactctacaccactcaccagacgtggacgtcctagtaagtattttgctagtagttattacgtgtacaacgtggttcgtctacacacgtacggtcggtaccgttcggaccgaacgggaccgaagggtacggaaactaccgaaacgtacgtaggtacggctacgacctaccgtattccgtcgttccttactacgttccttcccgactacgtacctagtaactaccgtacgttacgtactggcggtccggg

SEQ ID NO: 47134 - DNA, 402 bp, Homo sapiens
  misc_feature: GYAE6OF01BZ1ZL.34.6.A06.1.454.CMB.1.raw
  modified_base (396)..(402): a, c, t, g, unknown or other
  misc_feature (396)..(402): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgctagttgtattactgtacaacagttggtctcacacacgtggacgttcggaccgaagggaccaaggtaggaaatacgaaacgacgtgtgctgcacatctgtcttcacttctcccgctatctagactctacgtgtacgtgaggcgggtctggacgaaggcgacatagnnnnnnn

SEQ ID NO: 47135 - DNA, 289 bp, Homo sapiens
  misc_feature: GYAE6OF01DE0SG.34.6.A06.1.454.CMB.1.raw
  modified_base (282)..(289): a, c, t, g, unknown or other
  misc_feature (282)..(289): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtctcatctccgcatctgaatcacgtgtactgagcggctggcaaggcgcatagnnnnnnnn

SEQ ID NO: 47136 - DNA, 296 bp, Homo sapiens
  misc_feature: GYAE6OF01DAWHM.34.6.A06.1.454.CMB.1.raw
  modified_base (287)..(296): a, c, t, g, unknown or other
  misc_feature (287)..(296): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaaatcaaacgaactgtaggctgcaccatctgtctcatcttcccgcatctgaatcacgtgactgagcggctggcaaggcgacagtagnnnnnnnnnn

SEQ ID NO: 47137 - DNA, 699 bp, Homo sapiens
  misc_feature: GYAE6OF01DFS5N.34.6.A06.1.454.CMB.1.raw
  modified_base (168)..(168): a, c, t, g, unknown or other
  misc_feature (168)..(168): n is a, c, g, or t
  modified_base (268)..(268): a, c, t, g, unknown or other
  misc_feature (268)..(268): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaagngcccaccctctcctgcagggccagtcagagtgtaatgcatctacttagcctggtaccagcaacgaaacctggccagccctaccagactcctcaattaacnggtagactatactacgacggcccctggcactccagacgtacgttcgagtggacgtaggtgggtcgtagggacaggtacttccgaacttcctacaacctaactccaaccgagaaccgttcgggaacgtcccgttaagaacgttattttcggaccgtaagttagttaacttacgtagttacctaacgtacggtttcggtacctacgtaaccgtaacgtaccgggttcggtaaccggttaccggaaccggaaacgggtaaccgtaagggtaacgtaaacgtaccgaaaacggtaccgtacggtacggtacgtacgaacccgtaaccgtacgttaccgtacgttaccgttacttaccgttcccgttaccccgtacctaacttacccgtaacgtaacgttaccgtaacgttacgtaacgtcggtagggtacccggg

SEQ ID NO: 47138 - DNA, 560 bp, Homo sapiens
  misc_feature: GYAE6OF01DVZBT.34.6.A06.1.454.CMB.1.raw
  modified_base (167)..(167): a, c, t, g, unknown or other
  misc_feature (167)..(167): n is a, c, g, or t
  modified_base (356)..(356): a, c, t, g, unknown or other
  misc_feature (356)..(356): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaangccaccctctcctgcagggccagtcagagtgttaatagcatctacttagcctggtaccagcagaacctggccagcctccagacctcctcattaatggtgctatactacacgggcccctggcactccagacgaggttcaggtggcaggtgggtctgggacagacttcactctcacatcacagactggacncctgaagtagttttgctagttgtatttactgttacaacgtgttcggtactacactactacgtggtaccgttacggacgtaacgggacgaaggttaaggaatacgaaacgtaacgtgtaggctacgacctactagtcttagtcctttcgacttcccttacccgcctatcctagaccttcgacggttattacgtggacggtccggg

SEQ ID NO: 47139 - DNA, 377 bp, Homo sapiens
  misc_feature: GYAE6OF01ALNR1.34.6.A06.1.454.CMB.1.raw
  modified_base (372)..(377): a, c, t, g, unknown or other
  misc_feature (372)..(377): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcacatctgtctcatcttccgcatctgatcacgtgtactgagcggctggcaggcacatgnnnnnn

SEQ ID NO: 47140 - DNA, 392 bp, Homo sapiens
  misc_feature: GYAE6OF01BB6ZL.34.6.A06.1.454.CMB.1.raw
  modified_base (383)..(392): a, c, t, g, unknown or other
  misc_feature (383)..(392): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattctgcagtctattattgtcaactaatttggtcactctattccttttcggccctgggaccagagtggaatcaaacgactgtggctgcacatctgtcttcactctcccgctatctgaactcgacgtgtactgacgcgggctaggcgaaggcgacatacgnnnnnnnnnn

SEQ ID NO: 47141 - DNA, 525 bp, Homo sapiens
  misc_feature: GYAE6OF01C54ZD.34.6.A06.1.454.CMB.1.raw
  modified_base (517)..(517): a, c, t, g, unknown or other
  misc_feature (517)..(517): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacagggcccctggcatcccagacaggttcagtggcaggtgggtctgggacagacttcactctcaccatcaccagactggagcctgaagattttgctagtgtattactgtacaacgtagttgtctcacacgacgtggacgttacggccgaagggaccaagggtacggaaagtaccgaaacgaacgtgtggctgcaccatctgtcttcactccttcccgacctatctagaactctacgtgtactggngtccgggg

SEQ ID NO: 47142 - DNA, 367 bp, Homo sapiens
  misc_feature: GYAE6OF01C66JR.34.6.A06.1.454.CMB.1.raw
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
  modified_base (322)..(323): a, c, t, g, unknown or other
  misc_feature (322)..(323): n is a, c, g, or t
  modified_base (325)..(367): a, c, t, g, unknown or other
  misc_feature (325)..(367): n is a, c, g, or t
tcagtacacgtgatcacgaccggtgctcgatttagatctactgacagggccccctggcatccccagaccaggttcacgtggcaacgttgggtcgtgggacacgacggttccactctcaccatccaacctaagactgggagcctgaagattttgacacgtgtagttaacctgtcaaaccagttggtctcactacacgtggaccgttcggcctaaagggccaaggtgaaaactcaaaacgactgtaggctagcacctatctgtcttcatctcccncctatctgaatcaacggtgtactgacgcgggctggcaagggcanatagnnannnnnnnnnnnnnnnnnnnnnnnnnnnnnnnnnnnnnnnnnnn

SEQ ID NO: 47143 - DNA, 351 bp, Homo sapiens
  misc_feature: GYAE6OF01B0DN6.34.6.A06.1.454.CMB.1.raw
  modified_base (284)..(284): a, c, t, g, unknown or other
  misc_feature (284)..(284): n is a, c, g, or t
  modified_base (302)..(303): a, c, t, g, unknown or other
  misc_feature (302)..(303): n is a, c, g, or t
  modified_base (305)..(351): a, c, t, g, unknown or other
  misc_feature (305)..(351): n is a, c, g, or t
tcagtacacgtgatcacgaccggtgctcgatttagatctactgacaggggtccccgtaggcatcccagacaggttcgagtggcagtgggtctgggacagacttcactctcaccatcaccagactggagcctagtaagattttgcagtgtattacctgtcaactggttgggtctcgaacacgacgtggacgttcggccaagggaccaaggtggaaatcgaaacgaactgtaggctgcaccatctgtctcatctccgcatctgaactcacgtctactgtagcgggntggacaaggcgacatagnncnnnnnnnnnnnnnnnnnnnnnnnnnnnnnnnnnnnnnnnnnnnnnnn

SEQ ID NO: 47144 - DNA, 596 bp, Homo sapiens
  misc_feature: GYAE6OF01A5LLL.34.6.A06.1.454.CMB.1.raw
  modified_base (335)..(335): a, c, t, g, unknown or other
  misc_feature (335)..(335): n is a, c, g, or t
  modified_base (370)..(370): a, c, t, g, unknown or other
  misc_feature (370)..(370): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagacctcctcattaatggtgcatactacagggcccctggcactcccagacgtaggttcaggtggcgagtgggtctgggacagacttcnctctcaccatacaccagactggacgcctagaagtntttgctagttgtattactgtacaacgtagttggtctacgacacgtacggtaggtaccggtttcggaccgaacgggaccgtaagggtacgggtaaactaccgaaaacggtaacgtacggtacggacgttcgacgacctacgttcgtcgttcttacgtaccttcccttaccccgtaccctacttccgtacgtaacctcgtacggttagtaccgtggacgggtccgggg

SEQ ID NO: 47145 - DNA, 785 bp, Homo sapiens
  misc_feature: GYAE6OF01D7XRX.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaagagccaccctctcctgcagggccagtcagagtgttaatagcatctacttagcctggtaccagcagaaacctggccagccctcccagtacctcctactaattaagtggtcgactatacctacgacgggcccctggcctactcccagacgtaggttcgaggtggcgaggtgggtcgtgggacagtacttcactccgtacacctactaccaaccgacgtacgtacggacgtaccgtaggtaacgttacgttttcggacgttaggtttacgtttaactttacgttacggttaaccgtaaacggttacgggttttaccggttaccgtaaccgtaaaccgtaaccggtaaccggggtttacggggttaaacccggtttcccggggtaaccccggtaaacggggtaaacccggtaaacggggtaaacgggtaaaacgttaacccgtaaaacgggttaccgttacggggtaccgggtaccgttacgtacccgtaacccgtacgttaccgttcgtttaccctttaccgtaccgtttccccgtttacccccgtaccgttaccttaccgttaacgtaaaccgttccgtaaccggttacgttaacgggttccgggtaacgggtacccgggg

SEQ ID NO: 47146 - DNA, 623 bp, Homo sapiens
  misc_feature: GYAE6OF01DGTLO.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaagagccaccctctcctgcagggccagtcagagtgtaatagcatctacttagcctggtaccagcagaaacctggccagcctccagactcctcattaatggtgacatactacacgggccctggcatcccagacaggttcagtgcagtgggtctgggacagactcactctcacatcacagactggacgctagaagtattttgctagtgttattactgttacaacgtagttggtctacaactacgtacgttacggtaccggtttcgggacccgaaacggggtaccgtaaacgggtacggtaaaacgtaaccgtaaaacggtaaccgttaggtcgggtaccgtacgaccgaacccgtaagttccttcgttacctttacctaaccgttcccttacccccgtcctaactttccgtaacgttaacttacccgtaacggtttagttaaccgtgggtacggtacccgggg

SEQ ID NO: 47147 - DNA, 290 bp, Homo sapiens
  misc_feature: GYAE6OF01DOGSC.34.6.A06.1.454.CMB.1.raw
  modified_base (283)..(290): a, c, t, g, unknown or other
  misc_feature (283)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatctcccgcatctgaatcacgtgtactgagcggctggcaaggcgcatagnnnnnnnn

SEQ ID NO: 47148 - DNA, 685 bp, Homo sapiens
  misc_feature: GYAE6OF01DLTPU.34.6.A06.1.454.CMB.1.raw
tcagtacacgtgatcacgaccggtgctcgatttagatctactgacagggcccctggcatcccagaccagttcacgtggcaacgtgggtctggggacagaccttcgacctctcaccatcaccagactggagcctgaagattttgctagtcgtattacgtgtacaacagttggtctcacactacgtggtacgttccggccaagggaccaaggtggaaactccaaacggaactgtaggacctggacctaccgtattcgtcgttaccttccaacttccgttccccggacctaacttccgttagaacttaccgaaccggttaggtaacccttggaaccggtccggggtcttacggggccaaaacggggtccgaccgtaaaggttaacggcgttagagtacgagtcaagttccgattacgtcgtacgtacgtacgtacgacgacgacgacgtacgtaccgtacgtacgtacctactacgtacgtacgtagtacgtacgtacgtacgacgtacgtacctacgtacgtaacgtacgacgtacgtacgtacgtacgtacgtacgtacgtacgtacgtacgtacgtactacgtacgtacgtactacgtacgacgacacgtacgacggacgtacgtacgtagtagtacgtagtacgtacgttagtacgtacgtacgtagtacgtcgtcgtacgtac

SEQ ID NO: 47149 - DNA, 385 bp, Homo sapiens
  misc_feature: GYAE6OF01ECEV5.34.6.A06.1.454.CMB.1.raw
  modified_base (374)..(374): a, c, t, g, unknown or other
  misc_feature (374)..(374): n is a, c, g, or t
  modified_base (379)..(385): a, c, t, g, unknown or other
  misc_feature (379)..(385): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgcagttgtattactgtcaacagttggtctcacacacgtggacgttcggccaagggaccaaggtggaaatcaaacgaactgtggctgcacatctgtcttcatcttcccgcatctgaatcacgtgtactgaggcggctggcaaggcncatgnnnnnnn

SEQ ID NO: 47150 - DNA, 362 bp, Homo sapiens
  misc_feature: GYAE6OF01A4XVW.34.6.A06.1.454.CMB.1.raw
  modified_base (124)..(124): a, c, t, g, unknown or other
  misc_feature (124)..(124): n is a, c, g, or t
  modified_base (294)..(294): a, c, t, g, unknown or other
  misc_feature (294)..(294): n is a, c, g, or t
  modified_base (302)..(303): a, c, t, g, unknown or other
  misc_feature (302)..(303): n is a, c, g, or t
  modified_base (305)..(306): a, c, t, g, unknown or other
  misc_feature (305)..(306): n is a, c, g, or t
  modified_base (308)..(308): a, c, t, g, unknown or other
  misc_feature (308)..(308): n is a, c, g, or t
  modified_base (315)..(362): a, c, t, g, unknown or other
  misc_feature (315)..(362): n is a, c, g, or t
tcagtacacgtgatcacgaccggtgctcgatttagatctactgacagggcccctggcgatcccagacaggttcagtggcagtgggtctgggacagacttcactctcaccatcaccagactggancctgaagattttgcagtgtattactgtcaacagttggtctcacacacgtggaccgttcggccaagggaccaaggtggaaaatcaaaacgactgtaggctggcaccatctgtcttgattccttcccgctatctgaacttcaagtgactgaacggtcggctggacaaggccncatagctnnanncngcagcannnnnnnnnnnnnnnnnnnnnnnnnnnnnnnnnnnnnnnnnnnnnnnn

SEQ ID NO: 47151 - DNA, 795 bp, Homo sapiens
  misc_feature: GYAE6OF01CND7H.34.6.A06.1.454.CMB.1.raw
tcagtacacgtgatcacgaccggtgctcgatttagatctactgacagggaaccatggaaaccccagcgcagcttctcttcctcctgctactctggctcccagatcgccccggagtaaattgtgttgacgcagtcgccagaccaccctgtctctgtctaccgaaggggaaagacgcccaccctctccgtgcgagggtcagtcagtcgttactaacaccgtacttcttcgcctggtaccagacagacgaccgtcggaccgacggcctccgacggtcctacctctaacttcgtaatggtaacgtcggacccgtaaccgaaaccggcgggaccctacggtcggaccctaacgtccccgaaggtcccggtaagggtttccaaggggttcggggacgtacggggtttcggggtaccggtacggggaccctaacggttacccttacccaacccgttccaacccaaccgttagtacccgaacgacccgtaaccggaacccttaaagggaacccgttaaaacgttaaaagtttccgtttagaaacctttttaattttaccgtttaacgtcgtacccgtaggtaccgttacggtaaccggtaagtacccggtaccgttcccgggtacccccgtttacccggttagggaccccgttcccggtacccgggttaaccggggaccgggtaacgtaaccgaacggtacggtaacgggtaacgttaaaacgtaacgtacgtggtaccgcgtacacctactatccgtcgttactcctaacttccctcctataacgtctaacgtatcgtaacg

SEQ ID NO: 47152 - DNA, 391 bp, Homo sapiens
  misc_feature: GYAE6OF01C5LF4.34.6.A06.1.454.CMB.1.raw
  modified_base (383)..(391): a, c, t, g, unknown or other
  misc_feature (383)..(391): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgctagtgtattactgtacaacagttggtctcacacacgtggacgttcggccaagggaccaaggtgaaaatcaaaacgactgtggctgcacatctgtctcatcttcccgctatctgaatcacgtgtactgagcggcgtggcgaaggcgctagtagnnnnnnnnn

SEQ ID NO: 47153 - DNA, 389 bp, Homo sapiens
  misc_feature: GYAE6OF01CIR4U.34.6.A06.1.454.CMB.1.raw
  modified_base (352)..(352): a, c, t, g, unknown or other
  misc_feature (352)..(352): n is a, c, g, or t
  modified_base (382)..(389): a, c, t, g, unknown or other
  misc_feature (382)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcacttctcccgccatctgatcacgtntactgagcgggctggcaaggcgacagtagnnnnnnnn

SEQ ID NO: 47154 - DNA, 716 bp, Homo sapiens
  misc_feature: GYAE6OF01C6D2D.34.6.A06.1.454.CMB.1.raw
  modified_base (296)..(296): a, c, t, g, unknown or other
  misc_feature (296)..(296): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaagagccaccctctcctgcagggccagtcagagtgttaatagcatctactagcctggtaccagcagaaacctggccagcctccagactcctcattaatggtgcatactacgacggccctggcatcccagacnggttcagtgcgaggtggtcgtgggacagactcactctcaccatcaccagactggacgccgtagtaagtagttttgactagttgttaactttacgtacgtactaacgtaggtttcggtactaccgaacgtaccgtacgggttacggtaaccgggtttccgggaacccgtaaacggggtaacccgtaaaggggttaaccgggtaaaacgttaacccgtaaaaaccggtaaccggtttacgggtacgggtacccgttacggaacccgtaacccgtaactttacccgttacggtttacctttacccgtaaccgtttacccccgtttaccccgtaccccttaacgtttaccgttaaacggtaaaccgtttacccgtaaaccgggtttacggttaacccggttcgggtaacccgggtacccggggg

SEQ ID NO: 47155 - DNA, 490 bp, Homo sapiens
  misc_feature: GYAE6OF01EK687.34.6.A06.1.454.CMB.1.raw
  modified_base (190)..(190): a, c, t, g, unknown or other
  misc_feature (190)..(190): n is a, c, g, or t
  modified_base (457)..(457): a, c, t, g, unknown or other
  misc_feature (457)..(457): n is a, c, g, or t
  modified_base (460)..(490): a, c, t, g, unknown or other
  misc_feature (460)..(490): n is a, c, g, or t
tcagtacacgtgatcacgaccggtgctcgatttagatctactgacagggccagtcagagtgttaatagcattctacttagcctggtaccagcagaaacctggccagcctcccagactccctcattaatggtgcatactaacgacgggcccctggcatcccagacaggttcagtggcagtgggtctggganagcttcactctcaccatcagcagacttgacgcctagtaagttagtttttgctaggtaattattacctgttcagctaaatatcgagacgctactggtgggcgtttcggaccgtaaggggaccaagggttaggaaactacgaaacgaacgtgtggctggaccaccgattcctgttccttcattccctccccggacattctagaacttcgacgtgttaacctggacggcgggtacgttcgggacgtaaacgggccgtacacgttaggatncgnnnnnnnnnnnnnnnnnnnnnnnnnnnnnnn

SEQ ID NO: 47156 - DNA, 311 bp, Homo sapiens
  misc_feature: GYAE6OF01DFNXP.34.6.A06.1.454.CMB.1.raw
  modified_base (296)..(311): a, c, t, g, unknown or other
  misc_feature (296)..(311): n is a, c, g, or t
tcagtacacgtgatcacgaccggtgctcgatttagatctactgacagggcccctggcatccccagaccaggttcacgtggcagtgggtctggggacagacttcgacctctcaccatcaccagactggagcctgaagattttgcagtgtattactgtcaacagttggtctcacacacgtggacgttcggccaagggaccaaggtggaaatcaaacgaactgtggctgcaccatctgtcttcatccttcccgcatctgaatcacgtgtaactgacgccggctggcaaggcgcagtagnnnnnnnnnnnnnnnn

SEQ ID NO: 47157 - DNA, 719 bp, Homo sapiens
  misc_feature: GYAE6OF01DMQ3O.34.6.A06.1.454.CMB.1.raw
  modified_base (433)..(433): a, c, t, g, unknown or other
  misc_feature (433)..(433): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgttctttgtctaccgaaggggaaagcgccctaccctctcctggcagggccagtcagagtgttaatagcatctacttagcctaggtaccagacaagaacctggccacgccctaccagtacctcctactattaacgtggtcactataccgtaccggacgggtccccctgggacctacgtaccccgagaaccgtggttaccaggttggacgtaggtcgggtcgagggacaggtaacttcgactctaccaactatcgacgccacgtccgtgacgtacgtacgtagtaagttnttttcgacgttagttttactacgtcgtactagtactaacgtacgttaagtacggtcgggtaccggttaggtaccggttaccgggaaccggtaacgggtaaccggtaaagggttaaccggtaaaacgtaaacccggtaaacgttaccggttagggtaacggtaccttacggaaccctaccgttacgtttccgttaccgttaccttaccgttaccgttacccgttaccccggacttacgttaccgtaagttaaccgtcttaaccggtcggtaaccgtggggtaccggg

SEQ ID NO: 47158 - DNA, 309 bp, Homo sapiens
  misc_feature: GYAE6OF01BGD36.34.6.A06.1.454.CMB.1.raw
  modified_base (286)..(287): a, c, t, g, unknown or other
  misc_feature (286)..(287): n is a, c, g, or t
  modified_base (289)..(309): a, c, t, g, unknown or other
  misc_feature (289)..(309): n is a, c, g, or t
tcagtacacgtgatcacgaccggtgctcgatttagatctactgacagggcccctggcatcccagacaggttcagtggcagtgggtctgggacagacttcgactctcaccatcaccagactggagcctgaagattttgcagtgtattactgtcaacagttggtctcacacacgtggacgttcggccaagggaccaaggtggaaatcaaacgaactgtggctgcaccatctgtcttcatctcccgcatctgaatcacgtgtactgacgcggctggcaaggcgcatagnngnnnnnnnnnnnnnnnnnnnnn

SEQ ID NO: 47159 - DNA, 298 bp, Homo sapiens
  misc_feature: GYAE6OF01CBZ4Q.34.6.A06.1.454.CMB.1.raw
  modified_base (287)..(298): a, c, t, g, unknown or other
  misc_feature (287)..(298): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttgtctcacacacgtggacgttcggaccaagggaccaaggtgaaatcaaacgactgtggctgcaccatctgtcttcatcctcccgcatctgaatcacgtgtactgagcgggctggcaaggcgcaagtgcannnnnnnnnnnn

SEQ ID NO: 47160 - DNA, 402 bp, Homo sapiens
  misc_feature: GYAE6OF01DOPIE.34.6.A06.1.454.CMB.1.raw
  modified_base (186)..(186): a, c, t, g, unknown or other
  misc_feature (186)..(186): n is a, c, g, or t
  modified_base (355)..(355): a, c, t, g, unknown or other
  misc_feature (355)..(355): n is a, c, g, or t
  modified_base (384)..(384): a, c, t, g, unknown or other
  misc_feature (384)..(384): n is a, c, g, or t
  modified_base (391)..(402): a, c, t, g, unknown or other
  misc_feature (391)..(402): n is a, c, g, or t
tcagtacacgtgatcacgaccggtgctcgatttagatctactgacagggccagtcagagtgttaatagcatctacttagcctggtactagcagaaacctggccagcctcccagactcctcattaatggtgcatactacagggcccctggcatcccagacaggttcagtggcagtgggtctgggacngacttcactctcaccatcaccagactggagcctgaagattttgcagtgtattactgtcaacagttggtctcacacacgtggacgttcggccaagggaccaaggtggaaatcaaaacgactagtggactgcaccagtctgtcttcactcttcccgcatccgaatcacgtntacgtgacgcgggactgggacaaggggcncagtagnnnnnnnnnnnn

SEQ ID NO: 47161 - DNA, 727 bp, Homo sapiens
  misc_feature: GYAE6OF01EXGSM.34.6.A06.1.454.CMB.1.raw
  modified_base (712)..(712): a, c, t, g, unknown or other
  misc_feature (712)..(712): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgttctttgtctccgaggggaaagacgccaccctctcctgcagggccagtcaggagtgttaatagcatctacttagcctggtaccagcagaaacctggccacgcctccagactcctactattaagtggtgactactacgtacgaccgggtcccctggaccactcccgagaccgtaggttacaggtggctagggtcggtcgtacgggacacgacctccgaccgtcctccgaacctactacccgaaccgacggtaaccgtcgggaacccgtaccgttaggtaaacgtttacgtttttacggacgttaagggttacgtttaacgtttacgttaacgtaccgtaaacgttagggtttacggttacctaacgtaccgtaaccgtaccggggttacgggtaacccgtttaccggggaacccgaaagggggtaacccgtaaaggggtaacggtaaaacgtaccggtaaaacggtaacgtgggtacgcgttacgacctaccgtacttcgtcgttacttacctacgttccccgttcccgtacttacgtcgtacgaacgttacgtacgtacgttacgngggtaccgggtcggg

SEQ ID NO: 47162 - DNA, 550 bp, Homo sapiens
  misc_feature: GYAE6OF01AGXOA.34.6.A06.1.454.CMB.1.raw
  modified_base (166)..(166): a, c, t, g, unknown or other
  misc_feature (166)..(166): n is a, c, g, or t
  modified_base (176)..(176): a, c, t, g, unknown or other
  misc_feature (176)..(176): n is a, c, g, or t
  modified_base (383)..(383): a, c, t, g, unknown or other
  misc_feature (383)..(383): n is a, c, g, or t
  modified_base (522)..(522): a, c, t, g, unknown or other
  misc_feature (522)..(522): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaanagccaccctntcctgcagggccagtcagagtgttaatagcatctacttagcctggtaccagcagaacctggccagcctccagacctcctcattaatggtgcatactacgacgggccctggcactcccagacaggttcaggtggctaggtgggtctgggacagtacttcactctcaccactcaccagacgtggacgcctagaagtatttgactagttntattactgtactaacgtagttcgtctcgactacgtacgtcggtacgttacggaccgaagggacctaaggtaggaactacgaaacgtagtcgtgacgtgaccactatcgtcgttctacacttccgtccgtctactcgtanaacgtcctacgtagtacgtggcgtcggg

SEQ ID NO: 47163 - DNA, 291 bp, Homo sapiens
  misc_feature: GYAE6OF01D069W.34.6.A06.1.454.CMB.1.raw
  modified_base (123)..(123): a, c, t, g, unknown or other
  misc_feature (123)..(123): n is a, c, g, or t
  modified_base (287)..(291): a, c, t, g, unknown or other
  misc_feature (287)..(291): n is a, c, g, or t
tcagtacacgtgatcacgaccggtgctcgatttagatctactgacagggcccctggcatcccagacccactgccactgaacctgtctgggacagacttcactctcaccatcaccagactggancctgaagattttgcagtgtattactgtcaacagttgtctcacacacgtggacgttcggccaagggaccaaggtggaaatcaaacgactgtggctgcaccatctgtcttcattccttcccgcatctagaatcacgtgtactgagcgggctggcaaggcgcatagnnnnn

SEQ ID NO: 47164 - DNA, 480 bp, Homo sapiens
  misc_feature: GYAE6OF01EIVHJ.34.6.A06.1.454.CMB.1.raw
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (449)..(480): a, c, t, g, unknown or other
  misc_feature (449)..(480): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacacgggcccctggcatcccagacaggttcagtggcagtgggtctgggacagacttcactctcaccatccaccagacgtggagcctagaagtattttgctagtgttacttactgtacaacgtagttggtactcaacacgtacggtcggtaccggtttccggaccgaaaggggaaccaaggggtaggaaaactacgaaaacggaacttggtacggctggccacgattcgtcgtcttcacttccttcccgactagtcctagaactcacgtagtacngacggtcggntcgggacaaggtccganactagcagcagnnnnnnnnnnnnnnnnnnnnnnnnnnnnnnnn

SEQ ID NO: 47165 - DNA, 663 bp, Homo sapiens
  misc_feature: GYAE6OF01DNQRT.34.6.A06.1.454.CMB.1.raw
  modified_base (167)..(167): a, c, t, g, unknown or other
  misc_feature (167)..(167): n is a, c, g, or t
  modified_base (333)..(333): a, c, t, g, unknown or other
  misc_feature (333)..(333): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccagggggaaanacgccaccctctcctgcagggccagtcagagtgttaatagcatctacttagcctggtaccagcaagaacctggccagccctccagactcctcattaatggtgctaatactacgacgggcccctggcactcccagacaggttcaggtggcgaggtgggtctgggacngtacttcactctacaccatccacagactggacncctagtaagtatttgcgtagttnttaattactgttactaacgtgttacgtctacgtactacgtaccggtggtaccggttacggaccgtaaagggaaccgtaagggtaacggaaactaccgaaaacggtaacgttcgggtacggtaccgttaggacctacgtacttccgttacggttacctttccctaacgttttccccgttacccccggtaacccttacgtttacccgttaacggtaaaaccgtttcccggaacccggtttaaccggttacgttacggggtaacgggtcccgggggg

SEQ ID NO: 47166 - DNA, 311 bp, Homo sapiens
  misc_feature: GYAE6OF01CLR9J.34.6.A06.1.454.CMB.1.raw
  modified_base (168)..(168): a, c, t, g, unknown or other
  misc_feature (168)..(168): n is a, c, g, or t
  modified_base (290)..(292): a, c, t, g, unknown or other
  misc_feature (290)..(292): n is a, c, g, or t
  modified_base (294)..(311): a, c, t, g, unknown or other
  misc_feature (294)..(311): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttgtctcacacncgtggacgttcggccaagggaccaaggtggaaaatcaaacgactgtggactgcaccatctgtctcatcctccgcattcagaatcacgtgtactgagccgggctagggcaaggcgacagtagnnngnnnnnnnnnnnnnnnnnn

SEQ ID NO: 47167 - DNA, 295 bp, Homo sapiens
  misc_feature: GYAE6OF01EA2TJ.34.6.A06.1.454.CMB.1.raw
  modified_base (285)..(285): a, c, t, g, unknown or other
  misc_feature (285)..(285): n is a, c, g, or t
  modified_base (291)..(295): a, c, t, g, unknown or other
  misc_feature (291)..(295): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagtattttgcagtgtattactgtcaactagttgtctcacacacgtggacgttcggccaagggaccaaggtgaaatcaaacgactgtgctgcacatctgtcttcatccttccgcatctagtaactcgtacgtcgtactgaggcggtctggacgaggcnagtagnnnnn

SEQ ID NO: 47168 - DNA, 597 bp, Homo sapiens
  misc_feature: GYAE6OF01AWMR3.34.6.A06.1.454.CMB.1.raw
  modified_base (365)..(365): a, c, t, g, unknown or other
  misc_feature (365)..(365): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaagagccaccctctcctgcagggccagtcagagtgttaatagcatctacttagcctggtaccagcagaaacctggccagcctcccagacctcctcattaatggtgcatactacgacggcccctggcactcccagactaggtcagtggcgaggtcgggtcgtagggacagtacttcactctcaccactcacgagactggacncgtagaagtatttgctagtagtacttactgtactaacgtgtttggtctacactacgtagtggtcggtaccggttacggaccgaacgggaactaagggtaggaaacgtacgaaacgtaacgttaggtaggtactacgacctacctacgttaccgtcgttaccgtttcgactttcccttaccccggactaccgttcgtacgtaacttccgtaacggttacgtcgtcggtacggg

SEQ ID NO: 47169 - DNA, 290 bp, Homo sapiens
  misc_feature: GYAE6OF01A8M34.34.6.A06.1.454.CMB.1.raw
  modified_base (280)..(280): a, c, t, g, unknown or other
  misc_feature (280)..(280): n is a, c, g, or t
  modified_base (284)..(290): a, c, t, g, unknown or other
  misc_feature (284)..(290): n is a, c, g, or t
tcagtacacgtgatcacgaccggtgctcgatttagatctactgacagggcccctggcatcccagacaggttcagtggcagtgggtctgggacagacttcactctcaccatcagcagacttgagcctgaagattttgcagtatattactgtcagcaatatcgagacgcacgtgtgggcgttcggccaagggaccaaggtggaaatcaaacgactgtggctgcacatctgtcttcatcttctcgccatctgaatcacgtgtactgagcggctggcaaggcgnatgnnnnnnn

SEQ ID NO: 47170 - DNA, 722 bp, Homo sapiens
  misc_feature: GYAE6OF01DR0TQ.34.6.A06.1.454.CMB.1.raw
  modified_base (166)..(166): a, c, t, g, unknown or other
  misc_feature (166)..(166): n is a, c, g, or t
  modified_base (205)..(205): a, c, t, g, unknown or other
  misc_feature (205)..(205): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaanacgccaccctctcctagcagggccagtcagagtgttaanagcatctatagcctagtaccagcagaacctggccagcctaccagtacctcctactaagttaatggtcactactaccgtacgacgggtccccctaggcctacgtacccgagtacctaggttcctaggtggacgtaggtcggtcgtacgggaactaggtacctttccaccgttccaccgaactactacccgaaccgtaacggtcgtacggacgtccgttagtaacgtttagttttcggacgttagttacgttaacttaccgttagtaaccgtaacgttaggtttcgttaactaccgtaactaccggtacggttacgggtaaccggtttacccgggaaccggtaaacggggtaaccgtaaaggggttaccgaaaagtaaccgtaaacggtaacctgggtacggaccgttacgaccctacgtacgttccgttacgtaccttacctaccgttccccgttacccaccgttacttaccgttaagtacgtaccgttacgtacgttacgcgggtacggtacccggg

SEQ ID NO: 47171 - DNA, 395 bp, Homo sapiens
  misc_feature: GYAE6OF01BKTF2.34.6.A06.1.454.CMB.1.raw
  modified_base (333)..(333): a, c, t, g, unknown or other
  misc_feature (333)..(333): n is a, c, g, or t
  modified_base (343)..(395): a, c, t, g, unknown or other
  misc_feature (343)..(395): n is a, c, g, or t
tcagtacacgtgatcacgaccggtgctcgatttagatctactgacagggccccctggcatccccagaccaggttcacgtggcagtgggtctgggacagacttcgacctctcacatcaccagactggagctgaagattttgcagtgtattactgtacaacagttggctcacacacgtcggtacgttccggaccaaagggaccaagggtggaaaatccgaaaacggaactgtcggactgacaccgtatctcgtcttacacttccgttccccgctatcctgtaaactcctacggtacgtaactggacggccggtctcggacgaacggcgacgtagngatgactgannnnnnnnnnnnnnnnnnnnnnnnnnnnnnnnnnnnnnnnnnnnnnnnnnnnn

SEQ ID NO: 47172 - DNA, 425 bp, Homo sapiens
  misc_feature: GYAE6OF01EKTMY.34.6.A06.1.454.CMB.1.raw
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (401)..(402): a, c, t, g, unknown or other
  misc_feature (401)..(402): n is a, c, g, or t
  modified_base (404)..(425): a, c, t, g, unknown or other
  misc_feature (404)..(425): n is a, c, g, or t
tcagtacacgtgatcacgaccggtgctcgatttagatctactgacagggccagtcagagtgttaatagcatctacttagcctggtaccagcagaaaacctggccagcctcccagactcctcattaatggtgcatactacagggcccctggcatcccagacaggttcagtggcagtgggtctgggacagaattcactctcaccatcagcagcctgcagtctagtaagtattttgctagtttattactgtcagctagtaataagtactcggccgtccgggtacgttcgaccgaacgggacaagggtgaatacaaacgtatgtggctgcactntcngtctnactccttccgctatctgaactcacgtgtactggagtcggctgggactagggccanagtangtnngnnnnnnnnnnnnnnnnnnnnnn

SEQ ID NO: 47173 - DNA, 456 bp, Homo sapiens
  misc_feature: GYAE6OF01DLBNB.34.6.A06.1.454.CMB.1.raw
  modified_base (131)..(131): a, c, t, g, unknown or other
  misc_feature (131)..(131): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (420)..(456): a, c, t, g, unknown or other
  misc_feature (420)..(456): n is a, c, g, or t
tcagtacacgtgatcacgaccggtgctcgatttagatctactgacagggccagtcagagtgttaatagcatctacttagcctggtaccagcagaaacctggccagcctccccagactcctcattaatggtncatactacagggcccctggcactcccagacaggttcagtggcagtgggtctgggacagcttcactctcaccatcaccagactggagcctgagtattttgctagttgtattctgtacaagtagttgtctcgacacgacgtggacgttccgacgaacgggtacaagggtagaaatacgaaacgagtgtcgcgtcgacactattctacgttctactactcgttccccgatactctagaactctacgtntaccgnggacggtcggcgtaggaccgaacggtcgtacgatagcnnnnnnnnnnnnnnnnnnnnnnnnnnnnnnnnnnnnn

SEQ ID NO: 47174 - DNA, 665 bp, Homo sapiens
  misc_feature: GYAE6OF01BFV1C.34.6.A06.1.454.CMB.1.raw
  modified_base (631)..(631): a, c, t, g, unknown or other
  misc_feature (631)..(631): n is a, c, g, or t
tcagtacacgtgatcacgaccggtgctcgatttagatctactgacagggaaccatggaaaccccagcgcagcttctcgttcctcctgcctactctggctcccagactactcaccggagaaattgtgttgaccacagtctccaggcacctgtctttgtctccagggaagacgccacctctcctgcagggccagtcagagtgtaactgcatctacttagcctaggtaccagacagaaccgtggaccagcctccgagacctcctactattaagtcggtagactactacctacgacgggcccctggccactccagacgtacggtcaggtcgacgtaggtcgggtcgtacgggactcggtacctttaccgactccgtacgacctactaccgaaccgtacgaccggttcgggaactccgtacgtaaagtttcgttacggtacctaggttacgttaacttacgtacgtactaacgttacggttcgtaccttacgtaactaccggtacgttacgggttaccggtaccggtaaccgtaacggaccgttaacgggtagtaaaccgtaacgtaaacggtacgtagtacggtacttacgacgtacctagtcgtacttccgtataccgttccgtaccgtacctntccgtactacgtcgtactgtacgtggtacgtcgg

SEQ ID NO: 47175 - DNA, 705 bp, Homo sapiens
  misc_feature: GYAE6OF01CB8KJ.34.6.A06.1.454.CMB.1.raw
  modified_base (168)..(168): a, c, t, g, unknown or other
  misc_feature (168)..(168): n is a, c, g, or t
  modified_base (206)..(206): a, c, t, g, unknown or other
  misc_feature (206)..(206): n is a, c, g, or t
  modified_base (590)..(590): a, c, t, g, unknown or other
  misc_feature (590)..(590): n is a, c, g, or t
  modified_base (616)..(616): a, c, t, g, unknown or other
  misc_feature (616)..(616): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggccaccctgtctttgtctccgaggggaaanacgccaccctctcctgcagggccagtcagagtgttaanagcatctattacgcctggtaccagcaacgaaacctggaccacgccctcccgagaccttcctacaatttaacgtggtcgactactaccgtacgaccgggcccctggccactcccgagaccgtaggtttccgaggtcggcgtaggttcgggtacgtaggggactacggtaccttactaccttcctacctaacgtactacccgaaccgtaaggtaccgtagggtaaccgtacccgttaggtaaaacgtttgttttacgaacgttaggttacgtttaacgttacgtacgttacctaagttacggttcgtactacgtacaacggtacggtcggtaaccgtcggaacccgaagggtacctaagggtaacgaactaacgaaacgttacggngtacggacttacgacctagtaccgtnttaccgttcgtttaccaccgtttcccgttacccgacttagtaccttaggtaacctccggttaacgttctaacggtggtacgggtccggg

SEQ ID NO: 47176 - DNA, 586 bp, Homo sapiens
  misc_feature: GYAE6OF01CGNSF.34.6.A06.1.454.CMB.1.raw
  modified_base (166)..(166): a, c, t, g, unknown or other
  misc_feature (166)..(166): n is a, c, g, or t
  modified_base (294)..(294): a, c, t, g, unknown or other
  misc_feature (294)..(294): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaanagccaccctctcctgcagggccagtcagagtgttaatgcatctacttagcctggtaccagcagaacctggccagcctccagactcctcatcttggtgcgtccaccacgggccactggcactccagacnggttcaggtggcgtaggtcgggtcgtcggggacacggtaccttcgactcctacaaccatccagtcacgtacgttgacgtcgtagtaagttagttttagctagttaattattacgtgtactagactaagtacgtacgagaccgactacgttggcgggtccgttacggaccgaacgggacgtaagggtacgtaaacgtaccgtaaacgtacgtcggtacggtacgtcgaccgtacacgtacgttcgtcgttactcttccctcccgcctatcctagtacctcgtacgtgtaacgg

SEQ ID NO: 47177 - DNA, 635 bp, Homo sapiens
  misc_feature: GYAE6OF01DXT90.34.6.A06.1.454.CMB.1.raw
  modified_base (327)..(327): a, c, t, g, unknown or other
  misc_feature (327)..(327): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacaggcccctggcatcccagacaggttcagtggcagtgggtctgggacagacttnactctcaccatcacagactggagcctgaagtagttttgactaagttgttaattactacggtactaacgtacgtttaggtcctactaacgaacctacgggttaggaacggtttccgggaaccgaaacggggtaaccctaaaggggtaagaaaacgtaaccgaaaaccgaaacgttacgggtagggtaccttggaaccaccgtaatccgtagttcccttacgtacgttccctttaccccggtacctactttaccgtacgtaaacgttaccgtaaccgttacggttaaccgtggtaacgggtacccggggg

SEQ ID NO: 47178 - DNA, 637 bp, Homo sapiens
  misc_feature: GYAE6OF01CURWR.34.6.A06.1.454.CMB.1.raw
  modified_base (163)..(163): a, c, t, g, unknown or other
  misc_feature (163)..(163): n is a, c, g, or t
  modified_base (199)..(199): a, c, t, g, unknown or other
  misc_feature (199)..(199): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (399)..(399): a, c, t, g, unknown or other
  misc_feature (399)..(399): n is a, c, g, or t
tcagtacacgtgatcacgaccggtgctcgatttagatctactgacagggaaccatggaaacccagcgcagcttctcttcctcctgctactctggctcccagatatcaccggagaaattgtgttgacacagtctccaggcaccctgtctttgctccaggggaanagccacctctcctgcagggccagtcagagtgttaangcatctactagcctggtaccagcagaacctggccagcctccagactctcatangtncatactacgacggccctggcacnccagacnggttcagtgcngtggtctgggacngactcactcncacatcacagtctaggacncctagaagttatttcgactagttcgtaacttactcgtactaacgtgttggtactactaacncgtacgtacggtaccggttaccggaccgtaaacgggtaacccgtaagggtaacgtaaacgttaaccgaaacggttaacgttcgggacggtaccgtacggtaccctacgtacgtacccgttacggttaccctttacgtaacccgtttaccggttcccccggtaccttaccgttaccgttaaacgtaaacgtttcccgtaaacggttacggttaacccgtagggtacccgggtacccggg

SEQ ID NO: 47179 - DNA, 397 bp, Homo sapiens
  misc_feature: GYAE6OF01CESZI.34.6.A06.1.454.CMB.1.raw
  modified_base (334)..(334): a, c, t, g, unknown or other
  misc_feature (334)..(334): n is a, c, g, or t
  modified_base (385)..(397): a, c, t, g, unknown or other
  misc_feature (385)..(397): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtgaaatcaaaacgaactgtggctgacacgatctgtctcatctccncatcgtgaactcacgtgtactgagtcgggctcggacaacggcgacatacgnnnnnnnnnnnnn

SEQ ID NO: 47180 - DNA, 850 bp, Homo sapiens
  misc_feature: GYAE6OF01AWWJG.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagtaaattgtgttgacacagtctccaggcacctgtctttgtctccgaggggaagacgcccaccctctcctgcgagggccagtcagagttgttaagtagcattctaacttacgcctggtaccagacaacgaaaccctgggccacggccctaccagtaccttccgttactaatttaacgtggtacggactaagttaccgtaaccgtacggggccccccttgggacctaacttcccccgaaggtaccgtagggttttaccacgggttcgggacctaaggggttcggggtaccgtaggggaacctacgtaccgtttaccaaccttaccgtacctaacctacttccgaaccgaggtaccggtacgggaccgtaccgttaggtaaacgtttacgttttacggccgttaagtttacggtttaactttacgttacggttacctaaacggtttacggtttacgggtaccttaacgaccgttaaacggtaccgggtttacgggtacccggggtttaacgggtaaacccggtaacggggttaaaccccggttaaggggtaaaccgggtaaaacgttacccggtaaaaacggttacggttacggggttaccggaaccttcgggacccttaaaccgttcttacggttaccgtttacttacccgttaacgttccctttaaccccgaccgttacttaaccgtaacgtaaccttacggtaaccggttacgttaacgtcggggaaccggtcgggg

SEQ ID NO: 47181 - DNA, 600 bp, Homo sapiens
  misc_feature: GYAE6OF01DKNCR.34.6.A06.1.454.CMB.1.raw
  modified_base (222)..(222): a, c, t, g, unknown or other
  misc_feature (222)..(222): n is a, c, g, or t
  modified_base (561)..(561): a, c, t, g, unknown or other
  misc_feature (561)..(561): n is a, c, g, or t
  modified_base (563)..(600): a, c, t, g, unknown or other
  misc_feature (563)..(600): n is a, c, g, or t
tcagtacacgtgatcacgaccggtgctcgatttagatctactgacagggccagtcagagtgttaatagcatctacttagcctggtaccagcagaaacctggccagcctcccagacctcctcattaatggtgcatactacgagggcccctggcatcccagacaggttcagtggcaggtgggtcgtgggacagtacttcactctcaccatccaccagactggancctagaagtattttgctagttgttattactgtacaacgtagtttcggctacaacgaccgtacggttcgggaaccggtttccgggaacccggaaaacgggggtaacccgtaaaggggttaacggaaaaacgttaccgaaaaaaccggtaaacgttgggtacggtacctacgggaccctaaaccctagtttaccttcggttaccctttactaaccgttttccccgttaccccggacccttaattaccgttacggtaaaacttcccgtaaggttcggtaaccgtcggggtacggaccggggtcgttacgggaacggtaacgggcccgaagaacgttgatcgnannnnnnnnnnnnnnnnnnnnnnnnnnnnnnnnnnnnnn

SEQ ID NO: 47182 - DNA, 423 bp, Homo sapiens
  misc_feature: GYAE6OF01C39KJ.34.6.A06.1.454.CMB.1.raw
  modified_base (366)..(366): a, c, t, g, unknown or other
  misc_feature (366)..(366): n is a, c, g, or t
  modified_base (405)..(423): a, c, t, g, unknown or other
  misc_feature (405)..(423): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggacgcctagaagtattttgctagtagtattactgtacaacagtttcggctcacacacgtggacgttcggccaagggaccaagggtagaaaatcaaaacgacgtgtggctgcaccatctgtcttcacttccttccgcatctagaactcacgttntacgtggaggcgggtcgtaggcgaaggcgactaagtagnnnnnnnnnnnnnnnnnnn

SEQ ID NO: 47183 - DNA, 849 bp, Homo sapiens
  misc_feature: GYAE6OF01BPJ8U.34.6.A06.1.454.CMB.1.raw
  modified_base (797)..(797): a, c, t, g, unknown or other
  misc_feature (797)..(797): n is a, c, g, or t
  modified_base (834)..(834): a, c, t, g, unknown or other
  misc_feature (834)..(834): n is a, c, g, or t
tcagtacacgtgatcacgaccggtgctcgatttagatctactgacagggaaccatggaaaccccagcgcagcttctcttcctcctgctactctggctccagatatcacggagaattgtgtgacacagtctccgaggcctaccctgttctttgtcctaccggaagggggaaacgacgcccaccctctcctggcgacgggccagtcagtagttagttaatagctatcttacgttacgcctggtaaccagacgaacgaaccgtcgaccacgccctaccacgaccttcctactaagtttaagtggtcactacgttacgtaccggtaccgggtcccctaggacctaacccgtaccccggaaggtaccgttaacgggttccgaacggggtcggtaccggtaacgggttccggggtttaccgggacggggtaaccgtaacgtaaccgtttaccgaaccttttcccaaccgtaacccgaacttaacccaaccggtaacggtacggtaccgggtaacgtacccgttaaaggtaacgttttagtttacggacgttaaggtttaccttacgtttacgttaacgttaaccggtaacgtttaacgggttcgtaacccttacggtaaaccgtacgggttaccggtaccgggttaacccgggttaaccgggaacgtaaaccggggaacttaaacggggtaacggtaaacgtaaccgggtaaaccgtacggttacggggtacgtacgtaacgtaccctaacgtcgtctttacccgtacgtttaccgaccgtttaaccccggtccaaccggttntacttaacccggtacttacggttacttaggtaaccgngggtcgggtacccgg

SEQ ID NO: 47184 - DNA, 562 bp, Homo sapiens
  misc_feature: GYAE6OF01DH7YQ.34.6.A06.1.454.CMB.1.raw
  modified_base (167)..(167): a, c, t, g, unknown or other
  misc_feature (167)..(167): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (516)..(516): a, c, t, g, unknown or other
  misc_feature (516)..(516): n is a, c, g, or t
tcagtacacgtgatcacgaccggtgctcgatttagatctactgacagggaaccatggaaaccccagcgcagcttctcttcctcctgctactctggctccagatatcaccggagaaattgtgttgacacagtctccaggcaccctgtctttgtctccgagggggaaanagccaccctctcctgcagggccaggtcagagttagttaatagcatctacttagcctggtaccagcaagaaacctggccagcctccagactcctcaattagngtnacatactacacgggccctggcactccagtacaggttcagtggctaggtgggtactgggaacagaccttcgactccgtcaaccataccgacctagactggacgtcgtgaaatatttggctaaggttgttaacttactgttacaacgtaggttgtactacaacacgtacggtggtaccgttcgacgaagggaccaaggtacgaaactacgaaacgtacgtaggtcggactgacctactagttccgtntacttcacgttcctccgcctatctagactcagttgactggtgtcgg

SEQ ID NO: 47185 - DNA, 291 bp, Homo sapiens
  misc_feature: GYAE6OF01BC8TD.34.6.A06.1.454.CMB.1.raw
  modified_base (285)..(291): a, c, t, g, unknown or other
  misc_feature (285)..(291): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcgcatagnnnnnnn

SEQ ID NO: 47186 - DNA, 584 bp, Homo sapiens
  misc_feature: GYAE6OF01B21KZ.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtcgccagacaccctgtctctgtctccgaggggaaagagccaccctctcctgcagggtcagtcagtcgttctaacaccgtacttcttcgcctggtaccagcagacgacctggccaggcctcccgaggcctcctctattcgtttggtgccgtaccaccgacgggccacgtcggcactcccagacgaggttcaggtggcgtagggtcgggtcgtagggacagtacctcgactcctcacatcgagcagtacttgacgtcgtagtagtatttgactaagttattattacgtgtacagtactaatacgtcgaagtacgctacggttggtacgggtccggttacgggacgaacggggaacgtaagggtacggaaactacgtaaacgacgttggcggactcgacactactcgtgttcttactacttccgttcccgctacgtctacgactcgtagtcgtacg

SEQ ID NO: 47187 - DNA, 581 bp, Homo sapiens
  misc_feature: GYAE6OF01CRJDK.34.6.A06.1.454.CMB.1.raw
  modified_base (168)..(168): a, c, t, g, unknown or other
  misc_feature (168)..(168): n is a, c, g, or t
  modified_base (265)..(265): a, c, t, g, unknown or other
  misc_feature (265)..(265): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaaggggaaanacgccaccctctcctgcagggccagtcagagtgttaatagcatctacttagcctggtaccagcaagaacctggccagcctccagactcctcattaanggtgcatactacgacgggccctggcatcccaagtacgaggttcaggtcggacgtaggtcgggtctgggactaggacttcgactctcacctagtccaaccgagtacgtggacgtcctaggaattacgtttcgactagttcgtaatttactgttacaagtgttgtactcaacgacgtacggtcggtaccgttacggacgtaacgggtaccgaagggtacgaaagtacgaaacgtacgtgtgactcgacactatctcgtctcgtactccgttacccgctactcgtagtaactctacgttgtaacgtggacggtaccggg

SEQ ID NO: 47188 - DNA, 409 bp, Homo sapiens
  misc_feature: GYAE6OF01ELTE4.34.6.A06.1.454.CMB.1.raw
  modified_base (394)..(394): a, c, t, g, unknown or other
  misc_feature (394)..(394): n is a, c, g, or t
  modified_base (397)..(409): a, c, t, g, unknown or other
  misc_feature (397)..(409): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgcagttgttattactgtacaacagttggtctcacacacgtggacgttcggaccaagggaccaaggtaggaaatcgaaaacgactggtgctgcacatctgtctacactcttcccgcatctagactcacgtgtactggaggcggcgtggacgaagggctacagtagntgnnnnnnnnnnnnn

SEQ ID NO: 47189 - DNA, 587 bp, Homo sapiens
  misc_feature: GYAE6OF01AODAV.34.6.A06.1.454.CMB.1.raw
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (491)..(491): a, c, t, g, unknown or other
  misc_feature (491)..(491): n is a, c, g, or t
  modified_base (505)..(505): a, c, t, g, unknown or other
  misc_feature (505)..(505): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgcgagtgtattactgtcaactagttggtctacacacgtacggtcggtacgttccggaccgtaacgggaccgaagggtacggaaactaccgaaaacggtacgtggtacggctacgacctacctagttccgttgttccttacgtacttcccgtttccccgactacgtccgtagtaactcgtacgttcgtacgtggacggtcggtacgtacgggacaacgggtccagtaacgtaggcatacgcgatncgtnaacggctacggacncgctacgcgtcgcncgtacgcgtcgcgtacgacgacgcgacgacgtacgcgtcgtacgcgcgacgtacgtacgtacgtacgtacgactgtcgtacg

SEQ ID NO: 47190 - DNA, 290 bp, Homo sapiens
  misc_feature: GYAE6OF01BDN03.34.6.A06.1.454.CMB.1.raw
  modified_base (285)..(290): a, c, t, g, unknown or other
  misc_feature (285)..(290): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatccttcccgcatctgatcacgtgtactgagcggctggcaaggcgcatagnnnnnn

SEQ ID NO: 47191 - DNA, 819 bp, Homo sapiens
  misc_feature: GYAE6OF01D3T9Q.34.6.A06.1.454.CMB.1.raw
  modified_base (169)..(169): a, c, t, g, unknown or other
  misc_feature (169)..(169): n is a, c, g, or t
  modified_base (212)..(212): a, c, t, g, unknown or other
  misc_feature (212)..(212): n is a, c, g, or t
tcagtacacgtgatcacgaccggtgctcgatttagatctactgacagggaaccatggaaaccccagcgcagcttctcttcctcctgctactctggcctccagactcgccccggataaattgtgttgacgcagtcgccagacacctgtctctgtctccgaaggggaaacncgcccaccttctcctgcgacgggtcagtcacgtcttactaacnccgtacttccttcgccgtagtaccagacgacgacgaccgtcggccgacggtcctaccggacgtccttacctctactttcggttttcgggccgtcccgtacccgaacggccggcctacggtcgacctaccgtcccgaagtacgtaggttaccgaggtcggacgtagggttcgggtcgtacgggaactacgtaccttaccgacttccaccacgtactacgataccgtagtacgttcggacgttaccgtaagtaacgtttctttacgacctttaaagttacgttaacttaccgtcggtaacgtacgaaacgttaaagttaaccggacgggtaaacgtacccgcgggtttaaccggttacggggttaccggggtacccgtttaacccggggaacgggtaaaaaccgggggaacccggttaaaggggtaaaacgggtaaaccttaacccggtaaaacgggttcgggttacgggttacgtacgtaccccggtaaccctaccgttacgggtttactttaaccggtttcccttaaccgggttccctttcccccgttaccggaccttaacttcggttaaccgtactaccggttaaacggttcgtacccggggtagg

SEQ ID NO: 47192 - DNA, 602 bp, Homo sapiens
  misc_feature: GYAE6OF01AXPH9.34.6.A06.1.454.CMB.1.raw
  modified_base (348)..(348): a, c, t, g, unknown or other
  misc_feature (348)..(348): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccatcagaacctggccagcctccagacctcctcattaatggtgcatactacgacgggcccctggcactccccagacaggttcaggtggcaggtcgggtcgtgggacagacttcacgtctcgaccntcaccagacgtggagcctagaagttattttgcgtaagttgttaacttacgtgttaccaacgttggttcggtacctacgactaccgtacgggttacggtaccggtttccggaccgaacgggtaacctaagggtagaaacgtaccgaaaacgtacgtgggtcggcgtacgaccaccgtcgttctcgttaccttcgtacgttcccgttcccgactattccgtagtaactccgtacgttgtacctgggacggtccggg

SEQ ID NO: 47193 - DNA, 820 bp, Homo sapiens
  misc_feature: GYAE6OF01DSTEA.34.6.A06.1.454.CMB.1.raw
  modified_base (170)..(170): a, c, t, g, unknown or other
  misc_feature (170)..(170): n is a, c, g, or t
  modified_base (183)..(183): a, c, t, g, unknown or other
  misc_feature (183)..(183): n is a, c, g, or t
  modified_base (207)..(207): a, c, t, g, unknown or other
  misc_feature (207)..(207): n is a, c, g, or t
tcagtacacgtgatcacgaccggtgctcgatttagatctactgacagggaaccatggaaaccccagcgcagcttctcttcctcctgctactctggcctcccagatatcaccggagtaaattgtgttgacacagtctccaggcaccctgttctttgtctcgaaggggaaancgccacctctccngcgaggccagtcagagtagttaanagctatctacttagtcctaggtaccagacaacgaacctggacccaagccctaccaagtaccttacctactaagtttaaacgtggtacgactaattaaccgtacgacgggcccctaggaccaccgtaccccgaagtaaccgtaggttacgaggtcggacgtagggttcgggtacgtagggaactagtaccttacgactccaccgaacctagtaccaaccgagtaccgtaggacgtaccgttaaggtaacgtttacgttttagacgttaagggttactttaacgtttacgtaacgttaacctaaacggttaggtttacccggtaccttaaccgtaacccgtaaaccgttaccgggggttaacggttaacccgggttaacggtaaacccgggtaaaccgggaaccgttaaaaggggtaaccggtaaaacgtaaccggtaaaaacggtacggttacggtacgtaccgtacgtaaccgttaacccgtaagttaccggttacgttaccgttaaaccctttcgttaacccccgttacccgaaccggttacttaacccggtttaacgaaccgtttaaccggttacgttaccggttaaccgtcgggtaccgggttacccggg

SEQ ID NO: 47194 - DNA, 296 bp, Homo sapiens
  misc_feature: GYAE6OF01AYDPJ.34.6.A06.1.454.CMB.1.raw
  modified_base (124)..(124): a, c, t, g, unknown or other
  misc_feature (124)..(124): n is a, c, g, or t
  modified_base (256)..(256): a, c, t, g, unknown or other
  misc_feature (256)..(256): n is a, c, g, or t
  modified_base (285)..(296): a, c, t, g, unknown or other
  misc_feature (285)..(296): n is a, c, g, or t
tcagtacacgtgatcacgaccggtgctcgatttagatctactgacagggccccgtggcatcccagacaggttcagtggcagtgggtctgggacagacttcactctcaccatcaccagactggancctgaagattttgcagtgtattactgtcaacagttggtctcacactacgtggacgttcggccaagggaccaaggtggaaatcaaacgactgtgctgcaccatctgtcttcatcctccgcatctgaatcagtntactgacgcggctggcaaggcgacatagnnnnnnnnnnnn

SEQ ID NO: 47195 - DNA, 756 bp, Homo sapiens
  misc_feature: GYAE6OF01BCOEQ.34.6.A06.1.454.CMB.1.raw
  modified_base (168)..(168): a, c, t, g, unknown or other
  misc_feature (168)..(168): n is a, c, g, or t
tcagtacacgtgatcacgaccggtgctcgatttagatctactgacaggggaaccatggaaaccccagcgcagcttctcttcctcctgctactctggctcccagatatcaccggagaaattgtgttgacacagtctccaggcaccctgtctttgtctccgaggggaaanacgcccaccctctcctgcgagggccaggtcaagtagttagttaaatagctatcttaacgttacgccgttaggtaccagacaacgaaacccgtggaccacgtccctaccgagtacctcctactaagtttaacgtcggtacactaacttaaccgtaccggaccgggtccccttggacctacgtaccccgaaggtaccgtaggtttccgaacgggttcggaccgtagggttcgggtacgagggtactacgtacgttccactacctacgaccgtactaccgaacgagtacgtacgggaccgtacgttaaggtaacgtttacgtttacgacgttagtttagttacttacgtacgtaaccgtaagttacggtttacgtactaccgaacgtaacggttacgggttaccgggtaccggttaaccgggaaccggtaaacgggtaaaccggttaagggtaacgaaacttaaccggaaacggtaacgtgggtaccgacgttacgaaccgtactagttccgtacgttacctaccgtacttcccgtacccgactgttaccgtataaccggtcttacggttagtacggtggaccgggttcgg

SEQ ID NO: 47196 - DNA, 671 bp, Homo sapiens
  misc_feature: GYAE6OF01A0J27.34.6.A06.1.454.CMB.1.raw
tcagtacacgtgatcacgaccggtgctcgatttagatctactgacagggcccctggcatcccagacccactgccactgaacctgtctgggatgccaggggccctgtagtatgcaccattaatgaggagctgctcagttacggacccagacggaaccatggaacgcccagcgcagcttctcttcctcctgctactctcggcctcccagactaccacgtaggaagaaatagtagatgacgcacgtcctccacgcctaccgtgttccgtgttcgtccgtaccggtaagggggaaacgtacgtcccaccccttcgtcccgtcggacgacggggcccacgaccgaggtaggttcgttacgcacgactaacgttcggccgttacggtaacccaggaccgaacgtaaacccgtggacccacgggtccctccggacggtccctccgtacacttactaatacgtcgtactacgacggcgacgggtcctacgtccggcctaccgacgtacgtacggttacgacggtcggtacgtagggttcggtcggtacggggctaaggtcccttacgtacctaccgtccgaactacgtccacggtactacggacgttacggaccgtcgtaaggttaacgttcgtttacggaacgttaggttacgttttaagtttcgttcggtgtaacgg

SEQ ID NO: 47197 - DNA, 772 bp, Homo sapiens
  misc_feature: GYAE6OF01CRVQW.34.6.A06.1.454.CMB.1.raw
  modified_base (464)..(464): a, c, t, g, unknown or other
  misc_feature (464)..(464): n is a, c, g, or t
tcagtacacgtgatcacgaccggtgctcgatttagatctactgacagggcccctggcatcccagacccactgccactgaacctgtctgggatgccaggggccctgtagtatgcaccattaacctgaggagtctgctcagttacggacccgaggacgggtaaccagtggaacgccccagcgcagtcttctccttcctcctgctactcgtggcctcccagaccaccacgtaggaataaatggtagaatcggacgctacgtcctccacgcctacccttgtcgttgtcgtaccgtacggaagggaaacgcctaccccgacccgttcctccgaggaccggacggcctaaggtcgaaggtgttcggttcggacctaggtacctaacgttcggacccgttacggaaccgacgaccgaaaccggtaaccgtccggacccgtacggcccttacccgaaggtacccttccctanaccgttacttcgtacgtacccttaaccgaacccgtaccccggaaaccggtccgggtaccctaacccggtttacttaacccgttaaccgtttcccgaaccggtttacccggttaaccggggtttactacggggttaccggtaccgtagggggtttaccggggtttacgtaacgggacgtaacggtttaccgttccgtaacccttccgaacctacgtacgtaccgtaccgcctacggtaccgtcgacgttaccggttacgtagtacgtttacgtttccgaacgttaccttttaacgtttgttaccgtacg

SEQ ID NO: 47198 - DNA, 289 bp, Homo sapiens
  misc_feature: GYAE6OF01BJLKT.34.6.A06.1.454.CMB.1.raw
  modified_base (276)..(276): a, c, t, g, unknown or other
  misc_feature (276)..(276): n is a, c, g, or t
  modified_base (282)..(289): a, c, t, g, unknown or other
  misc_feature (282)..(289): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaaggaccaaggtggaaatcaaacgactgtggctgcaccatctgtctcatcttccgcatctgaatcacgtgtactgagcggctggacaaggcncatagnnnnnnnn

SEQ ID NO: 47199 - DNA, 336 bp, Homo sapiens
  misc_feature: GYAE6OF01AH1TT.34.6.A06.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (288)..(289): a, c, t, g, unknown or other
  misc_feature (288)..(289): n is a, c, g, or t
  modified_base (292)..(295): a, c, t, g, unknown or other
  misc_feature (292)..(295): n is a, c, g, or t
  modified_base (298)..(336): a, c, t, g, unknown or other
  misc_feature (298)..(336): n is a, c, g, or t
tcagtacacgtgatcacgaccggtgctcgatttagatctactgacagggccccctggcatcccagacaggttcagtggcagtgggtctgggacagacttcactctcaccatcaccagactggagcctgaagtattttgcagtgtattactgtcaacagttgtctcacacacgtgacgttcggccaagggaccaaggtgaaatcaaagactgngctgcaccatctgtcttcatccttcccgcatcagtaancacgtgtactgaggcggctggacaggccgacagtaggnncgnnnntcnnnnnnnnnnnnnnnnnnnnnnnnnnnnnnnnnnnnnnn

SEQ ID NO: 47200 - DNA, 419 bp, Homo sapiens
  misc_feature: GYAE6OF01D2YBB.34.6.A06.1.454.CMB.1.raw
  modified_base (399)..(419): a, c, t, g, unknown or other
  misc_feature (399)..(419): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgctagtgtattactgtacaactagttggtctcacacacgtggacgttcggaccaagggaccaaggtggaaatcaaacgaactgtggctgccacatctgtcttcactcttcccgctatctagaactcacgtgtacgtgacggcgggctgggcgaaggtccgactaagtagnnnnnnnnnnnnnnnnnnnnn

SEQ ID NO: 47201 - DNA, 405 bp, Homo sapiens
  misc_feature: GYAE6OF01AWKA3.34.6.A06.1.454.CMB.1.raw
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (354)..(354): a, c, t, g, unknown or other
  misc_feature (354)..(354): n is a, c, g, or t
  modified_base (388)..(389): a, c, t, g, unknown or other
  misc_feature (388)..(389): n is a, c, g, or t
  modified_base (391)..(405): a, c, t, g, unknown or other
  misc_feature (391)..(405): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgctagtgtattacngtcaacagttgtctcanacacgtgacgttcgccaaggtaccaaggtgaaactcgaaacgactgtaggctgacacatctgtcttcatccttaccgcatctagaactcacgtntacgtgaggcggctacggcgaacgcgacagtagnnannnnnnnnnnnnnnn

SEQ ID NO: 47202 - DNA, 468 bp, Homo sapiens
  misc_feature: GYAE6OF01DOWTL.34.6.A06.1.454.CMB.1.raw
  modified_base (189)..(189): a, c, t, g, unknown or other
  misc_feature (189)..(189): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (375)..(375): a, c, t, g, unknown or other
  misc_feature (375)..(375): n is a, c, g, or t
  modified_base (427)..(427): a, c, t, g, unknown or other
  misc_feature (427)..(427): n is a, c, g, or t
  modified_base (433)..(441): a, c, t, g, unknown or other
  misc_feature (433)..(441): n is a, c, g, or t
  modified_base (443)..(447): a, c, t, g, unknown or other
  misc_feature (443)..(447): n is a, c, g, or t
  modified_base (449)..(468): a, c, t, g, unknown or other
  misc_feature (449)..(468): n is a, c, g, or t
tcagtacacgtgatcacgaccggtgctcgattttagatctactgacagggccagtcagagtgttaatagcatctacttagcctggtacctagcagaaacctggccagcctcccagactcctcattaatggtgcatactacagggcccctggcattcccagacaggttcggtggcagtgggtctgggacngacttcactctcaccatcaccgagactggacncctgaacgtnttttgctagtgtattacgtgtacaaatgttggtctcacactacgtggacgttcgacgaagggaccaaggtggaaatcgaaacgacgtggagctagcacgtatcgtgtctcatccttccgctatcgtagaactcaacgttgtacngggacggcggtcgtgggaaccagggccactaatcggtcagctgaacttgatnactgannnnnnnnngnnnnncnnnnnnnnnnnnnnnnnnnn

SEQ ID NO: 47203 - DNA, 499 bp, Homo sapiens
  misc_feature: GYAE6OF01DKP1B.34.6.A06.1.454.CMB.1.raw
  modified_base (98)..(98): a, c, t, g, unknown or other
  misc_feature (98)..(98): n is a, c, g, or t
  modified_base (122)..(122): a, c, t, g, unknown or other
  misc_feature (122)..(122): n is a, c, g, or t
  modified_base (164)..(164): a, c, t, g, unknown or other
  misc_feature (164)..(164): n is a, c, g, or t
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (273)..(273): a, c, t, g, unknown or other
  misc_feature (273)..(273): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (340)..(341): a, c, t, g, unknown or other
  misc_feature (340)..(341): n is a, c, g, or t
  modified_base (345)..(346): a, c, t, g, unknown or other
  misc_feature (345)..(346): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
  modified_base (455)..(455): a, c, t, g, unknown or other
  misc_feature (455)..(455): n is a, c, g, or t
tcagtacacgtgatcacgaccggtgctcgatttagatctactgacagggcccctggcatcccagacaggttcagtggcagtggtctgggacagacttnactctcaccatcaccagactggancctgaagatttgcagtgtattactgtcaactagttgctcacncacgtgacgttcgacaaggccaaggtgaaactcaacgactgnggctgcaacctntacgtcgtccttctactccgttcccgactaagttcctacgaaacttcaccggttntacgtaggacgcgggtactggacaacgggcactagtacgctagctgcangctgacgctgcngtcgcnngacnncngacatcgtangctgacntacncgactngcntnacgtntctnctagntcgncntactctagcacgtgacgtcgtacgngtacgacgtgtacncgtcgtaatcgtacgngttcgtaacgctagtccgtaggttccctaacgttcgtgaccgtc

SEQ ID NO: 47204 - DNA, 481 bp, Homo sapiens
  misc_feature: GYAE6OF01DF3MN.34.6.A06.1.454.CMB.1.raw
  modified_base (272)..(272): a, c, t, g, unknown or other
  misc_feature (272)..(272): n is a, c, g, or t
  modified_base (374)..(374): a, c, t, g, unknown or other
  misc_feature (374)..(374): n is a, c, g, or t
  modified_base (449)..(449): a, c, t, g, unknown or other
  misc_feature (449)..(449): n is a, c, g, or t
  modified_base (452)..(481): a, c, t, g, unknown or other
  misc_feature (452)..(481): n is a, c, g, or t
tcagtacacgtgatcacgaccggtgctcgatttagatctactgacagggccagtcagagtgttaatagcatctacttagcctggtaccagcagaaacctggccagcctcccagacctcctcattaatggtgcatactacacgggcccctggcatcccagacaggttcagtggcagtgggtctgggacagacttcactctcaccatccacagactggacgcctagaagtattttgctagtgttattactgtacaactagttggtctacacacncgtggcggttcgacgaagggaccgtaaggagaaagacaaacgaacgtgtggctgccacctatccgtgttcttctactcccgtttccccgacctactaccgtntaactccgtacgttagtaccgttggaacgggccgggtacgtagggaccgtaacgggtcccgacgagttaaggcancgnnnnnnnnnnnnnnnnnnnnnnnnnnnnnn

SEQ ID NO: 47205 - DNA, 632 bp, Homo sapiens
  misc_feature: GYAE6OF01EIQRB.34.6.A06.1.454.CMB.1.raw
  modified_base (175)..(175): a, c, t, g, unknown or other
  misc_feature (175)..(175): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctcaggggaaagagccaccctntcctgcagggccagtcagagtgttaatagcatctacttagctggtacagcagaaacctggaccagcctaccagactcctcgattaactgtgcatactacagggccctggcatccagacaggttcagttggcaggtaggtctagggacaggacttcactctacaccagtcaaccagactacggacgtccagtaagtattttacgacgtacgtgttaacgttactggtaccaaccgtagttacggtacctacaaccgacgtaacgttcgggacgtttaccggaccgtaacgggaccgtaaagggtacggaaacgtaccgaaaacggaacgttacggtacggacctagtacccgaaccgtagtaccgttcggtaccttataaccgttccgttacccggtaccctaacgtccttacggaacttaccgtaacggtagttaacgtcggaaggtaccccggggg

SEQ ID NO: 47206 - DNA, 817 bp, Homo sapiens
  misc_feature: GYAE6OF01CIJ1L.34.6.A06.1.454.CMB.1.raw
  modified_base (434)..(434): a, c, t, g, unknown or other
  misc_feature (434)..(434): n is a, c, g, or t
tcagtacacgtgatcacgaccggtgctcgatttagatctactgacagggaaccatggaaaccccagcgcagcttctcttcctcctgctactctggctcccagatatcgaccggaagtaaattgtgttgacacagtcctccgaggcctacccttgttcttttcgtacctaccggaagggggaaagaccgccctacccctctcctgcgacgggccagtcgagtagttagttaatcgactacgttacttaccgttacgccgttaggaaccagacaacgaaccgtcgcctacgccctccgacgtacctcctataatttacggtggtacactaacgtaaccgtaccggccgggtaccctgacctaccgtccgaagaccgtaggttccgagggtcgacggtagggttccgggtataacggggactacgttaccccgttanacccttaccgtacccactaccgtaccacgtacgacgtggacctgtagtaagtttcgttacgattaacggttatttagttaccgtagttaaccgtaagttcggttcgtacgtacctaacgaccggttaccgggttaccggggtacccggttaaccgggaaccgtaacggggtaaccggtaaacgggtaaacgtaaacgtaaacccgggtaaacgttaccgggtaggtacgtaccctacggttaacccgtacgtttaaccgttccgtttaccgtttacccgttcccttaacccgttcccctttaccccggtacttacggttaccctaaaggtttaacccgtacggttaccgggttaccgtaacggttcggggaccggggttcggg

SEQ ID NO: 47207 - DNA, 607 bp, Homo sapiens
  misc_feature: GYAE6OF01DSBDE.34.6.A06.1.454.CMB.1.raw
  modified_base (554)..(554): a, c, t, g, unknown or other
  misc_feature (554)..(554): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaagacgccaccctctcctgcagggccagtcagatgttaatgcatctacttagcctggtaccagcagaacctgccagcctccagactcctacattaagtggtgcactccacgacgggccacgtggtactccccagacctggttcaggtcggcaggttcgggtctaggggactagtaacttcacgtctcgacctagtcaagcaacgcctgactagtctaggtaagttattttgacttaagttttacttaactggtacacgtactaacgttaataacgtaacgtcggaccttaccggtatcccgttaccgttcggaccgtaagggccaacgtactagggaacgtaacgttaacgtacgtcggtagtcctggacctactagttacgtcgtttacncgttctccccgttaccctacgtaccgttactagtaaccttccgtaggttaacg

SEQ ID NO: 47208 - DNA, 641 bp, Homo sapiens
  misc_feature: GYAE6OF01BSQWI.34.6.A06.1.454.CMB.1.raw
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (408)..(408): a, c, t, g, unknown or other
  misc_feature (408)..(408): n is a, c, g, or t
  modified_base (521)..(521): a, c, t, g, unknown or other
  misc_feature (521)..(521): n is a, c, g, or t
tcagtacacgtgatcacgaccggtgctcgatttagatctactgacgagggccctggcgatcccagacccactgccactgaacctgtctagggacagacttcactctccaccatccgaccgtagacctggacgccctagaagacttttgccaggtacgtattactgtacaactagttaggtctacactacacggtgggacgttccgggaccgaaagggacctaaggttgaaacttacaaacggactggtaggtctacgcgaccattcgtacgtaccttcgacgttccttacccggctacttcgtacggaactcgaacgttggtaacncggacgccggctagggacctaacgggaccacgaacgttaggcttcnccgngacnccagccgcaggactcacctcggaacggngacttacgcggttacgcgcgaactccgtagacgtaaacgccttaggtaccgaagtccaggttccaacttggggaacctcgggtactacggaggtacgattacgtacgagacgngcgacgtacgtacgacgtacgtacgacgacgactacgacgacgtacgtacgtagtacgtacgacgtacgtacgtacgtaggtcgtcgacgtacgtacgtacgacgtacgacgtcgctacg

SEQ ID NO: 47209 - DNA, 289 bp, Homo sapiens
  misc_feature: GYAE6OF01BRJIS.34.6.A06.1.454.CMB.1.raw
  modified_base (282)..(289): a, c, t, g, unknown or other
  misc_feature (282)..(289): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtgaaatcaaacgactgtgctgcacatctgtcttcatcttcccgcatctgaatcacgtgtactgagcgggctggcaaggcgcatagnnnnnnnn

SEQ ID NO: 47210 - DNA, 300 bp, Homo sapiens
  misc_feature: GYAE6OF01DTKPI.34.6.A06.1.454.CMB.1.raw
  modified_base (290)..(300): a, c, t, g, unknown or other
  misc_feature (290)..(300): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagttgtattactgtcaactagttgtctcacacacgtggacgttcggccaagggaccaaggtaggaaatcaaacgactgtggctgcacatctgtcttcactcttcccgccatctagaactcacgttgtactgagcggctggcaaggcgcatagnnnnnnnnnnn

SEQ ID NO: 47211 - DNA, 342 bp, Homo sapiens
  misc_feature: GYAE6OF01APL6K.34.6.A06.1.454.CMB.1.raw
  modified_base (265)..(265): a, c, t, g, unknown or other
  misc_feature (265)..(265): n is a, c, g, or t
  modified_base (332)..(342): a, c, t, g, unknown or other
  misc_feature (332)..(342): n is a, c, g, or t
tcagtacacgtgatcacgaccggtgctcgatttagatctactgacagggcccctggcatcccagacaggttcagtggcagtgggtctgggacagacttcactctcaccatcaccagactggagcctagaagtattttgctagtgttattactgtacaacgtagttgtctcacacacggtcggtacggttcggaccgaacgggaccgaaggtaggaaactacaaacgaacgtgtgctcgcacatcttgcttttttttttttttacnccttcccgcctactctagaatcacgttgtaactgaggcggtcgtggacgaacggcgtacagtagagnnnnnnnnnnn

SEQ ID NO: 47212 - DNA, 298 bp, Homo sapiens
  misc_feature: GYAE6OF01EN28Q.34.6.A06.1.454.CMB.1.raw
  modified_base (286)..(287): a, c, t, g, unknown or other
  misc_feature (286)..(287): n is a, c, g, or t
  modified_base (289)..(298): a, c, t, g, unknown or other
  misc_feature (289)..(298): n is a, c, g, or t
tcagtacacgtgatcacgaccggtgctcgatttagatctactgacagggcccctggcatccccagaccaggttcagtggcagtgggtctggggacagacttcgactctcaccatcaccagactggagcctgaagattttgcagtgtattactgtcaacagttggtctcacacacgtggacgttcggccaagggaccaaggtggaaatcaaacgactgtggctgcaccatctagtcttcatctccgcatctgaatcagtgactgagcggctggccaaggcgcatagnngnnnnnnnnnn

SEQ ID NO: 47213 - DNA, 294 bp, Homo sapiens
  misc_feature: GYAE6OF01BL6JR.34.6.A06.1.454.CMB.1.raw
  modified_base (286)..(294): a, c, t, g, unknown or other
  misc_feature (286)..(294): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttgtctcacacacgtggacgttcggaccaagggaccaaggtggaaatcaaatgaactgtggctgcaccatctgtcttctctcccgcatctgaatcacgtgtactgacgcgggctggcaaggcgacatagnnnnnnnnn

SEQ ID NO: 47214 - DNA, 463 bp, Homo sapiens
  misc_feature: GYAE6OF01AFR4F.34.6.A06.1.454.CMB.1.raw
  modified_base (137)..(137): a, c, t, g, unknown or other
  misc_feature (137)..(137): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (296)..(297): a, c, t, g, unknown or other
  misc_feature (296)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (406)..(406): a, c, t, g, unknown or other
  misc_feature (406)..(406): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (452)..(452): a, c, t, g, unknown or other
  misc_feature (452)..(452): n is a, c, g, or t
  modified_base (457)..(461): a, c, t, g, unknown or other
  misc_feature (457)..(461): n is a, c, g, or t
  modified_base (463)..(463): a, c, t, g, unknown or other
  misc_feature (463)..(463): n is a, c, g, or t
tcagtacacgtgatcacgaccggtgctcgatttagatctactgacagggcccctggcatcccagaccaggttcagtggcaggtgggtcctgggacagacttcgactcgtcaccatcaccagactggagcctggaagntttcgctagtgtattactgtacaacagttgactcacacacgtggacgttcggccaagggaccaaggtgaaactcaaacgactggtcggctgacaccgatctgtccttcatcttcccgctatctgaatcacgtnacngagcggntggcaaggcncaatgnngnangacnantnagncngcngctgcagccctagngctctgaacncgagccnttaagcttacngagnacncttaagcgcaggactgngtangtcgattccggatccgagnccagctcggattcggccagtgacgtgntggactgngatccgtaccnggtcnnnnngn

SEQ ID NO: 47215 - DNA, 297 bp, Homo sapiens
  misc_feature: GYAE6OF01CY6HB.34.6.A06.1.454.CMB.1.raw
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (287)..(297): a, c, t, g, unknown or other
  misc_feature (287)..(297): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagatttgcagtgtattactgtcaaacagttggtctcacacacgtggacgttcggccaaagggaccaaggtggaaaatcaaaacgactgtggctgcaccatctgtcttcatctaccgccatctgaatcaagtgtactgagcggntggcaaggcncatagnnnnnnnnnnn

SEQ ID NO: 47216 - DNA, 486 bp, Homo sapiens
  misc_feature: GYAE6OF01A58Z7.34.6.A06.1.454.CMB.1.raw
  modified_base (214)..(214): a, c, t, g, unknown or other
  misc_feature (214)..(214): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
  modified_base (469)..(486): a, c, t, g, unknown or other
  misc_feature (469)..(486): n is a, c, g, or t
tcagtacacgtgatcacgaccggtgctcgatttagatctactgacagggccagtcagagtgttaatagcatctacttagcctggtaccagcagaaacctggccagcctcccagacctcctcattaatggtgcatactacacgggccccctggccatccccagacaggttcagtggcacggtgggtctagggacaggaccttcactcctcaccgntccaccagactggacgcctagaaagtctttgctaggttgtaattacgtgttaccaaacttggttcggtactcaacgtaccacggtggttaccggttcggaccaagggaacccgtaggtacggaaactaccaaacggtaactggtcggacttacgcctaccgaattccgtagtcttctaacgtcccttccgtaccatccgtanactcgagttcgtacnggacgcggccttaggcgtaacggctanagtcgctgncnnnnnnnnnnnnnnnnnn

SEQ ID NO: 47217 - DNA, 417 bp, Homo sapiens
  misc_feature: GYAE6OF01AL5MX.34.6.A06.1.454.CMB.1.raw
  modified_base (99)..(99): a, c, t, g, unknown or other
  misc_feature (99)..(99): n is a, c, g, or t
  modified_base (125)..(125): a, c, t, g, unknown or other
  misc_feature (125)..(125): n is a, c, g, or t
  modified_base (129)..(129): a, c, t, g, unknown or other
  misc_feature (129)..(129): n is a, c, g, or t
  modified_base (169)..(169): a, c, t, g, unknown or other
  misc_feature (169)..(169): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (389)..(417): a, c, t, g, unknown or other
  misc_feature (389)..(417): n is a, c, g, or t
tcagtacacgtgatcacgaccggtgctcgatttagatctactgacagggcccctggcatcccagacaggttcagtggcagtgggtctgggacagacttnacctctcaccatcaccagacctggancctnaagattttgcagtgtacttactgtcaactgttggtctcanacgtacgtggacgttccggaccgtacgggaccgtaacgggtgaaacgttaccgaaaacggtaactaggttcggacttggacccaactacttacgtcgttccttaccaaccttccttacccccgtcctactagttacgaaacttccctaacggttactagtttaccggacggtcgggtacgtcgcggaaaggccgntagagcagngcaaggcttacatcannnnnnnnnnnnnnnnnnnnnnnnnnnnn

SEQ ID NO: 47218 - DNA, 680 bp, Homo sapiens
  misc_feature: GYAE6OF01CPMOM.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaagacgccaccctctcctgcgagggccagtcagagtgttaatagcatctacttagccttggtaccagcaagaacctggccagccctccagtacctcctactattaagtggtcgactaactactacgacgggtcccctgggcctacgtccccagaacgtacggttcgaggtcggcgtaggtgggtcgtgggacgacgtacttccgactcctcaccactacaaccgacgacgtcggacgtaccgtgtaagtacttttggactagttacgttatttacgtacgttaccaacgttaggttacggtacctacgtaacacgtaggtacggtaccggttaccggaccggaaacgggaccgaagggtacggaaacttaccgaaacggtacgtcggtacggacttacggacgtacctacgttcgttacgttaccgttacgtaccttccccgtacccgtaccttaccttaccgtaacgtaccgtaccgttacggttaccgttaacggttgggtacgggtacccggg

SEQ ID NO: 47219 - DNA, 321 bp, Homo sapiens
  misc_feature: GYAE6OF01ATBK5.34.6.A06.1.454.CMB.1.raw
  modified_base (298)..(321): a, c, t, g, unknown or other
  misc_feature (298)..(321): n is a, c, g, or t
tcagtacacgtgatcacgaccggtgctcgatttagatctactgacagggcccctggcatcccagacaggttcagtggcagtgggtctgggacagacttaactctcaccatcaccagactggagcctagaagtattttgcagtgtattactgtacaacagttggtctcacacagtggacgttcggaccgaagggaccaaggtagaaatcaaacgaacgtgtggctgcacatctgtcttcattcctccgcatctagaactcacgttgtactgacggcgggctgggacaaggcgctagagnnnnnnnnnnnnnnnnnnnnnnnn

SEQ ID NO: 47220 - DNA, 797 bp, Homo sapiens
  misc_feature: GYAE6OF01EB6ED.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaagacgccaccctctcctgcgagggccagtcagtagtgttaatagcatctacttagcctggtaccagacagaacctggccagccctccgagtacctcctactaattaagtcggtcgactaactacctacgaccgggtccccctggcctactaccccgaaggacgtacgggttcgaggtggacgtagggttcgggtcgtagggaacaggtaccttcacctcctaccgaccactacaaccgtacgtacgtacgggacgtccgtaagggtaacgtttagttttacggaccgttaaggttacgttaacgtttaccgttacggttaacccgtaaacggttacgggttttaccgggtaccttaaccgtaaccgtaacccggttacggggttacgggttaacccgggtttacccgggaacccggtaaacggggtaaaccggtaaagggtaacggtaaacgttaacccggaaaaccgtaacggttcgggtacggtaccgtacgtaacccgtaccgttacgttaccttacggtttacccttacccgttaccgttaccccgttaccccccgactttacgttacccgtaagtaacccgttccgtaacgggtttacctaaccggtcggggaacgggtacccgggg

SEQ ID NO: 47221 - DNA, 705 bp, Homo sapiens
  misc_feature: GYAE6OF01AQZNA.34.6.A06.1.454.CMB.1.raw
  modified_base (175)..(175): a, c, t, g, unknown or other
  misc_feature (175)..(175): n is a, c, g, or t
  modified_base (522)..(522): a, c, t, g, unknown or other
  misc_feature (522)..(522): n is a, c, g, or t
  modified_base (623)..(623): a, c, t, g, unknown or other
  misc_feature (623)..(623): n is a, c, g, or t
tcagtacacgtgatcacgaccggtgctcgatttagatctactgacagggaaccatggaaaccccagcgcagcttctcttcctcctgctactctggctcccagatatcaccggagtaaattgtgttgacacagtcctccgaggccacccttgttctttgtcctccgaaggggaaancgcccacctctcctggcagggccagtcgagtagttgttaatagctattcttacgttacgccgttacggtaccagtaccgaacgaaacccgtcggacccacgtccctaccccgaagtaccttccgtactatttaagtacggtcgactacgttaaccgtacggacccggtcccttacggacctaccgtacccgaaggtaccgtacggttacgagggttcggacggtagggtcgggttcgtagggactacggttccttaccgtacccgtacgtaccaccgtattaccgaacgttccgacgtacggtcgggtacctacgttaggttaacgtttgtttcggactttaggttnttaacgttactacgtactacgttggttcgcctacgacgtcgtacggtcggtacgtacggaaccggaggtacgaaggtacgaactacgaacgtgtcgtacgngtaccacgactcgttatcccgttgacttccgttcccaccggtctacttcgtactctacccggttatccgtaggtcggaacgg

SEQ ID NO: 47222 - DNA, 917 bp, Homo sapiens
  misc_feature: GYAE6OF01BBRYK.34.6.A06.1.454.CMB.1.raw
  modified_base (228)..(228): a, c, t, g, unknown or other
  misc_feature (228)..(228): n is a, c, g, or t
tcagtacacgtgatcacgaccggtgctcgatttagatctactgacagggaaccatggaaaccccagcgcagcttctcttcctcctgctactctggcctccagatatcaccggagaattgtgttagacacagtctccaggccacccttggttcttttgtccgtccgaaggggaaagacgcccacccctctccgagccgagggccctagtacgaagtagttagtttaagngctacttaccttaacgttacggcccgttaggtaaccaggaaccgtaaaccggaaacccgttcgggacccctacggtaccccctacccgtacggtaaccccttacccttaactaagttttaacgggtcgggttacaccgttaaactttacccgtaaccgggaccccggggtcccccttacgggacctaacccggttaccccggaggttaacccgttcgggttaacccgtaggtcgggggtaccttacggggtccgggggttacgttaccggggaacccaacggttttacccctcgtacccggtaccgttaccacccgtaagtaacccccgtaagtaccgtaccggtcggggaaccttcggttaaaggttaacgttttacgtttacgggacttacggtttacggtttaacgtttaccgttaacgtaccgttaacggttacggtttacggttaccgttaccgtaaccgtacgttaccgggtacggttaccggtaaccggtacccgaacgggtaaccggtaaaggttaccgaaacggtaccgtaaacggttacggacggttaccgacgtacgtaaccctccggtaacttcgttacgttccgttacccgtaccgttacccgttacccggtaccttacgttaccgtaacgttaaccgtacgtacgttaaccgtacggtacggtccgggtaccggg

SEQ ID NO: 47223 - DNA, 801 bp, Homo sapiens
  misc_feature: GYAE6OF01B90B3.34.6.A06.1.454.CMB.1.raw
  modified_base (260)..(260): a, c, t, g, unknown or other
  misc_feature (260)..(260): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcacccttgtcttttgtctccgaaggggaaagcgcccaccctctcctgcagggccagtcagtagttgttaatgctattctacttacgccttggtaccagaccaacgtaaacccgtggacccncgtccctaccacgtacctcctactaatttaagtggtacgtacctaacgttaccgtaccggaccgggtcccccgtggaccctaccgtaccccgaaggtaccgtacgggtttaccagggttcgggaccgtagggttcggggtacgtacggggtaactacggttacctttccgaaccgttcctaacccgacctacgtacccaacccgaaggtaccgtacgggaccgtaccgtaaggtaacgtttagtttacgacgttaaggttacggtttactttaccggttagttaaccgtaacggttcggtttcgtacttaccgtacgtaaccggtacggttaccgggttaaccggttacccggaaccggtaacggggtaaaccgtaagggtaaacggtaaaccgtaacgtaaaaccggtaaccggtttgggtaccggacttacggacctaaccgttcgttacgttcgttaccttacgtcctttacccgttaccccacttagtccgttaacgacgttcccggtacggtttacgtacggtcggccgggtcggg

SEQ ID NO: 47224 - DNA, 304 bp, Homo sapiens
  misc_feature: GYAE6OF01BX6DU.34.6.A06.1.454.CMB.1.raw
  modified_base (123)..(123): a, c, t, g, unknown or other
  misc_feature (123)..(123): n is a, c, g, or t
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (294)..(296): a, c, t, g, unknown or other
  misc_feature (294)..(296): n is a, c, g, or t
  modified_base (298)..(304): a, c, t, g, unknown or other
  misc_feature (298)..(304): n is a, c, g, or t
tcagtacacgtgatcacgaccggtgctcgatttagatctactgacagggcccctggcatcccagacaggttcagtggcagtgggtctgggacagacttcactctcaccatcaccagactggancctgaagtattttgctagtgtattactgtcaactagttggtctcacacacgtggacgttcggaccgaagggaccaaggtggaaatacaaacgactgtgctcgcacatctgtcttcactcctccgcatcanactcgagtntacgnggacggcggctaggcaggcacagtagnnncnnnnnnn

SEQ ID NO: 47225 - DNA, 731 bp, Homo sapiens
  misc_feature: GYAE6OF01CM44X.34.6.A06.1.454.CMB.1.raw
  modified_base (313)..(313): a, c, t, g, unknown or other
  misc_feature (313)..(313): n is a, c, g, or t
  modified_base (466)..(466): a, c, t, g, unknown or other
  misc_feature (466)..(466): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcacccttgttctttgtctccgaaggggaaagacgccaccctcctccgtcgacgacgggccagtcagtagtagttaatagctattcttacttagcccttaggtaccaggaccaacgaaacccgtggaccctaccgaccctcccacgtaccttccctactaatttaacgtcgggtntacaactaccgtacgaccgggcccctaggccacctcccgaagtacgtacggttacagggtcggccgtaggttcgggtacgtggggaactacggtacttaccactccgtacaccctatacccaaccgtagcgttacggctacgtagaaacgttntttcgagttacgttagtacttacgtgtactacgtagttgtcacgtacacgtacgtacggtacgttacggaccggtaacgggaaccgtaaagggtacggtaaactaccggtaaagtaccggtaggtacggacgttacgaccgtacccttaatccggtttacgttaccttacgttacccgttccccgtttaccccgacttaccgtaccttaaccgggttacttaccggttaccgtacgtttaaccggtcggtaaccgggggtccggg

SEQ ID NO: 47226 - DNA, 501 bp, Homo sapiens
  misc_feature: GYAE6OF01DXCMG.34.6.A06.1.454.CMB.1.raw
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (480)..(501): a, c, t, g, unknown or other
  misc_feature (480)..(501): n is a, c, g, or t
tcagtacacgtgatcacgaccggtgctcgatttagatctactgacagggccagtcagagtgttaatagcatctacttagcctggtaccagcaagaaacctggccagccctcccagacctcctcattaatggtgcatactacgacgggcccctggccatcccagacgaggttcagtggcgtaggtgggtctgggacacgtacttcactctcaccatccacagacgtaggacncctaggaattatttgactagtttattacngtacagctaagtaataacgtacgtcggccggtaccggggtcgtacggaccgaaggaccgtaaggtacgtaacttaacgaacggtagtggtaggcctcgcaaccgtcttcggttacgtccttactaccggttccttaccccgacttatctaggaacttcgtaacgttacggtaccgtgggacggccggtacggtagaccgaacgggcaacgtnaaggnacnnnnnnnnnnnnnnnnnnnnnn

SEQ ID NO: 47227 - DNA, 662 bp, Homo sapiens
  misc_feature: GYAE6OF01D48HI.34.6.A06.1.454.CMB.1.raw
  modified_base (168)..(168): a, c, t, g, unknown or other
  misc_feature (168)..(168): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (431)..(431): a, c, t, g, unknown or other
  misc_feature (431)..(431): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgagggggaaangccaccctctcctgcagggccagtcagagtgttaactagcatctacttagcctggtaccagcagaacctggaccagcctccagacctcctacatttaanggtanctatacctacgacgggtcccctaggctactccccaaggacgtacggttccaggttcggactagggttgggttccgtagggacaggtaccttactaccgtacgtccaaccactccaacacggtacgtagggacgtccctaggaaacggttattttacggnttaacgtaggttacttaacgtcgtactaagtagttgtctacaactcgtaggtcgtacgttaccgacgtaagggaccgaagggacgaactaccgaaaggtaacgtgggtacgtacgtaccggacaccggtactcgttacggtacctttaccgtacggttccccgttcccggtaacctcgtttacgtagtaaacctcgtaaccggttagtaacccgttggaacgggtcccggg

SEQ ID NO: 47228 - DNA, 718 bp, Homo sapiens
  misc_feature: GYAE6OF01E2STJ.34.6.A06.1.454.CMB.1.raw
  modified_base (129)..(129): a, c, t, g, unknown or other
  misc_feature (129)..(129): n is a, c, g, or t
  modified_base (171)..(171): a, c, t, g, unknown or other
  misc_feature (171)..(171): n is a, c, g, or t
  modified_base (216)..(216): a, c, t, g, unknown or other
  misc_feature (216)..(216): n is a, c, g, or t
  modified_base (415)..(415): a, c, t, g, unknown or other
  misc_feature (415)..(415): n is a, c, g, or t
  modified_base (616)..(616): a, c, t, g, unknown or other
  misc_feature (616)..(616): n is a, c, g, or t
  modified_base (622)..(622): a, c, t, g, unknown or other
  misc_feature (622)..(622): n is a, c, g, or t
  modified_base (631)..(631): a, c, t, g, unknown or other
  misc_feature (631)..(631): n is a, c, g, or t
  modified_base (684)..(684): a, c, t, g, unknown or other
  misc_feature (684)..(684): n is a, c, g, or t
  modified_base (704)..(704): a, c, t, g, unknown or other
  misc_feature (704)..(704): n is a, c, g, or t
tcagtacacgtgatcacgaccggtgctcgatttagatctactgacagggaaccatggaaaccccagcgcagcttctcttcctcctgctactctggcctcccagatatcacggagaaattgtgttgacanagttctccaggccacctgttctttcgtctccgaaggggaaanacgcccaccctctcctgacgacgggccagtcagtagtagttaaancgacatcttacgttacgccgttacggaccacgtcaaacgaacctcggacctacgaccctaccagtacctccacttaattacgtggtacactataaccgtacggaccgggtcccctggactaccgtccccgaaggaccgtagttcgaaggtgacgtagggtcggtcgtaggactacgtaccttcactcgtaaccacctanaccgaactagtccggtcggaacttacggtacggtaaagttcgtttcgagtacgttaacgttaactttacggtactaaccgttaaggtcgtttaccggttacctaaccgaacggtaccggtttaacgggtcgggttaaacccggttaccgggaaccggtaaacggggtaaccgtaagggaaccgttaaacacgggttaaacnccggtntaccgggtnacggtaacctacgtacttcgtacgttctactaccgtccctaacgctaacgttnaacgtacgtctaacggttanacgtggcggtacgg

SEQ ID NO: 47229 - DNA, 772 bp, Homo sapiens
  misc_feature: GYAE6OF01D8N55.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaagacgccaccctctcctgcagggtcagtcagtcgttactaacaccgtacttcttcgcctcggtaccagcagacgacctcggccagggcctcccgaggcctcctctattcgtttggtcgccgtcccaaccgacgggccacgtcggacctacgtaccccgaagtaccgtacggggtttaccgagggtcgggtaccgtaaggggttcgggggttaccgttacggggaaacccgtaacggttaacccgttttacccaaaccgttccccttaaccgaacccctaattccgaacgtaaccgtacgtaaccggttttacgggaaccggtacccgtttaaaggtaaacggtttacgttttagaaccgttaaaggtttaactttaacgtttaaccttcgttaacgacgtaactaaacgttagtaccgtaacgtaccgtacgtacgttcgggtacgggtcccggttaccgggacgtaacgggaacgtaagggtaaacgtaacgaacgtaaaacgtcgtaggtcgacgtcgtacaaccgtacgtcgttcgttacctacgtacttacccgtccgtaccgtacttcgtaacgtaacgttccctaaggttccgtagtccggg

SEQ ID NO: 47230 - DNA, 398 bp, Homo sapiens
  misc_feature: GYAE6OF01ENQJL.34.6.A06.1.454.CMB.1.raw
  modified_base (267)..(267): a, c, t, g, unknown or other
  misc_feature (267)..(267): n is a, c, g, or t
  modified_base (371)..(371): a, c, t, g, unknown or other
  misc_feature (371)..(371): n is a, c, g, or t
  modified_base (374)..(375): a, c, t, g, unknown or other
  misc_feature (374)..(375): n is a, c, g, or t
  modified_base (377)..(398): a, c, t, g, unknown or other
  misc_feature (377)..(398): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagtacttttgcagttgtattactgtacaaactgttcgtctcacacgaggtggacgttccggaccgaagggaccgaaggtaggaaaataccgaaaacgacttcggtaggtcctgacccaacctgttcctggttaccttcncgttcccgttccccgacctaagttcctaagtacttacccgaacggtttcgttaacgttcgggaacgggtccggggtctacggacggaacgggtcaaacgtggancgnnannnnnnnnnnnnnnnnnnnnnn

SEQ ID NO: 47231 - DNA, 721 bp, Homo sapiens
  misc_feature: GYAE6OF01CWHKP.34.6.A06.1.454.CMB.1.raw
  modified_base (128)..(128): a, c, t, g, unknown or other
  misc_feature (128)..(128): n is a, c, g, or t
  modified_base (150)..(150): a, c, t, g, unknown or other
  misc_feature (150)..(150): n is a, c, g, or t
  modified_base (160)..(160): a, c, t, g, unknown or other
  misc_feature (160)..(160): n is a, c, g, or t
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (200)..(200): a, c, t, g, unknown or other
  misc_feature (200)..(200): n is a, c, g, or t
tcagtacacgtgatcacgaccggtgctcgatttagatctactgacagggaaccatggaaaccccagcgcagcttctcttcctcctgctactctggcctccagatatcacggaagtaattgtgtgacanagtctcagcacctgtcttgtcncgaagggaanctccacctntcngcgaggtccagtcagtagttacgttaanagctaattccgtaagttacgcccgttaggaaccaggacaaacggtaaaccgtcggacccaacggcccccttaccggaagtaacctttcccctaagttaaacttaaggttgggtaaccaccttaacgttaaaccgtaccggaaccgggtccccctaggaaccgtaccttaaccccgaaggttaaccgaaggtttcgaggttcggacgttagggtccggttacgagggacctaaagttaccttcgaaccttccaaaccgacttaaactcccgaaccgttaggaacgttccggaagtccgttaaagacgtttaagtttgaccgtttaagtttaccgttagtaacgttgaccgagacagactatacgacgtacgtaccgacgttactagttacggaacgtagggaacctagagtacggaagaacgtaacgaaacgtacgttagacggtacgtaccgacgacctacgtacgttactccttactaccgttccacccgtacttacgactaagtactagtacgtaacgg

SEQ ID NO: 47232 - DNA, 342 bp, Homo sapiens
  misc_feature: GYAE6OF01DZVSC.34.6.A06.1.454.CMB.1.raw
  modified_base (300)..(301): a, c, t, g, unknown or other
  misc_feature (300)..(301): n is a, c, g, or t
  modified_base (303)..(342): a, c, t, g, unknown or other
  misc_feature (303)..(342): n is a, c, g, or t
tcagtacacgtgatcacgaccggtgctcgatttagatctactgacagggcccctggcatcccagaccaggttcatggcagtgggtctggggacagacttcgacctctcaccatccaccagactggagcctgaagtacttttgcagttgtattacctgtacaactagttgtctcacacacgtgacgttcgccaaggccaagtgaaatcaaacgactgtggactgcaccatctgtcttcatccttcccgccatctgaatcgacgtgtacctggacgtcggcctggaccaaggcactataggnngnnnnnnnnnnnnnnnnnnnnnnnnnnnnnnnnnnnnnnnn

SEQ ID NO: 47233 - DNA, 882 bp, Homo sapiens
  misc_feature: GYAE6OF01EJIJ9.34.6.A06.1.454.CMB.1.raw
tcagtacacgtgatcacgaccggtgctcgatttagatctactgacagggaaccatggaaaccccagcgcagcttctcttcctcctgctactctggctcccagatatcgaccggagtaattgtgtgacacgagtcctccgaggcctacccgttgttcttttgtccgtccgaaggggaaagtacgcccacccgttctccgtgcgagggcctagtcaggtagttagttaagtacgctattcgttaacgttacgccgttaggtaaccagaccaaaccgtaaccgtcggacccacgtaccctcccgagtaccctacctactaagttaacgttcggtactacgtaacttaaccgtaacggtacccggtccccgttacggaccctaaccgtaccccgaacggtaaccggttaacggtttaccggaacgggttcggaccggtacgggggtttacgggtccggttaacgggaaaccgttaccgttacccttaccgtacccgttccgtaaacccacctaacctacccgaaccgacggtacggaacggtcggtaacccgttaggtaaccgtttagtttacgacgtttaggtttactttaacgttacgttacgtaaccgttaacgttacgggttacgtacctacgtacctaaccgggtaccgggttacgggtacccggttaaccggtaaccggtaaaacccgggtacgttaaacggggtaacggtaaaaccgtaaccggtaaacggttaccggtacggggtacctacggtacaaccgtacccgttctacccgttagttcccgttaacctccgtttccccgtaacccgttcctccggtttaataacccgttcggtaaccgttaccggttacgtccggtaagggccggtaccgggg

SEQ ID NO: 47234 - DNA, 461 bp, Homo sapiens
  misc_feature: GYAE6OF01DJBVL.34.6.A06.1.454.CMB.1.raw
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
  modified_base (416)..(416): a, c, t, g, unknown or other
  misc_feature (416)..(416): n is a, c, g, or t
  modified_base (418)..(461): a, c, t, g, unknown or other
  misc_feature (418)..(461): n is a, c, g, or t
tcagtacacgtgatcacgaccggtgctcgatttagatctactgacagggccagtcagagtgttaatagcatctacttagcctggtaccagcaagaaacctggccagcctccccagacctcctcattaatggtgcatactacagggccccctggcatcccagacaggttcagtggcagtgggtctgggacagacttcactctcaccatcaccagactggagcctgtaagacttttgcagtgtattactgtcaaactagttggctcactacacgttggaccgttcggaccaaggggacctaaggtaggaaaattcaaaacgaactggtggactgacaccatcgtgtcttnaactccttccgctagtcngtaatcaactgtactgacggtcgggctgggactaaaggccgagagttagngnnnnnnnnnnnnnnnnnnnnnnnnnnnnnnnnnnnnnnnnnnnn

SEQ ID NO: 47235 - DNA, 473 bp, Homo sapiens
  misc_feature: GYAE6OF01A4OWB.34.6.A06.1.454.CMB.1.raw
  modified_base (213)..(213): a, c, t, g, unknown or other
  misc_feature (213)..(213): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (440)..(473): a, c, t, g, unknown or other
  misc_feature (440)..(473): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtgcagtgggtctgggacagcttcactctcaccatcacagctggacncctagagtatttgctagtgtattactgtcaactagttcgtcctacaactaccgacgtcggaccggttccggaccaagggggacctaagggtacgaaaactaccgaaaacgtagttggcgtacgtgcccgtactagttctacgtccttcaccttccctcccgctagtcctagactcacgtcgtacgnggcgtacggntacggacgacggtcgtacagtacgcgnancnnnnnnnnnnnnnnnnnnnnnnnnnnnnnnnnnn

SEQ ID NO: 47236 - DNA, 748 bp, Homo sapiens
  misc_feature: GYAE6OF01CS1NQ.34.6.A06.1.454.CMB.1.raw
  modified_base (124)..(124): a, c, t, g, unknown or other
  misc_feature (124)..(124): n is a, c, g, or t
  modified_base (175)..(175): a, c, t, g, unknown or other
  misc_feature (175)..(175): n is a, c, g, or t
  modified_base (722)..(722): a, c, t, g, unknown or other
  misc_feature (722)..(722): n is a, c, g, or t
tcagtacacgtgatcacgaccggtgctcgatttagatctactgacagggccccctggcatcccagacccactgccactgaacctgtctgggatgccaggggccctgtagtatgccactattaanggaggagctgctcagtaggaccagaggacatacgaacccagcgcagtcttntccttcctcctgctacgtctcggcctaccgagtatactcgaaccggtaagtaatttcgtagttacgaactacgtacgtcctcccacgccccttaccgttgttctttccgcgtaccggaggacgacgaccgtacccgtaccctcgttaccggcgggccccgggtcaacggttcgtaaacggtagttaacgtttaacggtccgttaaccgtttaccgttacggtttaaccgtccgttaacggtactcgaacggtacgtaaacgtacccggtcgaccgtacgggccccgacccgtacggtcctacctacctattaccctaagtacgtccgtaccagtaccgacggacggtcccgtcggtcggtaccctaccggagttaacgttacggtacgtaacgggtcgggtaccgtaggggttcgggtacggtccgggtacgtacgtcctaaccgtcctacaccgtactcacgacgacgtacggtaccgtacggtcgtaccgttaagtacgggttttattaccgggatttaaacggtttgttaaacttttaacgggntttaaaccggcggtagttaaccccgg

SEQ ID NO: 47237 - DNA, 591 bp, Homo sapiens
  misc_feature: GYAE6OF01E18RV.34.6.A06.1.454.CMB.1.raw
  modified_base (166)..(166): a, c, t, g, unknown or other
  misc_feature (166)..(166): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaanagccaccctctcctgcagggccagtcagagtgttaatagcatctacttagcctggtaccagcagaaacctggccagccctcccagacctcctacattaatggtgcatacctacgacgggccccctggccactccccaggaccaggttcagtcggcaggtgggtctgggacagtacttcactctccaccatccaccagacgtggacgtcctagaagttatttgctagttgttatactgtacaagtgttggtctacacacgtacgtggtaccggttcggaccgaacgggaccgtaaggtagaaactacgaaacgtaacgtgggtacggtactcgaccaccgtacttcgtcgttccttactaccgttcccttaccccgacctacttcctagtaacttccgtacggttagtacgttggacggtccgggg

SEQ ID NO: 47238 - DNA, 288 bp, Homo sapiens
  misc_feature: GYAE6OF01ET8RP.34.6.A06.1.454.CMB.1.raw
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (278)..(288): a, c, t, g, unknown or other
  misc_feature (278)..(288): n is a, c, g, or t
tcagtacacgtgatcacgaccggtgctcgatttagatctactgacagggccctggcatcccagacaggttcagtggcagtgggtctgggacagacttcactctcaccatcaccagactggagcctgaagattttgcagttgtattactgtcaacagttggtctcacacacgtggacgttcggcaagggccaaggtgaaatcgaaacgactgtggctgcaccatctgtctcatctccgcatctgaactcacgtgtactgagcggctggcaggcnanagnnnnnnnnnnn

SEQ ID NO: 47239 - DNA, 743 bp, Homo sapiens
  misc_feature: GYAE6OF01D6WQI.34.6.A06.1.454.CMB.1.raw
  modified_base (233)..(233): a, c, t, g, unknown or other
  misc_feature (233)..(233): n is a, c, g, or t
  modified_base (481)..(481): a, c, t, g, unknown or other
  misc_feature (481)..(481): n is a, c, g, or t
  modified_base (636)..(636): a, c, t, g, unknown or other
  misc_feature (636)..(636): n is a, c, g, or t
tcagtacacgtgatcacgaccggtgctcgatttagatctactgacagggaaccatggaaaccccagcgcagcttctcttcctcctgctactctggcctccagatatcgaccggaagtaattgtgttacgacacagtctccgaggccacccgttgttcttttgtacctaccggaaggggggtaaagacgccctacccttctccgtgcgacgggccagtcgagtagttagttaancgactattcttacttacgccttaggtaccagacctaacgaaccgtcggaccacgtacccaccacgaccttcctacgtaattagtcgggtacactaacttacacggtaccggccctggacacgtaccgagtacggtacggttcgaggtacggacgtgggttcggggtcgtaggggtaaccacgtaccttacaccgttacctaccgactactacaccgaggtcgttagggactaccggtagaacgttttntttacgggactttaaggtttcgttaagttaccgttaacgtaacgtaaccgttaggttccgtaacctaacgtaacgtacgtacgggttacggttaccgggtacggaacggtaaccgggtaacgtaagggtacgtaaacgacgtaacgaggttcggngtacgttcacgtactacgtcttacgttccgttaccgtaccgttacccgtctaccgttctacgtacgttaactcgggtaacgtaggttacggtccggtggtaccgggg

SEQ ID NO: 47240 - DNA, 426 bp, Homo sapiens
  misc_feature: GYAE6OF01EBOV4.34.6.A06.1.454.CMB.1.raw
  modified_base (126)..(126): a, c, t, g, unknown or other
  misc_feature (126)..(126): n is a, c, g, or t
  modified_base (386)..(386): a, c, t, g, unknown or other
  misc_feature (386)..(386): n is a, c, g, or t
  modified_base (390)..(391): a, c, t, g, unknown or other
  misc_feature (390)..(391): n is a, c, g, or t
  modified_base (393)..(426): a, c, t, g, unknown or other
  misc_feature (393)..(426): n is a, c, g, or t
tcagtacacgtgatcacgaccggtgctcgatttagatctactgacagggcccctggcatcccagacaggttcagtggcaggtgggtctgggacagtacttcactctcaccatccaccagactggancctagaagtattttgactagtgttattacgtgttaccaaacgttaggttcggtactacaacacgtacggttcggtaccgttccggaacgaacgggaaccgtaaaggtagaaaactaccgaaaacgtacgtaggtcggtactacgtaacctattcgtagtttcttctacgttccttacccgctaatcgtataaacgtccgtaacgttcggtaactcgggacggtccggggatacggggaagaacgggtcaacggtaatcgncgannannnnnnnnnnnnnnnnnnnnnnnnnnnnnnnnnn

SEQ ID NO: 47241 - DNA, 674 bp, Homo sapiens
  misc_feature: GYAE6OF01AEW8N.34.6.A06.1.454.CMB.1.raw
  modified_base (115)..(115): a, c, t, g, unknown or other
  misc_feature (115)..(115): n is a, c, g, or t
  modified_base (170)..(170): a, c, t, g, unknown or other
  misc_feature (170)..(170): n is a, c, g, or t
  modified_base (180)..(180): a, c, t, g, unknown or other
  misc_feature (180)..(180): n is a, c, g, or t
  modified_base (595)..(595): a, c, t, g, unknown or other
  misc_feature (595)..(595): n is a, c, g, or t
  modified_base (624)..(624): a, c, t, g, unknown or other
  misc_feature (624)..(624): n is a, c, g, or t
tcagtacacgtgatcacgaccggtgctcgatttagatctactgacagggaaccatggaaaccccagcgcagcttctcttcctcctgctactctggcctcccagatatcaccgganaaatttgtgttgacacagtctccaggcaccctgttctttgtctccgaggggaaancgccaccctntcctgcagggccagtcagagttgttaaatgctattctaacttacgcctaggtaccagccaaggaaacctggccctaagccctacccgagtacctccctacaatttaacggtcggtacgactaacgtacctacggaccgggtccccctaggacctaacgtccccgaagtaccgtacggtttccaaggttcggacgtagggttcggggttacgtacggggaacctaggtaaccctttcgacctacgttaccaaccgttatacccaaccgtagtacgtcgggacgtaccgttaggaaacgtttgtttcgacgttagttacgttacttacgtacgtaaccgtaacgtggttcgtacctacgacgtacgacgtcggtacgtccggaacgtaggaccgtaggaacgtaactacgaagtacngtacgctacggcacgtctcgtcgtctacnccgttccctcgactgtctacgtactccgtatccgtagtcggacggtcggg

SEQ ID NO: 47242 - DNA, 733 bp, Homo sapiens
  misc_feature: GYAE6OF01DN7N8.34.6.A06.1.454.CMB.1.raw
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
  modified_base (635)..(635): a, c, t, g, unknown or other
  misc_feature (635)..(635): n is a, c, g, or t
  modified_base (691)..(691): a, c, t, g, unknown or other
  misc_feature (691)..(691): n is a, c, g, or t
tcagtacacgtgatcacgaccggtgctcgatttagatctactgacagggaaccatggaaaccccagcgcagcttctcttcctcctgctactctggctcccagatatcaccggaagaaattgtgttgacacagtctccgagctaccctgttctttgtctaccggaaggggaaancgtcccaccctctccngcgacgggccaggtcagtagttagttaacagcattctaagttcggcccttaggaccagctaaaggaacctggaccactccctccagtacctcctacgtaagtttaatgggtacactaaacgtacctaacggacccggggtcccctgggacctaacgtaccccgaagaccggtcggtttacgaggttcgggacgtcggggttcgggacgttacggggaatacggtaccttcactcctacacctactaccgactagtacgtacgggactaccgtagtaacgtttatttcgacgtagttacgtatttaccggtcttaacgtaaccgttagggtttcgttacctacgtaaccgtacgtacgggtttacggggttacccgttaccgggaaccgggtaacggggtaacctaaggttacggaaaacgaaccgtaaacgacgtacggtgtaccncgaacctactgtactagtccttctaccggttacctccccgtataaccctaggttanaacgtttccggaacttggtaccgtagggccgggtaaccgggg

SEQ ID NO: 47243 - DNA, 784 bp, Homo sapiens
  misc_feature: GYAE6OF01AC2HR.34.6.A06.1.454.CMB.1.raw
  modified_base (167)..(167): a, c, t, g, unknown or other
  misc_feature (167)..(167): n is a, c, g, or t
  modified_base (175)..(175): a, c, t, g, unknown or other
  misc_feature (175)..(175): n is a, c, g, or t
  modified_base (270)..(270): a, c, t, g, unknown or other
  misc_feature (270)..(270): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaangccacctntcctgcagggccagtcagacgtgttaatgcattctacttagcctggtaccagcaagaacctggccagccctccagacctcctcattaatcgggtnactatacgtacgacgggcccctggcactcccgagacgtaggttcaggttcggacctaggtcgggtcgtcggggactagtacgtttcacttcgtaccacctattccaacgagtaacgttggacgtcccttaggaaagtttacgttttgaccgttaaggtttacggtttaactttacgtacggttaccgtaaacgtttgggttttacccgggtaacctttaccaaccgtaaccggtaaccggggttaccgggggttaaccggtttccgggggaaacccgtaaaccggggggtaacccgttaaaggggggttaaaccgggtaaaacgtttacccggaaaaaccgggttaaccgttgggtaccgggccttacgggtacccctaaccgtacgtttaccgttcggttaaccctttcgtaaccgttttccccgttacccccgtacttccgtttaaccgttacggttaaacccttaccgggttaccgttaccggttaacgttcgggaaagggttccccgggg

SEQ ID NO: 47244 - DNA, 360 bp, Homo sapiens
  misc_feature: GYAE6OF01B3ASV.34.6.A06.1.454.CMB.1.raw
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
  modified_base (300)..(301): a, c, t, g, unknown or other
  misc_feature (300)..(301): n is a, c, g, or t
  modified_base (306)..(360): a, c, t, g, unknown or other
  misc_feature (306)..(360): n is a, c, g, or t
tcagtacacgtgatcacgaccggtgctcgatttagatctactgacagggccccctggcatcccagacccactgccactgaacctgtctgggacagacttcactctcaccatcaccagactggagcctgaagatttttgcagtgtattactgtcaacagttggtctcacacacgtgacgttcggcaagggccaaggtggaaatcaaacgaactgtcggctgcacattctgtcttcattccttcccgctatctnaactcacgttntactggagcgggctagggacaaggcacatagtcancnncatcnnnnnnnnnnnnnnnnnnnnnnnnnnnnnnnnnnnnnnnnnnnnnnnnnnnnnnn

SEQ ID NO: 47245 - DNA, 803 bp, Homo sapiens
  misc_feature: GYAE6OF01EGWTI.34.6.A06.1.454.CMB.1.raw
  modified_base (759)..(759): a, c, t, g, unknown or other
  misc_feature (759)..(759): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccgaggccaccctgttctttgtctccgaaggggaagacgcccaccctctcctgcgagggccagtcgagtagttgttaatacgctacttcctacgttacgccgtacggtaccacgtacgaacgtaaccgtcggccacgccctaccagtacctcctacgtattaagtcggtacgactaactacgtaccgtacggggtcccccgtggacctaccgtaccccgtaggtaccgtacgggtttacgaacggttcgggacgtacggggttcggggttcgtaacggggtaaccgtacgttaccgttaccgtaccttcctaaccgacctaactaccgaaccgtaggaccggttacgggaccgtaccgttaggtaacgtttagttacggtaccgttaagttacgtttaactttacgttacggttaaccgtaacgttaggtttacgttctaaccgtaccgtaccggttacgggttacggtaaccggtttcccgggaacggtaaaccgggtaaccgtaagggtaacgtaacctaacggaaaccggtacgtgggtaccggtacgttacgacccttacgtcttacgttcggttaaccttcgtacccggttcccgtacccgtaccttcgtacccggttanaaacgtttcccgtacgggtttactaccggttaggcgggtccggg

SEQ ID NO: 47246 - DNA, 327 bp, Homo sapiens
  misc_feature: GYAE6OF01CP449.34.6.A06.1.454.CMB.1.raw
  modified_base (160)..(160): a, c, t, g, unknown or other
  misc_feature (160)..(160): n is a, c, g, or t
  modified_base (221)..(221): a, c, t, g, unknown or other
  misc_feature (221)..(221): n is a, c, g, or t
  modified_base (275)..(275): a, c, t, g, unknown or other
  misc_feature (275)..(275): n is a, c, g, or t
  modified_base (294)..(295): a, c, t, g, unknown or other
  misc_feature (294)..(295): n is a, c, g, or t
  modified_base (299)..(327): a, c, t, g, unknown or other
  misc_feature (299)..(327): n is a, c, g, or t
tcagtacacgtgatcacgaccggtgctcgatttagatctactgacagggccccctggcatccccagacaggttcagtggcagtgggtctgggacagacttcactctcaccatcaccagactggagcctagaagtattttgcagtgtattactgtcaacgngttgctcacacacgtggacgttcggaccaagggaccaaggtaggaaatcgaaaacgactgngctgcaccatctgtctcattcctcccgcatctgaactcacgtgtactgagcggntggacaaggccatagtagnngtannnnnnnnnnnnnnnnnnnnnnnnnnnnn

SEQ ID NO: 47247 - DNA, 700 bp, Homo sapiens
  misc_feature: GYAE6OF01BZ699.34.6.A06.1.454.CMB.1.raw
  modified_base (630)..(630): a, c, t, g, unknown or other
  misc_feature (630)..(630): n is a, c, g, or t
  modified_base (653)..(653): a, c, t, g, unknown or other
  misc_feature (653)..(653): n is a, c, g, or t
  modified_base (655)..(656): a, c, t, g, unknown or other
  misc_feature (655)..(656): n is a, c, g, or t
  modified_base (665)..(665): a, c, t, g, unknown or other
  misc_feature (665)..(665): n is a, c, g, or t
  modified_base (667)..(668): a, c, t, g, unknown or other
  misc_feature (667)..(668): n is a, c, g, or t
  modified_base (671)..(671): a, c, t, g, unknown or other
  misc_feature (671)..(671): n is a, c, g, or t
  modified_base (674)..(674): a, c, t, g, unknown or other
  misc_feature (674)..(674): n is a, c, g, or t
  modified_base (676)..(678): a, c, t, g, unknown or other
  misc_feature (676)..(678): n is a, c, g, or t
  modified_base (680)..(681): a, c, t, g, unknown or other
  misc_feature (680)..(681): n is a, c, g, or t
  modified_base (683)..(683): a, c, t, g, unknown or other
  misc_feature (683)..(683): n is a, c, g, or t
  modified_base (686)..(689): a, c, t, g, unknown or other
  misc_feature (686)..(689): n is a, c, g, or t
  modified_base (692)..(693): a, c, t, g, unknown or other
  misc_feature (692)..(693): n is a, c, g, or t
  modified_base (695)..(700): a, c, t, g, unknown or other
  misc_feature (695)..(700): n is a, c, g, or t
tcagtacacgtgatcacgaccggtgctcgatttagatctactgacagggccagtcagagtgttaatagcatctacttagcctggtaccagcagaaacctggccagcctcccagacctcctcattaatggtgcatactacgacgggccccctggcactcccagacgtacggttcgaggtggcgtagggttcgggtcgtagggactaggtacctttcaccttcctaccaacctactaccaaccgaacgtaacgtacgggacgtccgtaaggtaaagtttacgttttcggacgtagtttacggttaactttaacgttacgttaaccgtaacggtaggtttttccgggtacctaccgaaccgtaccgtaacggttcgggtacccggtttacccgggaaccggtaaagggggaaccggtaacgggtaaggtaaaaccgttaccgaaaaaccggtaccgttaggtccggtacgtacgcctaacttacgttcgtaccgttctttaccaaccgtttcccggttaccccaccactttacttaacggaccttaccgtaacggttaccgttacgtacgggtaccgggtcgggtccggttacgggaacccggaacggtccggtaaccgtaaggttaaccggngtagacgtacgctagcgcgacgngnnactacacgngnntantgncnnncnngnctnnnncgnnannnnnn

SEQ ID NO: 47248 - DNA, 837 bp, Homo sapiens
  misc_feature: GYAE6OF01CTEG0.34.6.A06.1.454.CMB.1.raw
  modified_base (175)..(175): a, c, t, g, unknown or other
  misc_feature (175)..(175): n is a, c, g, or t
  modified_base (613)..(613): a, c, t, g, unknown or other
  misc_feature (613)..(613): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttagacacacgtctaccgaggccacccgttgtctttgtctccgaagggggaancgccctacctctccgtgcgagggccctagtaccgaggtacgttagttaatacggactagttaccttacgtttacggcccttagggttaacccaggaccgtaacggaaaccgtggacccacggtccctacccgacgtacctcccgttactagtttaacggtggtacggtacctaacgtaaccgtaccggtaccgggtaccccctaggaccctaccgttaccccggaacgtaccggttacggtttacgacgggttacgggccggtaagggtcggttacgttaggggacctacggttactaccgacttacctaccgacctacgtaccaaccgtacgtacggtcggaccgtaccgtagggtaacttacggttttacgaccgtaggtttacgttaacgtttacgtacgtaccgtaacgtcgggttcgttacgacgttaaccgnggtaaccgggttacggttaacccggttaccgggaaccggtaaaccggggtacggttaaagggtaacggtaaccgtaaccggaaacggttacgtaggttaccgggtcgttacggaacctaccgtattccggtacgttcccgttaacttaccgtcccgttccctacggttccttacgtaaggttacctaaccgggttacttaggtaacggtcgtacgggtaccggg

SEQ ID NO: 47249 - DNA, 750 bp, Homo sapiens
  misc_feature: GYAE6OF01E46NR.34.6.A06.1.454.CMB.1.raw
tcagtacacgtgatcacgaccggtgctcgatttagatctactgacagggaaccatggaaaccccagcgcagcttctcttcctcctgctactctggcctcccagatatcaccggagaattgtgttgacacagtctccaggcaccctgtctttgtcctccgaggggaaagacgcccaccctctcctgccgacggggccagtcgagtagttagttaatagactatctactagccgtacggtacagcaacgaaccgtggaccacgaccctcccgagtacctcctactaagttaacgtggtacactactaccgacgaccggggtcccctaggccaccgttacccgaaggtaccgttacgggttccagggtacggtacggtacgggttcggggtccgtagggacctaacgtcctttacgaccgttcctaacccgaacctacttaccccgaaccgtacggtaccggtacgggaaccgttccgtaaacgggttaaactttgtttacggtacgttaacgttacgtttacttacgtacgtaccgtaagtacgttcggtactacctacgtacgtaccggttacggtacgttccggaccggtaaggggtaccgtaaagggtaccggtaacgtaacctaagggtacgttcggtacgaccgttagaccctacgtcgtacgtctttccgtactaccccgtttctccccggtacttatacccgttaggtacgttcctagttaccggcgtagggtccggtaccgggg

SEQ ID NO: 47250 - DNA, 302 bp, Homo sapiens
  misc_feature: GYAE6OF01ELC9U.34.6.A06.1.454.CMB.1.raw
  modified_base (259)..(259): a, c, t, g, unknown or other
  misc_feature (259)..(259): n is a, c, g, or t
  modified_base (291)..(302): a, c, t, g, unknown or other
  misc_feature (291)..(302): n is a, c, g, or t
tcagtacacgtgatcacgaccggtgctcgatttagatctactgacagggcccctggcatcccagacaggttcagtggcagtgggtctgggacagacttcactctcaccatccaccagactggagcctgaagtattttgcagtgtattactgtcaacagttggtctcacacacgtggacgttcggccaagggaccaaggtgaaatcaaacgactgtggctgcaccatctgtctcatcctccgccatcgtgaactcacgtntactggacgcgggctggcaaggcgacagtagnnnnnnnnnnnn

SEQ ID NO: 47251 - DNA, 293 bp, Homo sapiens
  misc_feature: GYAE6OF01ATXM4.34.6.A06.1.454.CMB.1.raw
  modified_base (156)..(156): a, c, t, g, unknown or other
  misc_feature (156)..(156): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (284)..(293): a, c, t, g, unknown or other
  misc_feature (284)..(293): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagtattttgcagtgtattactgtcaacngttgtctcacacacgtggacgttcggccaagggaccaaggtgaaatcaaacgactgtgctgcacatctntcttcatccttcccgctatctgaactcacgtntactgagcggctggacaaggcgcatgnnnnnnnnnn

SEQ ID NO: 47252 - DNA, 301 bp, Homo sapiens
  misc_feature: GYAE6OF01E1MMJ.34.6.A06.1.454.CMB.1.raw
  modified_base (233)..(233): a, c, t, g, unknown or other
  misc_feature (233)..(233): n is a, c, g, or t
  modified_base (288)..(301): a, c, t, g, unknown or other
  misc_feature (288)..(301): n is a, c, g, or t
tcagtacacgtgatcacgaccggtgctcgatttagatctactgacagggcccctggcatcccagacaggttcagtggcagtgggtctgggacagacttcactcgtcaccatccaccagactggacgcctgaagattttgcagtgtattactgtcaacagttggtctcacacacgtggacgttcggccaagggaccaaggtggaaatcaaacgactgtgctgcacatctgtctnatcttccgctatctgaatcacgtgtactgacgcggctggcaagggcacgatagcnnnnnnnnnnnnnn

SEQ ID NO: 47253 - DNA, 376 bp, Homo sapiens
  misc_feature: GYAE6OF01DMRQ0.34.6.A06.1.454.CMB.1.raw
  modified_base (102)..(102): a, c, t, g, unknown or other
  misc_feature (102)..(102): n is a, c, g, or t
  modified_base (330)..(330): a, c, t, g, unknown or other
  misc_feature (330)..(330): n is a, c, g, or t
  modified_base (333)..(341): a, c, t, g, unknown or other
  misc_feature (333)..(341): n is a, c, g, or t
  modified_base (343)..(376): a, c, t, g, unknown or other
  misc_feature (343)..(376): n is a, c, g, or t
tcagtacacgtgatcacgaccggtgctcgatttagatctactgacagggcccctggcatcccagacaggttcagtttggcagtgggtctggggacagacttnactctcaccatcaaccagactggagcctagaagtatttttgctagtgtattactgtacaactaggttggtctacacactacggtggtacgttcggaccaaagggaccaaaggtaggaaatacaaaacgaactggtgctgccacattctgtctctactccgtcccactatcagtaactctacggtgtactggacggcggtcgtcggacgaacgggcgaactagtagctnatnnnnnnnnnannnnnnnnnnnnnnnnnnnnnnnnnnnnnnnnnn

SEQ ID NO: 47254 - DNA, 568 bp, Homo sapiens
  misc_feature: GYAE6OF01AZ4NX.34.6.A06.1.454.CMB.1.raw
  modified_base (125)..(125): a, c, t, g, unknown or other
  misc_feature (125)..(125): n is a, c, g, or t
  modified_base (503)..(503): a, c, t, g, unknown or other
  misc_feature (503)..(503): n is a, c, g, or t
  modified_base (505)..(523): a, c, t, g, unknown or other
  misc_feature (505)..(523): n is a, c, g, or t
  modified_base (525)..(525): a, c, t, g, unknown or other
  misc_feature (525)..(525): n is a, c, g, or t
  modified_base (527)..(568): a, c, t, g, unknown or other
  misc_feature (527)..(568): n is a, c, g, or t
tcagtacacgtgatcacgaccggtgctcgatttagatctactgacagggccccctggcatcccagacaggtttcagtggcagtgggtctgggacagacttcactctcaccatcaccagactggancctagaagtatttttgacgtagttgtaatttacgtgttaccaaacgtaggtttggtactacaacacgtacggtggacgtttccgggaccgtaaaggggaaccgaagggtaaggtaaaactaccgaaaaaacggtacgttggtacgggcctacggaccctaacgtaacttccgttacggtttcctttccgaacttttccccgtttacccccggacccttaacttccggtttaaagtaaaaccgtttaccgttaaaccggtttacggttaaccggttacggggaaacccggtccgggggggtaccttaacggggaccggtaaaaacggggtcccgtaacggtaagttaaacggctaagcggttacagcgttgaattcagngnnnnnnnnnnnnnnnnnnnanannnnnnnnnnnnnnnnnnnnnnnnnnnnnnnnnnnnnnnnnn

SEQ ID NO: 47255 - DNA, 542 bp, Homo sapiens
  misc_feature: GYAE6OF01CCYCK.34.6.A06.1.454.CMB.1.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (489)..(489): a, c, t, g, unknown or other
  misc_feature (489)..(489): n is a, c, g, or t
  modified_base (500)..(500): a, c, t, g, unknown or other
  misc_feature (500)..(500): n is a, c, g, or t
  modified_base (504)..(505): a, c, t, g, unknown or other
  misc_feature (504)..(505): n is a, c, g, or t
  modified_base (507)..(509): a, c, t, g, unknown or other
  misc_feature (507)..(509): n is a, c, g, or t
  modified_base (512)..(512): a, c, t, g, unknown or other
  misc_feature (512)..(512): n is a, c, g, or t
  modified_base (514)..(516): a, c, t, g, unknown or other
  misc_feature (514)..(516): n is a, c, g, or t
  modified_base (518)..(523): a, c, t, g, unknown or other
  misc_feature (518)..(523): n is a, c, g, or t
  modified_base (525)..(525): a, c, t, g, unknown or other
  misc_feature (525)..(525): n is a, c, g, or t
  modified_base (527)..(530): a, c, t, g, unknown or other
  misc_feature (527)..(530): n is a, c, g, or t
  modified_base (532)..(535): a, c, t, g, unknown or other
  misc_feature (532)..(535): n is a, c, g, or t
  modified_base (537)..(541): a, c, t, g, unknown or other
  misc_feature (537)..(541): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacacgggcccctggcatcccagacaggttcagtggcaggttgggtctgggacagcttcactctcaccatccacagacgtggacncctagaagttnttttgctaagttgtatttacgtgtacaacgtggtttcgtcctacacctacgtacggtcggtaccgtttcggaccgaaacgggtacgtaaagggtaaggaaactacgaaaacgtacgtggtacggctacgactaccattcgtcttactactacgttccctaccgacacgttctacgtacctaacgtacggtacgtacgtcggaacggtcccggtgtacgggaacggacggtactacgtaaggtactgagcgtacagtgnactcgcagttncgtnntnnncgngnnngnnnnnnangnnnnannnncnnnnnc

SEQ ID NO: 47256 - DNA, 344 bp, Homo sapiens
  misc_feature: GYAE6OF01BH90R.34.6.A06.1.454.CMB.1.raw
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (302)..(305): a, c, t, g, unknown or other
  misc_feature (302)..(305): n is a, c, g, or t
  modified_base (307)..(344): a, c, t, g, unknown or other
  misc_feature (307)..(344): n is a, c, g, or t
tcagtacacgtgatcacgaccggtgctcgatttagatctactgacagggcccctggcatcccagaccaggttcagtggcacgtgggtctgggacagaccttcgacctctcaccatcaccagactggagctgaagtattttgcagtgtattactgtacaacgagttggtctcacactacgtcggacgttcgaccgaaggaccaaggtggaaactcaaacgaactggtggactgacacatctgtctcatcctccgcatcctnaactccagtgtacgtgagcggtntggacgacggnacgaatgnnnncnnnnnnnnnnnnnnnnnnnnnnnnnnnnnnnnnnnnnn

SEQ ID NO: 47257 - DNA, 412 bp, Homo sapiens
  misc_feature: GYAE6OF01B61XU.34.6.A06.1.454.CMB.1.raw
  modified_base (140)..(140): a, c, t, g, unknown or other
  misc_feature (140)..(140): n is a, c, g, or t
  modified_base (380)..(412): a, c, t, g, unknown or other
  misc_feature (380)..(412): n is a, c, g, or t
tcagtacacgtgatcacgaccggtgctcgatttagatctactgacagggcccctggcatcccagacccactgccactgaacctgtctgggacagacttcactctcaccatccaccagactggagcctagaagtattttgntagttgttattacgtgtaccaaacgtaggttgtcctacgaacacgacggtcggacgttccggaccgaaaagggacctaaggtaggaaactacgaaaacgtacgtgtgctagaccaccattctacggttcttacaccgttccctacccctctaacttcgtaagtaactaccgtacggttagtaacggtcgggacggtccggggtggaaccggacggaaccgggaccgtactagaagcctgnnnnnnnnnnnnnnnnnnnnnnnnnnnnnnnnn

SEQ ID NO: 47258 - DNA, 494 bp, Homo sapiens
  misc_feature: GYAE6OF01DJB2Z.34.6.A06.1.454.CMB.1.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (459)..(459): a, c, t, g, unknown or other
  misc_feature (459)..(459): n is a, c, g, or t
  modified_base (464)..(494): a, c, t, g, unknown or other
  misc_feature (464)..(494): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacgacgggcccctggcactcccagacaggttcagtggcaggtgggtcgtgggacagtacctcactcncaccatcacagacgtggacgtcctagaagtntttgctagtagttattactgtaccaatgttggtactccaactacgtacggtggtacgttccggaccgaaagggaccgtaaggtaggaaactcgaaaacgatggtgctnccacntctgtctacgtcttccctcccgctcgttacgtacgtaactccgtacgtacgtaccgtgggacggacccgggtgtacgggaaccgtacgggtccctaaagtcgtaacggctanagctnnnnnnnnnnnnnnnnnnnnnnnnnnnnnnn

SEQ ID NO: 47259 - DNA, 796 bp, Homo sapiens
  misc_feature: GYAE6OF01BG22F.34.6.A06.1.454.CMB.1.raw
tcagtacacgtgatcacgaccggtgctcgatttagatctactgacagggaaccatgggaaaccccagcgcagcttctcttcctcctgctactctggctcccagatatcgaccggagtaaattgtgttgacacagtcctccgaggccacccttgttctttgtctccgaagggggaaacgacgccctacccctctcctggccgacggggccagtcgagtaggttagttaaatagacctattaccttaacttacgtcccgttggtaaccagacaacgaaccgtcgggccacgcccctccacgacctcctaacgtattaagtggacgtactaattaaccgaccggtaccggtcccctggacctaccgtaccccgtaagaccgtagggttccagggtcggtacgtaggggtcggtcgtagggactacggtactccgtacttcccacgtaaccgacttaccgaacgtacggtacgaccgggtactaccgtaaggtaacgtttagtttacgcggtttaagtttacggtttactacgttacgtacgttaacgttcggtttcgttaacctaccgtaccgtaacggttaccgggttacgggtacccggttaccgggaaacgggtaaccgggtaaacgggtaagggtaacgttaaacggtaaaccgaaacggtacggtgtaccggtacgtcgtaacccgtactacgtcgttcttacgttacccgttacgtttcccgtacccccgtacggttctacgttaccgtaacgtttaccgtacggttaaggtacggtgggaaccgggtccggg

SEQ ID NO: 47260 - DNA, 761 bp, Homo sapiens
  misc_feature: GYAE6OF01DWCKK.34.6.A06.1.454.CMB.1.raw
  modified_base (177)..(177): a, c, t, g, unknown or other
  misc_feature (177)..(177): n is a, c, g, or t
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaagcgccaccctntcctgcgaggccagtcagagttagttaatagcatctacgttacgcctggtaccagacaacgaaacctcggccacgtcccnccagtaccttcctactaagtttaagtcgggtnacctaattaaccgtaacgaccggggaccccgttggcctaaccgtccccaaggaccgtagggtttccaagggtcggcgtagggttcgggtcgtacggggaactacggtaccttaccggaccttcctaccgaccctatcccaaccggtaggtaccgttagggactacccggttaagtaaagttaccggtttttagacgtaagtttacgttattttacgtttacgtcaacggtccaagtcgtaataccgtaaccgttcccggtaccgttaacccgtttaccgtttaccggtttacgggacccgggtaacgggtaacccgaacggttaccggtaaggaacgtaaaccgtaacgtaaaaccggtgttacgtacggttaccagaccccgttactacggtttaccgtactttccgtttacgtcccttaccccgttccccgacttacgttaccacgtttacgtaccggtacgtttaccgg

SEQ ID NO: 47261 - DNA, 938 bp, Homo sapiens
  misc_feature: GYAE6OF01EKEU3.34.6.A06.1.454.CMB.1.raw
  modified_base (168)..(168): a, c, t, g, unknown or other
  misc_feature (168)..(168): n is a, c, g, or t
tcagtacacgtgatcacgaccggtgctcgatttagatctactgacagggaaccatggaaaccccagcgcagcttctcttcctcctgctactctggctccagatatcaccggagaaattgtgttgacacagtctccaggcacccttgtctttgtctccgaaggggaacncgcccaccctctcctgcgagggccagtcagtagtgttaatagcatctacttagcctaggtaccagacaacgaaccgtcggccacgccctacccgacgtaccttccctactaattaacgtcggtacgactaactaccgtaacggaccgggtccccctagggacctaaccgtaccccggaacgtaccgtaacgggtttccgaaggggttccggtaggtacggggttcggggttaccggtaagggggaacctacggttaccctttaccggtacccttaccgtaaccctaacccgtacgtaacccgtaacccgtaacgggtaccggtaacgggtaccggtaccgttaaagggtaacggttttaacgttttcggaaccgtttaagggtttcgttttaaccgtttaaccgtttacggtaaccgttaacgtttaccgggtttacgttaccgttaacccgtaaacggttaaccccgggtaacgggttacccgggggttaaccccgggtttaacccggggtaaaccccgggtaaccgggggtaaaacccggtaaaagggggttaaccggtaaaaacggtaaacctaaaaaccggggtttaaccggtggggttaccccggtacggtaccgtacccggtaacccgttcgtttaaccgtggtttttaccccaccgtttaccttacccccggttacccggaaccttgttaccggttaaccctaaacggtttccccgtaacgggtttaaaccggttaccggtaagggtccccgggggtacgggg

SEQ ID NO: 47262 - DNA, 830 bp, Homo sapiens
  misc_feature: GYAE6OF01D6JTD.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgagggaaagagccaccctctcctgcagggccagtcagtagtgttaatagcatctacttagcctaggtaccagcaagaaacctggccagtccctaccagtacctcctactaatttaacgtggtcgacaattaccgtaaccgaccgggtccccgtggacctaccgtacccgagaacgtacggtttacaggttacggacctagggttcgggtacgttaggggaacctacggttaccttacctaccttaccgtaccctaaccgtaactacccgaaaccgtcggtaacgtacgggaccgtaccgtaagtaaacgtttgttttacggacgttaaggttacgtttaacgtttaaccgttaacggttaaccgtaaacgttacggttttaccgggtaccttaacccgtaaccgtaaccggttaccgggttaccgggttaaccgggtttacccgggaaaccggtaaaccggggtaaacccgtaacgggttaaacgggtaaaacgtaaccgtaaaacccgggttaacgtaccgggttacgtaacccgttacgacccgtaacccgtaagtttacccgttacgtttaccgttaccctaacccgtttccccgttaccccgtaccttacttaacccgtgtaaaacccttcggtaacccggttagttaccggtggtaccgggacccggg

SEQ ID NO: 47263 - DNA, 302 bp, Homo sapiens
  misc_feature: GYAE6OF01DPRXR.34.6.A06.1.454.CMB.1.raw
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (292)..(302): a, c, t, g, unknown or other
  misc_feature (292)..(302): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagtattttgctagtgtattactgtacaactagttgtctcacactcgtggacgttcggaccgaagggaccaaggtagaaatacgaaacgactgtgctgcaccatctntcttcatcctccgcatntagatcacgtntagtggagcggctggacaggccganatagnnnnnnnnnnn

SEQ ID NO: 47264 - DNA, 545 bp, Homo sapiens
  misc_feature: GYAE6OF01E09CJ.34.6.A06.1.454.CMB.1.raw
  modified_base (523)..(545): a, c, t, g, unknown or other
  misc_feature (523)..(545): n is a, c, g, or t
tcagtacacgtgatcacgaccggtgctcgatttagatctactgacagggccagtcaggagtgttaatagcatctacttagcctggtaccagcagaaacctggccagcctcccagacctcctcattaatggtgcatactacgacgggcccctggcactcccagacgaggttcagtggctaggtgggtcgtgggacagtacttcactctcacatcagcgagtacgttgacgtaccgtagaagttacttttgactagttattactttacgtcgtactacgactaatacgtacgacggacgtcgtacgttcggggtcggggtaccggttccgggaaccggaaccggggtaaccgaagggtacggaaaacgtaccgaaaacggtaccgttgggtcgtacggtcacctaccgtacgtcttccgtactttctaccttcccgtcccctactacttcgtacgtaacgtcgtacggttagtcggtaggtaccgggcggggtacgacggggaacctagggccgtgtaagtagcnnnnnnnnnnnnnnnnnnnnnnn

SEQ ID NO: 47265 - DNA, 753 bp, Homo sapiens
  misc_feature: GYAE6OF01D6SHX.34.6.A06.1.454.CMB.1.raw
  modified_base (173)..(173): a, c, t, g, unknown or other
  misc_feature (173)..(173): n is a, c, g, or t
  modified_base (709)..(709): a, c, t, g, unknown or other
  misc_feature (709)..(709): n is a, c, g, or t
  modified_base (742)..(742): a, c, t, g, unknown or other
  misc_feature (742)..(742): n is a, c, g, or t
  modified_base (745)..(745): a, c, t, g, unknown or other
  misc_feature (745)..(745): n is a, c, g, or t
tcagtacacgtgatcacgaccggtgctcgatttagatctactgacagggaaccatggaaaccccagcgcagcttctcttcctcctgctactctggctcccagatatcaccggaagaaattgtgttgacacagtctccaggccaccctgttctttcgtctccgaagggggaaanacgcccaccctctcctgcgacgggccagtcaggtagttagttaatagctattccttacttacgccttacggtaccagaccaacgaaacccgtgggacccacggtcccctacccaacgtaccttccttataagtttaacgtggtaccgactaacttaccgtaccggaccgggtccccttggaccctaccgtaccccgaaggaccgttaggttaccgagggtcggtacgtacgggttggggtaccgtaggggaacctacggttaccttccaccgttcctacccaacctaacgtacccaaccgtacggtacgtacgggtacctaccggttagtaaacgtttacgtttcgaacgttgttttaacgtttaacgttacgttacgttaaccgttaaggttacggtttacgtacctacgtaaccgtaccgttacggtacgggttaccgtacccgggtaaccgaacgggtacgtaagggtaacgaaactacgaaacgtagtcgtagtctcgacgtactagttctcgttcttacgtcttccctccnctatcgtaactacgtaccgtaggtaccgttagnggnggtccggg

SEQ ID NO: 47266 - DNA, 786 bp, Homo sapiens
  misc_feature: GYAE6OF01EL8ZO.34.6.A06.1.454.CMB.1.raw
tcagtacacgtgatcacgaccggtgctcgatttagatctactgacagggaaccatggaaaccccagcgcagcttctcttcctcctgctactctggcctcccagatatcaccggagaaattgtgttgacacagtctccaggcaccctgttctttgtctccgaaggggaaagacgccctaccctctcctgccgacgggccagtcagagtagttaatagctatcttacttacgcccgtaggtaaccagaccaacgaaaccgtcggccacgccctacccgagtaccttcctactaagtttaagtcggtacgactaacgttacctaaccggccgggtcccccgtaggacctacccgttaccccgaagggtaaccgtagggtttccgaaggtccgggtacggtacgggtcgggtttacgtacggggtaacacggttacctttccgaccttccgtacccgacctacgtacccgtaacccgagtaccgtagggaccgtacccgttaggtaaacgtttctttcggacgttacggttagtttaacgttacgttacgtaaccgtaacgtttgggtttccggacctaaccgtaaccgtaaccggttaccgggtcgggtaccggttaccggaacggtaacgggtacgtaagggtacgaaactacgtaaaccggtagtcgggtactcgtacgtacgtaccgtacgttcctagttacccgttactaccgtttccccgtacccgtatacgttacgagttaacctccggttaacgtacggtaccggttcggaccgggtccggg

SEQ ID NO: 47267 - DNA, 721 bp, Homo sapiens
  misc_feature: GYAE6OF01C6B6N.34.6.A06.1.454.CMB.1.raw
  modified_base (183)..(183): a, c, t, g, unknown or other
  misc_feature (183)..(183): n is a, c, g, or t
  modified_base (265)..(265): a, c, t, g, unknown or other
  misc_feature (265)..(265): n is a, c, g, or t
tcagtacacgtgatcacgaccggtgctcgatttagatctactgacagggaaccataggaaaccccagcgcagcttctcttcctcctgctactctggctcccagatatcaccggagaaattgtgttgacacagtctccaggcacctgtctttgtctccgaggggaagagccaccctctcctgcncgggccagtcagagtagttaatagcatctactagcctggtaccagcaagaacctggaccagcctaccagactctactattangtagacactactacgacggtaccctggtacacgtacccgagacgtacggttcaggtcggcgtaggtggtacgtagggacagtaccgttacacctcctacctaaccgaacgtaccgaaccacggtaaccgttagggaccgtacccttaaggtaaacgtttaacggtttttacggacgttacggtttacgttaacttttaccggtacggttaactaaaccggtttagtttacgggtaccttacgaacccgttacgtaacccgggttacgggtacggttacccggaaccgggaacgggtaaaccggaagggttaacgtaaacgtaacgaaaccgtacgtacgggtaggcctacgaccactacgtcgttcgttaccttaaccgtcctacccgttcccgtacctacgtttaccgtagtaacccgttcgtaacggttagttaccggtggcgggttaccgggg

SEQ ID NO: 47268 - DNA, 734 bp, Homo sapiens
  misc_feature: GYAE6OF01EP1YH.34.6.A06.1.454.CMB.1.raw
  modified_base (164)..(164): a, c, t, g, unknown or other
  misc_feature (164)..(164): n is a, c, g, or t
tcagtacacgtgatcacgaccggtgctcgatttagatctactgacagggaaccatggaaaccccagcgcagcttctcttcctcctgctactctggctcccagatatcaccggagtaattgtgttgacacagtctccaggcacctgtctttgtctcgaggggaancgccacctctcctgcgagggccagtcagagtagttaatagctatctacttagcctaggtaccagacaacgaaacccgtcggaccacgcccctacccgaagtacccttcctactaacgtttaagtgggtacactaacttaccgtaaccggaccgggtcccccgtggacctacctacccgaggtaccgtacgggttcagggtgggacgtagggttcgggtcgtagggactacgtaccttccacgtcctaccacctatcccaacgagtacggtaggtacggtaaccggtaagttcgttttacggacgttaggttacgtttaacttacgtacgttaaccgaagtttacggtttcggtacctaccgaacgtacgtacgggttcgggtaccggttacgggaaccgtaacgggtaaccggtaagggtaacgtaactaacggaaacgtagtacggtacggtacgtacggacctaactacgttacgttcgttaaccttccgtacctttacccggtaccctacttacgtacgtacgtacttaccgtacggttacgtaccgtagggtccgggacggtacgg

SEQ ID NO: 47269 - DNA, 811 bp, Homo sapiens
  misc_feature: GYAE6OF01ARAUI.34.6.A06.1.454.CMB.1.raw
  modified_base (168)..(168): a, c, t, g, unknown or other
  misc_feature (168)..(168): n is a, c, g, or t
  modified_base (282)..(282): a, c, t, g, unknown or other
  misc_feature (282)..(282): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaaagngccaccctctcctgcgagggccagtcagagtgttaatgcatctacttaggcctggtaccagcaacgaaaccgtggaccacggccctccgagacctcctctaattaagtgggtanactactaacctacggaccgggtccccgtaggtccactacccgagtacgtacggttacaggttcggcgtagggtcggggtcgtacggggactaacggtcctttacaccgttacctaccaaccgtactaccgaccgtacggtaccgttcgggaaccgtctaacgggtaaagtttacggttttcgaaccggtttaggttactttaacgtttaccgtcgttaacgtaaccgtttgggttcggttaacctacgaacctacggtacgggttacgggtaccggttaccgggtaacccgaaacggggtaacccgttaagggggttaacggaaaacgtaaaccgtaaaacgggttccgggtaagggtttacccggacgtaacgggtaccccgtaacttccctttccgggttactttaccccgtttaccgtaccgttttacccccggttaccccgaacgtttcgttacccggttaacgtaaccgttaacccggttaaggttacccgggtttaacggtaggggtacccggggtaccgggg

SEQ ID NO: 47270 - DNA, 726 bp, Homo sapiens
  misc_feature: GYAE6OF01CULPT.34.6.A06.1.454.CMB.1.raw
tcagtacacgtgatcacgaccggtgctcgatttagatctactgacagggaaccatggaaacccagcgcagcttctcttcctcctgctactctggctccagatatcaccggagtaaacttgtgttacgacacagtctccaggtcacccttgtctttcgtctccgaaggggaaagacgcctaccctcgtcctagcagggccagtccagagttagtaagtcgctaagtccttactacgcccttaggaccagacaacggaaacctggacccaggcccttccgagtactcctactagttaatcggttgacctagtaccttacggaccgggttcccctgggacctacgtacccggtagtaacgtacgggtttcaacgggtggaccgtaggttcgggacgtacggggtaacacggtacctttacgacgttcctctaacctacttccgacccgtaacgttaccgacgggactacccgtaggtaacgttagtttcggaacttagttcgttaacttagtaccgttaataacgtgttcgtactactacacgtaccggtacggtacgttaccggaacgttaccggaacggtaagaacgttaacgaaccgtaaacggtacgtaggtccggtactaccgtaacgtactacgttccttacgtaacttccgttaaccgtcccgttaccaccttcgtacccgtagtacgttaccgtaacgtcgttaaccgtagcggtaccggg

SEQ ID NO: 47271 - DNA, 549 bp, Homo sapiens
  misc_feature: GYAE6OF01E5L5K.34.6.A06.1.454.CMB.1.raw
  modified_base (493)..(493): a, c, t, g, unknown or other
  misc_feature (493)..(493): n is a, c, g, or t
  modified_base (502)..(502): a, c, t, g, unknown or other
  misc_feature (502)..(502): n is a, c, g, or t
  modified_base (507)..(509): a, c, t, g, unknown or other
  misc_feature (507)..(509): n is a, c, g, or t
  modified_base (511)..(514): a, c, t, g, unknown or other
  misc_feature (511)..(514): n is a, c, g, or t
  modified_base (516)..(516): a, c, t, g, unknown or other
  misc_feature (516)..(516): n is a, c, g, or t
  modified_base (518)..(525): a, c, t, g, unknown or other
  misc_feature (518)..(525): n is a, c, g, or t
  modified_base (527)..(549): a, c, t, g, unknown or other
  misc_feature (527)..(549): n is a, c, g, or t
tcagtacacgtgatcacgaccggtgctcgatttagatctactgacagggccagtcagagtgttagcagcaacttggcctggtaccagcagaaacctggccaggctcccaggctcctcatctatggttcatccaccagggccaacttggtactcccaagccaggttcagtggcaggtggtctgggacaggaacttcactctcaccatcaagcacgcctgcagtctgaattattttgctagttttatactgtaccagtactaagtaataataacgttcggacccgtccgggacgttaccgggacgaaacgggtaccaaagggttggaaaacttaccgaaaacggtaacgtggtcggactacgtcgaacccctaattcccttggttacccttagacgttccctttaccccggaccctaagttcaggtaaaacttccgaacccggttagaaccttggaacggaccggggtctacggtagaacgggtcccgagttaanacggcagtncgtcnnnannnnanannnnnnnnannnnnnnnnnnnnnnnnnnnnnn

SEQ ID NO: 47272 - DNA, 653 bp, Homo sapiens
  misc_feature: GYAE6OF01AX8WD.34.6.A06.1.454.CMB.1.raw
  modified_base (167)..(167): a, c, t, g, unknown or other
  misc_feature (167)..(167): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccagggggaaanagccaccctctcctgcagggccagtcagagtgttaatagcatctacttagcctggtaccagcagaacctggccagccctccagactcctacattaatggtgcatactacagggcccctggcactcccagacaggttcagtggcaggtgggtcgtgggacagacgtttcactctacacctatacaccagacctggagccgtagaagtattttgactagtcgttattactgtacaacgtacgttcggtactctaacctacgtacgtacgggtaccgttaccgggaccgaacggggtaccaagggttacgggaaacttaacgaaaaccggtaacgttacgggtacgggtaccttcggacccaccgtacgttaccgttcgtttaccgttccgtaccgtttccccgtttaccccggtaacccgttacttaccgtaacggttaactacccgttaaccggtcggttaaccgtttagggacggtacccgggggg

SEQ ID NO: 47273 - DNA, 522 bp, Homo sapiens
  misc_feature: GYAE6OF01ELQ6Q.34.6.A06.1.454.CMB.1.raw
  modified_base (474)..(474): a, c, t, g, unknown or other
  misc_feature (474)..(474): n is a, c, g, or t
  modified_base (481)..(482): a, c, t, g, unknown or other
  misc_feature (481)..(482): n is a, c, g, or t
  modified_base (485)..(522): a, c, t, g, unknown or other
  misc_feature (485)..(522): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtggggtctgggacagacttcactctcaccatcaccagtacctggagcctgaaagattttgcagttgtagttacctgttcaaactaggtttggccttacactaacctaacgtgggaccgtttacgggccctaaaagggggaccaaagggtggaaaacgttcaaaacggtaactgtaggcgtacgtccaacctagtacctgtcctttagactttccttccccgactactctacggacttacaacggttgtaaccctaggaacggcgggtacctgggtaccaagggtccggactagtaaggctnaagtcanncgnnnnnnnnnnnnnnnnnnnnnnnnnnnnnnnnnnnnnn

SEQ ID NO: 47274 - DNA, 755 bp, Homo sapiens
  misc_feature: GYAE6OF01EEMHD.34.6.A06.1.454.CMB.1.raw
  modified_base (217)..(217): a, c, t, g, unknown or other
  misc_feature (217)..(217): n is a, c, g, or t
  modified_base (475)..(475): a, c, t, g, unknown or other
  misc_feature (475)..(475): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggccacctgttctttgtcctaccgaagggggaaagacgcccaccctcctcctgccacgggccagtcagtagttagttaanacgcacgttcttacgttacgccgtaggtaccagtaccaacgtaaaccgtcggaccacgcccctaccgacgtacctcctactaagttaagtggtactactaactaccgtaccgaccggtccccgtaggacctaccgtacccgaagaacggttacggttaccgagggttcggacgtgggtcgggtcggtagggactacgtacgttccactctaccaacctactacccaacgtagtaccgtaggacgacgtagtaaggttntttcgagttagttaacgttactttacgtacggtactaaacggttcggtttaccgtacctaacggtaacctaacggttaccgggttaacgggttacccgttaccggggaaccggtaaacggtaacccggtaagggaacgtaaactaaccgggtaaacgtaccgttggtaccggtctacggacctaaccgtcgttcttccgttcgtactacccgttcccgtacccgtactacgtacgttactaacgttcccgtaagtaccgttacggtcggcgggttaccgg

SEQ ID NO: 47275 - DNA, 510 bp, Homo sapiens
  misc_feature: GYAE6OF01BVWJS.34.6.A06.1.454.CMB.1.raw
  modified_base (132)..(132): a, c, t, g, unknown or other
  misc_feature (132)..(132): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (472)..(510): a, c, t, g, unknown or other
  misc_feature (472)..(510): n is a, c, g, or t
tcagtacacgtgatcacgaccggtgctcgatttagatctactgacagggccagtcagagtgttaatagcatctacttagcctggtaccagcagaaacctggccagccctcccagacctcctcattaatggtncatactacacgggccctggcatcccagactaggttcagtggctaggtgggtctgggacagtacttcactctcacatcacagactggactctaggaagttagtttcgctagttattacttacgngtacaagtggttcgtctacacncgtaggtcgacggttccgacggaagggtaccaaggtagaaactaggaaacgtagtggcgtcncgacactacgtcgtnttaccgtactcgtttcccncccgtactacgtacgttataaccgtacgtacggttacgtaccggagggcggggcggtccgtagggacccggttaacgccgtaacgtatcgctgatcggnnnnnnnnnnnnnnnnnnnnnnnnnnnnnnnnnnnnnnn

SEQ ID NO: 47276 - DNA, 626 bp, Homo sapiens
  misc_feature: GYAE6OF01C50MA.34.6.A06.1.454.CMB.1.raw
  modified_base (133)..(133): a, c, t, g, unknown or other
  misc_feature (133)..(133): n is a, c, g, or t
  modified_base (177)..(177): a, c, t, g, unknown or other
  misc_feature (177)..(177): n is a, c, g, or t
  modified_base (216)..(216): a, c, t, g, unknown or other
  misc_feature (216)..(216): n is a, c, g, or t
  modified_base (584)..(584): a, c, t, g, unknown or other
  misc_feature (584)..(584): n is a, c, g, or t
  modified_base (591)..(593): a, c, t, g, unknown or other
  misc_feature (591)..(593): n is a, c, g, or t
  modified_base (595)..(626): a, c, t, g, unknown or other
  misc_feature (595)..(626): n is a, c, g, or t
tcagtacacgtgatcacgaccggtgctcgatttagatctactgacagggccagtcagagttgttaatagcatctacttagcctggtaccagcagaaacctggccagccctcccagacctcctcagttatggtncatactacacggcccctgccatcccagacaggttcagtcggacnggtggtcgtagggacagacttcactctccaccatccacngactggatcctagaagttttcggactagtagttattaccgtagtactaacgtaggtttcgtactcaaccgtactacgggtacgggtaccgtttaccggaccggtaacggggtaacccgtaaaacgggggtaacgttaaaaaaccgtaccgtaaaaaccggtaaccggttcgggtaccggtaccgttttacggaacccttaacccgtagttaccgttaaccggtttccttacctaaccggtttcccgtttacccccacgttacgtaccgttaacgtaccgttacgtacggtacgtttaccggacgtacggggtacgggtcccgtaagggaccgaaacgggccaaccgttaagccgtgcctggatttganccgttgnnngnnnnnnnnnnnnnnnnnnnnnnnnnnnnnnnn

SEQ ID NO: 47277 - DNA, 758 bp, Homo sapiens
  misc_feature: GYAE6OF01AYY4X.34.6.A06.1.454.CMB.1.raw
  modified_base (170)..(170): a, c, t, g, unknown or other
  misc_feature (170)..(170): n is a, c, g, or t
  modified_base (437)..(437): a, c, t, g, unknown or other
  misc_feature (437)..(437): n is a, c, g, or t
  modified_base (644)..(644): a, c, t, g, unknown or other
  misc_feature (644)..(644): n is a, c, g, or t
  modified_base (648)..(648): a, c, t, g, unknown or other
  misc_feature (648)..(648): n is a, c, g, or t
  modified_base (689)..(689): a, c, t, g, unknown or other
  misc_feature (689)..(689): n is a, c, g, or t
tcagtacacgtgatcacgaccggtgctcgatttagatctactgacagggaaccatgggaaaccccagcgcagcttctcttcctcctgctactctggctcccagatatcaccggagtaattgtgttgaccacagtctccaggcacccttgtctttgtctaccgaggggaancgcctaccctctcctgcgacgggccagtcagtagttagttaatagctacttcttacttacgtccgttacggtaccagtaccgaacgtaaccgtcggaccacgtccctaccgaacgtaccttaccttactaagtttaaggtcggtacgactaacgtaccgtaaccggtccgggtaccccttaggacctaccgtacccgaacgtacgttacgggttaccgaggtcggtacgtagggttcggtgtaacggtaccgtaactccgttaaccnccgttacacctacctagacccaacggtacgtacggtcgtaaccgtacgtaaagtacgtttctttacggacgttagtttacgtttataccggttacgtacgtaaggttctttacggactacggacttacggaggttcggtaaccggcgaaacggaacggtacggtaagaaccgtatacccggaattacgggcgttacgcgtacctacncgtnttaccgttgtaccctaagtttacccgttcccggttaacccntttacgtaccctaagggttacctacgggtttaccggaccctttaaagggtcccgggtcggggtaaccgg

SEQ ID NO: 47278 - DNA, 574 bp, Homo sapiens
  misc_feature: GYAE6OF01B25JS.34.6.A06.1.454.CMB.1.raw
  modified_base (207)..(207): a, c, t, g, unknown or other
  misc_feature (207)..(207): n is a, c, g, or t
  modified_base (265)..(265): a, c, t, g, unknown or other
  misc_feature (265)..(265): n is a, c, g, or t
  modified_base (518)..(518): a, c, t, g, unknown or other
  misc_feature (518)..(518): n is a, c, g, or t
  modified_base (521)..(521): a, c, t, g, unknown or other
  misc_feature (521)..(521): n is a, c, g, or t
  modified_base (539)..(539): a, c, t, g, unknown or other
  misc_feature (539)..(539): n is a, c, g, or t
  modified_base (542)..(560): a, c, t, g, unknown or other
  misc_feature (542)..(560): n is a, c, g, or t
  modified_base (565)..(574): a, c, t, g, unknown or other
  misc_feature (565)..(574): n is a, c, g, or t
tcagtacacgtgatcacgaccggtgctcgatttagatctactgacagggccagtcagagtgttaatagcatctacttagcctggtaccagcagaaacctggccagcctcccagactcctcgacttaatggtgctatacctacgacgggcccctggcatcccagacgaggttcagtggcaggttgggtctgggacagacttcgacctntccgaccatcaccagactggacgcctaggtaagtacttttgctaggttcgtattacgntcaacgtagttcggtctacaactcgaacgttggaccgtttcggacccgttaaagggacccaaagggtcgaaaattaccgaaaacggtaacgttggtaacggtcctacggacccaaccgtatttaccgtcgtttaccgttaccacgtttccctccccggaccttaacgttcgtacgtaacgttccgtaacggtttacgtaccgttagggaacggtccgggcgttacgggacgttacggccgactaacgtgtcgnacngatcgctgcagcgcagcngannnnnnnnnnnnnnnnnnnggggnnnnnnnnnn

SEQ ID NO: 47279 - DNA, 566 bp, Homo sapiens
  misc_feature: GYAE6OF01CLDMQ.34.6.A06.1.454.CMB.1.raw
  modified_base (184)..(184): a, c, t, g, unknown or other
  misc_feature (184)..(184): n is a, c, g, or t
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (434)..(434): a, c, t, g, unknown or other
  misc_feature (434)..(434): n is a, c, g, or t
  modified_base (459)..(459): a, c, t, g, unknown or other
  misc_feature (459)..(459): n is a, c, g, or t
  modified_base (496)..(496): a, c, t, g, unknown or other
  misc_feature (496)..(496): n is a, c, g, or t
  modified_base (519)..(519): a, c, t, g, unknown or other
  misc_feature (519)..(519): n is a, c, g, or t
  modified_base (525)..(526): a, c, t, g, unknown or other
  misc_feature (525)..(526): n is a, c, g, or t
  modified_base (531)..(566): a, c, t, g, unknown or other
  misc_feature (531)..(566): n is a, c, g, or t
tcagtacacgtgatcacgaccggtgctcgatttagatctactgacagggccagtcagagtgttaatagcatctacttagcctggtaccagcaagaaacctggccagccctcccagacctcctcattaatggtgacatactacgaccgggcccctggacactcccagacgtaggttcaggtggcnggtgggtcgtggacagtacttcatctaccacactccaacaggacgnggacgacctaggtaaacgttatttcgntaggttattacttacgtagtcgtaagtcggttagcctaacaaccgaccgtaggtcggaccgttacggaaccggaacggaacgtaaggtaagaaaactaacccggaaagccgttagggacggtaccacggtaaccctacgtaattcgtacgttacgttcccttagtaccccctcccgntaaccttagaaccgttgtaacccgnggtttaaccgtacgggcgtaccggggagttaccgggnggtaacgacgggtaccgactagngatcgnntagcnnnnnnnnnnnnnnnnnnnnnnnnnnnnnnnnnnnn

SEQ ID NO: 47280 - DNA, 933 bp, Homo sapiens
  misc_feature: GYAE6OF01A7E97.34.6.A06.1.454.CMB.1.raw
tcagtacacgtgatcacgaccggtgctcgatttagatctactgacagggaaccatggaaaccccagcgcagcttctcttcctcctgctactctggctcccagatatcacggagaattgtgttgacacagtctccgaggcaccctgttctttgtctccgaaggggaaatacgccaccctctacctgcgacgggcctagtcagtagttacttaaagtagctacttcttaacctttaggccttacgggtaaccaggtacgaaacgtaaacccgtcgggacctacgccctcccaaggtaccttcctacctatttaaaggtcggtacgtactaacttaaccgtaccggaccgggtaccccttgggacctaccgttaccccgaaggtaccgtaacgggtttccgaacggttcgggaccgtagggtttacggggtacgttacgggggtaaactacggttaccccgtttactacccgtttaccgtaaccctaaccgtaactttacccgaaacccgttcggaaaccgtttcgggggaaccttaacggttacgtaaaacgggttttaacttttacgggaccgttaacggtttaacggtttaaccgtttaccgttaacgggttaacccgttaaacggtacggggtttttacccgttaacgttaacccgtaaaccgttaacccggttacggggttaaccgggttaacccgggtttaccgggaaaccggtaaaccggggttaaaccgtaaacgggggttaaacgggtaaaacctaaccgggtaaaccggttaacccggttagggaccgtttaccggacgtaccccacgttactcccggtttaacgttaccttaccgtaacctttcccggttaccccgtattacgtaaccgttaagtaacccgtcgggttaaccgttaggttaaccgcgggtcggggttaacccggg

SEQ ID NO: 47281 - DNA, 1039 bp, Homo sapiens
  misc_feature: GYAE6OF01B5ETB.34.6.A06.1.454.CMB.1.raw
  modified_base (486)..(486): a, c, t, g, unknown or other
  misc_feature (486)..(486): n is a, c, g, or t
tcagtacacgtgatcacgaccggtgctcgatttagatctactgacagggaaccatcggaaaccccagcgcagctttctcttcctcctgctactctggcctccagatactcgaccggagtaattgtgtagacacagtcctccgacggccaccccttggtttcctttttcgtacccgtacggaaagggggaaagaccggaccctaccccttccgttacccgtcggccggacgggacccgtacggtaccgtaaggtaaggtttaggtttaaactacgactacttacctttaccgtttacgtccgttacggtaccaaggaccgaaaccgaaaccgttccgcccgaccgtacccgtaccccgaacgtacccttccgttaacgtaaagtttttaacgtgggtaccaaccgttaacgttaaccgttacccggacccggggttcccctaacgggacctacccgttaaccccggaggttaggttccgggttaacncggggttaacggccggtacgggttaggggtaccgtacgggtaaacctacgttcctacccgccgttacctaccgaacttaccgaccgtaaccgtacgggacccggttaagggaccgttacttaacgggtaattttacggtttcgggaaccttcgtttaaagtttaacgtccgttaacggtacggttaaccgttccgggtttacgtaacccgttaccgtaaacgtaccgggttaaccgggttaaccggggttaaccccggttacggggtaaaccccgggtaaacggggtaacggtaaacccggggtaaacgttaaacccggttaaacggtaacccgggtttaacgggtacgggttcccgtaaaccggggtcccgttaaagttaccccgtaacccgttcgggttttaaccgtaccccgttttaaccggtccccgtttttaaacccccggtccgttaacttacccccgggtttataaccccggttttaaacccgtaacccggttttaaccgggttaaccctaccgggggtttccgggaaaccgggggttccccgggg

SEQ ID NO: 47282 - DNA, 569 bp, Homo sapiens
  misc_feature: GYAE6OF01B8GV4.34.6.A06.1.454.CMB.1.raw
  modified_base (133)..(133): a, c, t, g, unknown or other
  misc_feature (133)..(133): n is a, c, g, or t
  modified_base (186)..(186): a, c, t, g, unknown or other
  misc_feature (186)..(186): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (510)..(510): a, c, t, g, unknown or other
  misc_feature (510)..(510): n is a, c, g, or t
  modified_base (514)..(515): a, c, t, g, unknown or other
  misc_feature (514)..(515): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
  modified_base (532)..(538): a, c, t, g, unknown or other
  misc_feature (532)..(538): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (546)..(547): a, c, t, g, unknown or other
  misc_feature (546)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(563): a, c, t, g, unknown or other
  misc_feature (561)..(563): n is a, c, g, or t
  modified_base (565)..(567): a, c, t, g, unknown or other
  misc_feature (565)..(567): n is a, c, g, or t
  modified_base (569)..(569): a, c, t, g, unknown or other
  misc_feature (569)..(569): n is a, c, g, or t
tcagtacacgtgatcacgaccggtgctcgatttagatctactgacagggccagtcagagtgttaatagcatctacttagcctggtaccagcagaaacctggccagcctcccagaccttcctcaattaatggtncatactacgagggcccctgcactcccagacaggttcagtggactaggtcggtntagggacagtacttcacctctccaccatccaacacgtaccgtgggactacctgaaacgttctttgacagtttagtaactttacgtgtacaaacgtggttacgtacctacaacggactacggttagtaacgttcggaaccgtaaacgggaacctaaggttaggaaaacttacgaaagtacgaacgtggtaacgtcctaggaaccctactagtcttcggtaccttactacgtccctacccgtacattcacgaattcctaaggttccgaggtacgagggttcccgaacggcggaccgtaacggccagtaatacggntagacgntacnggtnnacgcaagntacgancannnnnnncngntnannangnanngananannnannngn

SEQ ID NO: 47283 - DNA, 605 bp, Homo sapiens
  misc_feature: GYAE6OF01BPIT7.34.6.A06.1.454.CMB.1.raw
  modified_base (231)..(231): a, c, t, g, unknown or other
  misc_feature (231)..(231): n is a, c, g, or t
  modified_base (542)..(542): a, c, t, g, unknown or other
  misc_feature (542)..(542): n is a, c, g, or t
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (568)..(568): a, c, t, g, unknown or other
  misc_feature (568)..(568): n is a, c, g, or t
  modified_base (577)..(579): a, c, t, g, unknown or other
  misc_feature (577)..(579): n is a, c, g, or t
  modified_base (582)..(582): a, c, t, g, unknown or other
  misc_feature (582)..(582): n is a, c, g, or t
  modified_base (584)..(586): a, c, t, g, unknown or other
  misc_feature (584)..(586): n is a, c, g, or t
  modified_base (592)..(592): a, c, t, g, unknown or other
  misc_feature (592)..(592): n is a, c, g, or t
  modified_base (599)..(601): a, c, t, g, unknown or other
  misc_feature (599)..(601): n is a, c, g, or t
  modified_base (603)..(603): a, c, t, g, unknown or other
  misc_feature (603)..(603): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacgagggcccctggcatcccagacaggttcagtggcaggtgggtctgggacagacttcactctcaccatcaccagacgtcggacgcctagaagtnttttcgacgtagttagttacttacgttcgtacaaacgtaggtttggtcctacgaacctacgtacggtcgggtaccggttacggaccgaaacggggaccgaaagggtacggaaaactaccgaaaacgtacgtggtcggcgtacggaccaaccgtattccgttacgttaccgttactaccgttcccgtccccgtacctacgtaccgtacgtaaacgtcctacggttacgtaccgtagggaaccggtccggggtctacgggtaccggaacgggtcccgtaaccgtaagttaacggctagtcgtcagggctacgngtcgtgngancacncangntnatcanacgtagagnnnatngnnngtgagncgtctgnnngngc

SEQ ID NO: 47284 - DNA, 416 bp, Homo sapiens
  misc_feature: GYAE6OF01BE5YA.34.6.A06.1.454.CMB.1.raw
  modified_base (99)..(99): a, c, t, g, unknown or other
  misc_feature (99)..(99): n is a, c, g, or t
  modified_base (161)..(161): a, c, t, g, unknown or other
  misc_feature (161)..(161): n is a, c, g, or t
  modified_base (346)..(346): a, c, t, g, unknown or other
  misc_feature (346)..(346): n is a, c, g, or t
  modified_base (348)..(350): a, c, t, g, unknown or other
  misc_feature (348)..(350): n is a, c, g, or t
  modified_base (352)..(354): a, c, t, g, unknown or other
  misc_feature (352)..(354): n is a, c, g, or t
  modified_base (357)..(357): a, c, t, g, unknown or other
  misc_feature (357)..(357): n is a, c, g, or t
  modified_base (360)..(365): a, c, t, g, unknown or other
  misc_feature (360)..(365): n is a, c, g, or t
  modified_base (367)..(416): a, c, t, g, unknown or other
  misc_feature (367)..(416): n is a, c, g, or t
tcagtacacgtgatcacgaccggtgctcgatttagatctactgacagggcccctggcatcccagacaggttcagtggcagtgggtctgggacagacttnactctcaccatcgaccagactggagcctgaagtacttttgctaggttgtattactgtcaacnggtttgtctcacacgacgtggacgttcggcaagggaccaaggtggaaatacgaaaacgactggtcggactgaccaccattcgtagttacctttacaatttccgttccccgctattccgtagtaacttcgacgttacgtacgttaggagggccgggtactagggacgtaacggcctaagtatacgntnnntnnncancannnnnngnnnnnnnnnnnnnnnnnnnnnnnnnnnnnnnnnnnnnnnnnnnnnnnnnn

SEQ ID NO: 47285 - DNA, 657 bp, Homo sapiens
  misc_feature: GYAE6OF01CMW2H.34.6.A06.1.454.CMB.1.raw
  modified_base (464)..(464): a, c, t, g, unknown or other
  misc_feature (464)..(464): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
  modified_base (561)..(561): a, c, t, g, unknown or other
  misc_feature (561)..(561): n is a, c, g, or t
  modified_base (570)..(570): a, c, t, g, unknown or other
  misc_feature (570)..(570): n is a, c, g, or t
tcagtacacgtgatcacgaccggtgctcgatttagatctactgacagggccagtcagagtgttaatagcatctacttagcctggtaccagcagaaacctggccagcctccagactcctcattaatggtgctatactacaggcccctggcacgtcccaagacgacgttgagtggcaggtgggtctgggacacgacttcaactctcgaacctataccaccgaacgtacgtggacgtcctagaacgttagttttcgactaagttgtaacttactcgttacaaactaggtttggtacctacaacgtaccgtaccggtggtaccggttaccggaccgtaaaggaaccccgaaagggttacggaaaactaccgaaaaaccggtagtacggttacggtcctacggaacctaccgttaacgtccgttacgtaccgtacgttaacttcccgtttaccccgcctattaccggtntaaatccgtaacggtacgtacgtaggtacggccggttacgacggacgaacggtccggattaagggactnagcctngtanacgtatctacgtcgtaangctacgctntctacacgtacgtacgtacgtactacgtacgtcgtacgtactgtacgcgatacgtcgacgtcgtcgtacgtactagacgcgtgtacg

SEQ ID NO: 47286 - DNA, 658 bp, Homo sapiens
  misc_feature: GYAE6OF01BL27A.34.6.A06.1.454.CMB.1.raw
  modified_base (133)..(133): a, c, t, g, unknown or other
  misc_feature (133)..(133): n is a, c, g, or t
  modified_base (613)..(613): a, c, t, g, unknown or other
  misc_feature (613)..(613): n is a, c, g, or t
  modified_base (617)..(617): a, c, t, g, unknown or other
  misc_feature (617)..(617): n is a, c, g, or t
  modified_base (620)..(627): a, c, t, g, unknown or other
  misc_feature (620)..(627): n is a, c, g, or t
  modified_base (631)..(658): a, c, t, g, unknown or other
  misc_feature (631)..(658): n is a, c, g, or t
tcagtacacgtgatcacgaccggtgctcgatttagatctactgacagggccagtcagagtgttaatagcatctacttagcctggtaccagcaagaaacctggccagcctccccagactcctcattaatgggtncatactacgacgggcccctggcactcccgagactagggttcaggtggctaggtgggtctgggacagtacttcactctccacactcaccagaccgtggacgcctaggaagttcttttggactagttggttatttagttcgtacgagtcgacgtactaactcgtacgttccggttaacccgtaaccccgttaaccgttacggttttccgggaacccgggtaaccgggggaacctaacggtcggtacgggtaaacgaacgtaaacccggaaaacggtaacgttgggtaccggacgtacgacccaaccgttacgtttcgttaccgtttacctttccgtaccccgtttacccgtttacccggtacccttaccgttacgtaacgtaacgttaccctttaaccggttaacggtacgttacggggtaaccggggtccgggttaaccgggttcggggaaccgtaacggggtaccaaccgttaaggactntacnagnnnnnnnngacnnnnnnnnnnnnnnnnnnnnnnnnnnnn

SEQ ID NO: 47287 - DNA, 285 bp, Homo sapiens
  misc_feature: GYAE6OF02GBBNN.34.6.A06.1.454.CMB.1.raw
  modified_base (281)..(285): a, c, t, g, unknown or other
  misc_feature (281)..(285): n is a, c, g, or t
tcagtacacgtgatcacgaccggtgctcgatttagatctactgacaggccctggcatcccagacaggttcagtggcagtggtctgggacagacttcactctcaccatcaccagactggagcctgaagatttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcgcatagnnnnn

SEQ ID NO: 47288 - DNA, 289 bp, Homo sapiens
  misc_feature: GYAE6OF02IX8TD.34.6.A06.1.454.CMB.1.raw
  modified_base (285)..(289): a, c, t, g, unknown or other
  misc_feature (285)..(289): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgccatctgaatcacgtgtactgagcggctggcaaggcgcatagnnnnn

SEQ ID NO: 47289 - DNA, 327 bp, Homo sapiens
  misc_feature: GYAE6OF02H4T05.34.6.A06.1.454.CMB.1.raw
  modified_base (293)..(327): a, c, t, g, unknown or other
  misc_feature (293)..(327): n is a, c, g, or t
tcagtacacgtgatcacgaccggtgctcgatttagatctactgacgagggccctggcatcccagaccaggttcagtggcagtcgggtctgggacagacttcactctcaccatcaccagactggagacctgaagattttgcagtgtattactgtcaacagttggtctcacacacgtggaacgttcggccaaagggccaaggtggaaatcgaaacgaactgtggctgcaccatctgtcttcatctccgcatctgaatcacgtgtactgagcgggtctggcaaggcgcaagtacgnnnnnnnnnnnnnnnnnnnnnnnnnnnnnnnnnnn

SEQ ID NO: 47290 - DNA, 383 bp, Homo sapiens
  misc_feature: GYAE6OF02I96YF.34.6.A06.1.454.CMB.1.raw
  modified_base (378)..(383): a, c, t, g, unknown or other
  misc_feature (378)..(383): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcgcatagnnnnnn

SEQ ID NO: 47291 - DNA, 289 bp, Homo sapiens
  misc_feature: GYAE6OF02ITPUW.34.6.A06.1.454.CMB.1.raw
  modified_base (284)..(289): a, c, t, g, unknown or other
  misc_feature (284)..(289): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgcatctgaatcacgtgtactgagcggctggcaaggcgcatagnnnnnn

SEQ ID NO: 47292 - DNA, 289 bp, Homo sapiens
  misc_feature: GYAE6OF02HUYOZ.34.6.A06.1.454.CMB.1.raw
  modified_base (284)..(289): a, c, t, g, unknown or other
  misc_feature (284)..(289): n is a, c, g, or t
tcagtacacgtgatcacgaccggtgctcgatttagatctactgacagggccctggcatcccagacaggttcagtggcagtgggtctgggacagacttcactctcaccatcaccagactggagcctgaagatttgcagtgtattactgtcaacagttggtctcacacacgtggacgttcggccaagggaccaaggtggaaatcaaacgaactgtggctgcaccatctgtcttcatcttccgccatctgaatcacgtgtactgagcgggctggcaaggcgcatagnnnnnn

SEQ ID NO: 47293 - DNA, 383 bp, Homo sapiens
  misc_feature: GYAE6OF02GCVJS.34.6.A06.1.454.CMB.1.raw
  modified_base (379)..(383): a, c, t, g, unknown or other
  misc_feature (379)..(383): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcggctggcaaggcgcatagnnnnn

SEQ ID NO: 47294 - DNA, 290 bp, Homo sapiens
  misc_feature: GYAE6OF02I59IE.34.6.A06.1.454.CMB.1.raw
  modified_base (286)..(290): a, c, t, g, unknown or other
  misc_feature (286)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnn

SEQ ID NO: 47295 - DNA, 292 bp, Homo sapiens
  misc_feature: GYAE6OF02F6GD0.34.6.A06.1.454.CMB.1.raw
  modified_base (287)..(292): a, c, t, g, unknown or other
  misc_feature (287)..(292): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcagcaatatcgagacgcactgtgggcgttcggccaagggaccaaggtggaaatcaaacgaactgtggctgcaccatctgtcttcatcttcccgccatctgaatcacgtgtactgagcgggctggcaaggcgcatagnnnnnn

SEQ ID NO: 47296 - DNA, 291 bp, Homo sapiens
  misc_feature: GYAE6OF02GG5IU.34.6.A06.1.454.CMB.1.raw
  modified_base (286)..(291): a, c, t, g, unknown or other
  misc_feature (286)..(291): n is a, c, g, or t
tcagtacacgtgatcacgaccggtgctcgatttagatctactgacagggccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgcatagnnnnnn

SEQ ID NO: 47297 - DNA, 384 bp, Homo sapiens
  misc_feature: GYAE6OF02GC3NY.34.6.A06.1.454.CMB.1.raw
  modified_base (378)..(384): a, c, t, g, unknown or other
  misc_feature (378)..(384): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcgcatagnnnnnnn

SEQ ID NO: 47298 - DNA, 383 bp, Homo sapiens
  misc_feature: GYAE6OF02HJITL.34.6.A06.1.454.CMB.1.raw
  modified_base (377)..(383): a, c, t, g, unknown or other
  misc_feature (377)..(383): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgcatctgaatcacgtgtactgagcggctggcaaggcgcatagnnnnnnn

SEQ ID NO: 47299 - DNA, 384 bp, Homo sapiens
  misc_feature: GYAE6OF02F3CFR.34.6.A06.1.454.CMB.1.raw
  modified_base (379)..(384): a, c, t, g, unknown or other
  misc_feature (379)..(384): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnnn

SEQ ID NO: 47300 - DNA, 497 bp, Homo sapiens
  misc_feature: GYAE6OF02GJWEQ.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggcaagggacaaggtggaaatcaaacgactgtggctgcaccatctgtcttcatcttccgccatctgaactcacgtgtactgagtcggg

SEQ ID NO: 47301 - DNA, 499 bp, Homo sapiens
  misc_feature: GYAE6OF02JATQ7.34.6.A06.1.454.CMB.1.raw
  modified_base (358)..(358): a, c, t, g, unknown or other
  misc_feature (358)..(358): n is a, c, g, or t
tcagtacacgtgatcacgaccggtgctcgatttagatctactgacagggaaccatggaaaccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctcccaggctcctcatctatggtgcatccaccagggccactggtatcccagccaggttcagtggcagtgggtctgggacagattcactctcaccatcagcagcctgcagtctgaagtnttttgctagtttattactgtcagtcagtataataactggcctcgggtacgttcggaccaagggaccgaaggtagaacttacgaaacgactgtggctgcacatctgtcttcattccttccgctatctagatctacgtgtacg

SEQ ID NO: 47302 - DNA, 167 bp, Homo sapiens
  misc_feature: GYAE6OF02HMACV.34.6.A06.1.454.CMB.1.raw
  modified_base (156)..(167): a, c, t, g, unknown or other
  misc_feature (156)..(167): n is a, c, g, or t
tcagtacacgtgatcacgaccggtgctcgatttagatctactgacaacgacacaagggaccaaagtggaaatcaaacgaactgtggctgcaccatctgtcttcatcttcccgccatctgaatcacgtgtactgagcgggctggcaaggcgcatagnnnnnnnnnnnn

SEQ ID NO: 47303 - DNA, 386 bp, Homo sapiens
  misc_feature: GYAE6OF02JEMN0.34.6.A06.1.454.CMB.1.raw
  modified_base (360)..(360): a, c, t, g, unknown or other
  misc_feature (360)..(360): n is a, c, g, or t
  modified_base (377)..(386): a, c, t, g, unknown or other
  misc_feature (377)..(386): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagatttgcagtgtattactgtcaacagttggtctcacacacgtggacgttcggccaagggaccaaggtggaaatcaaacgaactgtggactgcaccatctgtctcatcttcccgcatctgatcacgtgtactgagcggntggcaaggcacagtagnnnnnnnnnn

SEQ ID NO: 47304 - DNA, 293 bp, Homo sapiens
  misc_feature: GYAE6OF02HKIY3.34.6.A06.1.454.CMB.1.raw
  modified_base (288)..(293): a, c, t, g, unknown or other
  misc_feature (288)..(293): n is a, c, g, or t
tcagtacacgtgatcacgaccggtgctcgatttagatctactgacagggcccctcggccatcccagacccactcgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcacatctgtcttcatcttccgccatctgaatcacgtgtactgagcggctggcaaggcgctatagnnnnnn

SEQ ID NO: 47305 - DNA, 422 bp, Homo sapiens
  misc_feature: GYAE6OF02JC18C.34.6.A06.1.454.CMB.1.raw
  modified_base (131)..(131): a, c, t, g, unknown or other
  misc_feature (131)..(131): n is a, c, g, or t
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (361)..(361): a, c, t, g, unknown or other
  misc_feature (361)..(361): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (408)..(410): a, c, t, g, unknown or other
  misc_feature (408)..(410): n is a, c, g, or t
  modified_base (412)..(422): a, c, t, g, unknown or other
  misc_feature (412)..(422): n is a, c, g, or t
tcagtacacgtgatcacgaccggtgctcgatttagatctactgacagggccagtcagagtgttaatagcatctacttagcctggtaccagcagaaacctggccagcctcccagactcctcattaatgggtncatactacagggcccctggcatcccagaccaggttcagtggcagtggggtctagggacagacttnactctcaccatcaccaggacctggagcctgaaacgnttttcggcagtgtatttacngttnaacagttggtcttnacacacgtggacgttcggccaagggaccaagggtggaaatcaaaacgaacgtntgggctncgaccaattcncgttctcatcttcccgaccntacctaatcacgtgtactcgagcccggtgcaagggtccnctanacgnnncnnnnnnnnnnn

SEQ ID NO: 47306 - DNA, 507 bp, Homo sapiens
  misc_feature: GYAE6OF02H3IIV.34.6.A06.1.454.CMB.1.raw
  modified_base (352)..(352): a, c, t, g, unknown or other
  misc_feature (352)..(352): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcacagactggancctgaagattttgcagtgtattactgtcaactagttggtctcacacacgtggacgttcggcgaagggacaaggtgaaatacgaaacgaactgtagcgtgcaccatctgtcttctatccttccgccattcctgtactcacgttgtactgagtcggg

SEQ ID NO: 47307 - DNA, 498 bp, Homo sapiens
  misc_feature: GYAE6OF02FV1DX.34.6.A06.1.454.CMB.1.raw
  modified_base (486)..(486): a, c, t, g, unknown or other
  misc_feature (486)..(486): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacaggcccctggcatcccagacaggttcagtggcagtgggtctgggacagacttcactctcaccatcaccagactggagcctgaagattttgcagtgtattactgtcaacagttggtctcacacacgtggacgttcgccaagggaccaaggtggaaatcgaaacgaactgtggctgcacgatctgtctcatctcccgcactctgactcacgtntactgagtcggg

SEQ ID NO: 47308 - DNA, 290 bp, Homo sapiens
  misc_feature: GYAE6OF02G1JET.34.6.A06.1.454.CMB.1.raw
  modified_base (286)..(290): a, c, t, g, unknown or other
  misc_feature (286)..(290): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnn

SEQ ID NO: 47309 - DNA, 307 bp, Homo sapiens
  misc_feature: GYAE6OF02H1NDD.34.6.A06.1.454.CMB.1.raw
  modified_base (156)..(156): a, c, t, g, unknown or other
  misc_feature (156)..(156): n is a, c, g, or t
  modified_base (282)..(282): a, c, t, g, unknown or other
  misc_feature (282)..(282): n is a, c, g, or t
  modified_base (288)..(307): a, c, t, g, unknown or other
  misc_feature (288)..(307): n is a, c, g, or t
tcagtacacgtgatcacgaccggtgctcgatttagatctactgacagggcccctggcatcccagacccactgccactgaacctgtctgggacagacttcactctcaccatcaccagacgtggagcctgaagattttgcagtgtattactgtcaacngttggtctcacacacgtggacgttcggccaagggaccaaggtggaaaatcaaacgaatgtggctgcaccatctgtacttcatccttccgcatctgaatcaacgtgactgacgcggctggcaaggcncatagnnnnnnnnnnnnnnnnnnnn

SEQ ID NO: 47310 - DNA, 289 bp, Homo sapiens
  misc_feature: GYAE6OF02GI50F.34.6.A06.1.454.CMB.1.raw
  modified_base (287)..(289): a, c, t, g, unknown or other
  misc_feature (287)..(289): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgcatagnnn

SEQ ID NO: 47311 - DNA, 503 bp, Homo sapiens
  misc_feature: GYAE6OF02GE155.34.6.A06.1.454.CMB.1.raw
tcagtacacgtgatcacgaccggtgctcgatttagatctactgacagggaaccatggaaaccccagcgcagcttctcttcctcctgctaatctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgtttcggccaagggaccaaggtggaaatcaaacgaactgtggctgcaccatctgtcttcatcttcccgccatctgaatcacgtgtactgagtccggg

SEQ ID NO: 47312 - DNA, 502 bp, Homo sapiens
  misc_feature: GYAE6OF02IAPK2.34.6.A06.1.454.CMB.1.raw
  modified_base (497)..(497): a, c, t, g, unknown or other
  misc_feature (497)..(497): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgtttcggccaagggaccaaaggtggaaattcaaacgactagtgctgcacatctgtcttcatcttcccgcactctaatcacgtgtactgagnggtcg

SEQ ID NO: 47313 - DNA, 494 bp, Homo sapiens
  misc_feature: GYAE6OF02HXKF2.34.6.A06.1.454.CMB.1.raw
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacaggcccctggcatcccagacccactgccactgaacctgtctgggacagacttcactctcaccatcacanactggancctgaagatttgcagtgtattactgtcaacagttggtctcacacacgtggacgttcggcaagggaccaaggtggaaatcaaacgactgtggctgcacatctgtcttcatcttcccgcatctgactcacgtgtactgagtcggg

SEQ ID NO: 47314 - DNA, 386 bp, Homo sapiens
  misc_feature: GYAE6OF02I8KQD.34.6.A06.1.454.CMB.1.raw
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (379)..(386): a, c, t, g, unknown or other
  misc_feature (379)..(386): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaaacgaactgtgtctgcaccatctgtcttcatcttcccgcatctgaatcacgtntactgagcggctggcaaggcncatagnnnnnnnn

SEQ ID NO: 47315 - DNA, 391 bp, Homo sapiens
  misc_feature: GYAE6OF02IF1IU.34.6.A06.1.454.CMB.1.raw
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (332)..(332): a, c, t, g, unknown or other
  misc_feature (332)..(332): n is a, c, g, or t
  modified_base (381)..(391): a, c, t, g, unknown or other
  misc_feature (381)..(391): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctagggacaggacttcactctcaccatcaccagactggancctgaagntttgcagtgtacttactgtcaacagttggtctcacacacgtggacgttcggccaaggggaccaaggtggaaatcgaaacgaactgtagctagcactatctgtcttnatctccgcatcgtgaatcagtgactgagcgggctggcaggcgtcatagnnnnnnnnnnn

SEQ ID NO: 47316 - DNA, 658 bp, Homo sapiens
  misc_feature: GYAE6OF02H4QLS.34.6.A06.1.454.CMB.1.raw
  modified_base (435)..(435): a, c, t, g, unknown or other
  misc_feature (435)..(435): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagccgtggtaccagcaacgaaacctggccacgccctacccgaagtaccttccctactaatttaaacgtgggtcgactaacttaacctaacggaccgggtccccctggactactcccccgaagacgtaggttcaggttcggactagggtcgggtcgtagggacagtaccttcgaccttcaccacctatcgagctaagtacttggacgtcctaggaacgtttntttcgactaagttattacttacgtgtacagtactaaatagtacgagacgactacgttgggtcgggtccgttcggaccggaacgggaaccgtaagggtagtaaactaaccgaaacgtaacgttggtacggtactacgacctaactacgttcgttcgtccttactaccgttccctttacccgacccttacttaccgtacgttaacctcgtacgttcgttaaccgg

SEQ ID NO: 47317 - DNA, 291 bp, Homo sapiens; identical to SEQ ID NO: 46993
  misc_feature: GYAE6OF02G0KY0.34.6.A06.1.454.CMB.1.raw
  modified_base (286)..(291): a, c, t, g, unknown or other
  misc_feature (286)..(291): n is a, c, g, or t

SEQ ID NO: 47318 - DNA, 293 bp, Homo sapiens
  misc_feature: GYAE6OF02GNTDA.34.6.A06.1.454.CMB.1.raw
  modified_base (286)..(293): a, c, t, g, unknown or other
  misc_feature (286)..(293): n is a, c, g, or t
tcagtacacgtgatcacgaccggtgctcgatttagatctactgacagggcccctggcatcccagacaggttcagtggcagtgggtctgggacagacttcgactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgcatctgaatcacgtgtactgagcgggctggcaaggcgcatagnnnnnnnn

SEQ ID NO: 47319 - DNA, 289 bp, Homo sapiens
  misc_feature: GYAE6OF02F9JBN.34.6.A06.1.454.CMB.1.raw
  modified_base (285)..(289): a, c, t, g, unknown or other
  misc_feature (285)..(289): n is a, c, g, or t
tcagtacacgtgatcacgaccggtgctcgatttagatctactgacagggcccctggcatcccagacccactgccactgaacctgtctgggacagacttcactctcaccatcaccagactggggcctgaagattttgcagtgtattactgtcaacagttggtctcacacacgtggacgttcggccaagggaccaaggtggaaatcaaacgaactgtggctgcaccatctgtcttcatcttccgccatctgaatcacgtgtactgagcggctggcaaggcgcatagnnnnn

SEQ ID NO: 47320 - DNA, 389 bp, Homo sapiens
  misc_feature: GYAE6OF02JS4CT.34.6.A06.1.454.CMB.1.raw
  modified_base (351)..(351): a, c, t, g, unknown or other
  misc_feature (351)..(351): n is a, c, g, or t
  modified_base (379)..(380): a, c, t, g, unknown or other
  misc_feature (379)..(380): n is a, c, g, or t
  modified_base (382)..(389): a, c, t, g, unknown or other
  misc_feature (382)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtaggctgcaccatctgtcttcatcttccgcatctgaatcacgtntactgagtcggctggcaaggcgctatgnngnnnnnnnn

SEQ ID NO: 47321 - DNA, 293 bp, Homo sapiens
  misc_feature: GYAE6OF02F0LMT.34.6.A06.1.454.CMB.1.raw
  modified_base (286)..(293): a, c, t, g, unknown or other
  misc_feature (286)..(293): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnnnnn

SEQ ID NO: 47322 - DNA, 300 bp, Homo sapiens
  misc_feature: GYAE6OF02FSQ42.34.6.A06.1.454.CMB.1.raw
  modified_base (293)..(300): a, c, t, g, unknown or other
  misc_feature (293)..(300): n is a, c, g, or t
tcagtacacgtgatcacgaccggtgctcgatttagatctactgacagggcccctggcatcccagaccaggttcagtggcacgtgggtctggggacagacttcgacctctcaccatcaccagactggagcctgaagattttgcagtgtattactgtcaacagttggtctcacacacgtggacgtttcggccaagggaccaaggtggaaatcaaacgaactgtggctgcaccatctgtcttcatcttcccgccatctgaatcacgtgtactgagcgggctggcaaggcgcatagnnnnnnnn

SEQ ID NO: 47323 - DNA, 289 bp, Homo sapiens
  misc_feature: GYAE6OF02H0VOF.34.6.A06.1.454.CMB.1.raw
  modified_base (286)..(289): a, c, t, g, unknown or other
  misc_feature (286)..(289): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcggctggcaaggcgcatagnnnn

SEQ ID NO: 47324 - DNA, 290 bp, Homo sapiens; identical to SEQ ID NO: 47294
  misc_feature: GYAE6OF02GOFB6.34.6.A06.1.454.CMB.1.raw
  modified_base (286)..(290): a, c, t, g, unknown or other
  misc_feature (286)..(290): n is a, c, g, or t

SEQ ID NO: 47325 - DNA, 400 bp, Homo sapiens
  misc_feature: GYAE6OF02JVBG5.34.6.A06.1.454.CMB.1.raw
  modified_base (331)..(338): a, c, t, g, unknown or other
  misc_feature (331)..(338): n is a, c, g, or t
  modified_base (340)..(340): a, c, t, g, unknown or other
  misc_feature (340)..(340): n is a, c, g, or t
  modified_base (342)..(400): a, c, t, g, unknown or other
  misc_feature (342)..(400): n is a, c, g, or t
tcagtacacgtgatcacgaccggtgctcgatttagatctactgactagggtcccgtggcatccccagacaggttacagtggcagtgggtctgggacgacggacttcactctcaccgattcaccagactggagcctgaacgatttttgcagttgtattactgttcaaactagttgtctcacacaccgtggacgttcggccaagggaccaaggttgaaagtcaaacgaactgtggacctgcaccatccgtgtacttcagttccttacccgccatctagaattcactgtactgagcggctaggccaagggccgccagtaaggctgagtcatgcnnnnnnnngngnnnnnnnnnnnnnnnnnnnnnnnnnnnnnnnnnnnnnnnnnnnnnnnnnnnnnnnnnnn

SEQ ID NO: 47326 - DNA, 291 bp, Homo sapiens; identical to SEQ ID NO: 46993
  misc_feature: GYAE6OF02HBU7I.34.6.A06.1.454.CMB.1.raw
  modified_base (286)..(291): a, c, t, g, unknown or other
  misc_feature (286)..(291): n is a, c, g, or t

SEQ ID NO: 47327 - DNA, 299 bp, Homo sapiens
  misc_feature: GYAE6OF02GMO0K.34.6.A06.1.454.CMB.1.raw
  modified_base (280)..(280): a, c, t, g, unknown or other
  misc_feature (280)..(280): n is a, c, g, or t
  modified_base (286)..(299): a, c, t, g, unknown or other
  misc_feature (286)..(299): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatcttcccgcatctagaatcacgtgtactgagcgggctggcaaggcncatagnnnnnnnnnnnnnn

SEQ ID NO: 47328 - DNA, 290 bp, Homo sapiens; identical to SEQ ID NO: 47294
  misc_feature: GYAE6OF02GQDZD.34.6.A06.1.454.CMB.1.raw
  modified_base (286)..(290): a, c, t, g, unknown or other
  misc_feature (286)..(290): n is a, c, g, or t

SEQ ID NO: 47329 - DNA, 292 bp, Homo sapiens; identical to SEQ ID NO: 46998
  misc_feature: GYAE6OF02I7QJJ.34.6.A06.1.454.CMB.1.raw
  modified_base (286)..(292): a, c, t, g, unknown or other
  misc_feature (286)..(292): n is a, c, g, or t

SEQ ID NO: 47330 - DNA, 386 bp, Homo sapiens
  misc_feature: GYAE6OF02GBKZJ.34.6.A06.1.454.CMB.1.raw
  modified_base (373)..(373): a, c, t, g, unknown or other
  misc_feature (373)..(373): n is a, c, g, or t
  modified_base (379)..(386): a, c, t, g, unknown or other
  misc_feature (379)..(386): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaaggggaccaaggtggaaatcaaacgaactgtggctgcaccatctgtcttcatcttccgccatctgaatcacgtgtactgagcggctggcaaggcncatagnnnnnnnn

SEQ ID NO: 47331 - DNA, 386 bp, Homo sapiens
  misc_feature: GYAE6OF02IJS0T.34.6.A06.1.454.CMB.1.raw
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
  modified_base (381)..(386): a, c, t, g, unknown or other
  misc_feature (381)..(386): n is a, c, g, or t
tcagtacacgtgatcacgaccggtgctcgatttagatctactgacagggccagtcagagtgttaatagcatctacttagcctggtaccagcagaaacctggccaggctcccaggctcctcatctatggtgcatccaccagggccactggtatcccagccaggttcagtggcagtgggtctgggacagaattcactctcaccatcagcagcctgcagtctgaagattttgcagtttattactgtcagcagtataataactggcctccggggacgttcggccaagggaccaaggtggaattcaaacgactgtggctgcaccatctgtcttcatcttcccgccatctgaatcaacgtntactgagcgggctggcaaggcnatgnnnnnn

SEQ ID NO: 47332 - DNA, 292 bp, Homo sapiens
  misc_feature: GYAE6OF02IQUNT.34.6.A06.1.454.CMB.1.raw
  modified_base (286)..(292): a, c, t, g, unknown or other
  misc_feature (286)..(292): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgccatctgaatcacgtgtactgagcgggctggcaaggcgcatagnnnnnnn

SEQ ID NO: 47333 - DNA, 499 bp, Homo sapiens
  misc_feature: GYAE6OF02GFK8P.34.6.A06.1.454.CMB.1.raw
  modified_base (383)..(383): a, c, t, g, unknown or other
  misc_feature (383)..(383): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagatttgcagtgtattactgtcaanagttgttctcacacacgtggacgttcggccaagggaccaaggtggaaatcaaacgactgtaggctgcacatctgtcttcatcttccgccatctgaactcacgtgtactgagtcggg

SEQ ID NO: 47334 - DNA, 512 bp, Homo sapiens
  misc_feature: GYAE6OF02GHB6X.34.6.A06.1.454.CMB.1.raw
  modified_base (508)..(508): a, c, t, g, unknown or other
  misc_feature (508)..(508): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacgcagtcgccagacaccctgtctctgtctccaggggaaagagccaccctctcctgcagggtcagtcagcgttctaacaccgacttcttcgcctggtaccagcagagacctggccaggcctcccaggcctcctcatcttggtgcgtccaccagggccactggcatcccagacaggttcagtggcagtgggtctgggacagacttcactctcaccatcagcagcttgagcctgaagtattttgctagtatattactgtcagcaatatcgagacgcactgtgggcgttcggaccaagggaccaagggtagaaagtcgaaacgaatgtaggactggacaccgatcgtcgtcttactatccttcccgcctactctagaatacacgtntacg

SEQ ID NO: 47335 - DNA, 330 bp, Homo sapiens
  misc_feature: GYAE6OF02IWCXD.34.6.A06.1.454.CMB.1.raw
  modified_base (301)..(330): a, c, t, g, unknown or other
  misc_feature (301)..(330): n is a, c, g, or t
tcagtacacgtgatcacgaccggtgctcgatttagatctactgacagggccccctggcagtccctagacccactgccactgaacctgtctgggacagaacttacactctcaccatcaccagacctggagcctgaagacttttgcaggtgtattacctgtcaacagttggtctcacacaccgtggacgtttcggccaagggacccaaggtggaaatcaaacgacctgtggctgcaccatctgtcttcatcttcccgcatctgaatcacgtgtactgagcgggctggccgaaggcgcataggnnnnnnnnnnnnnnnnnnnnnnnnnnnnnn

SEQ ID NO: 47336 - DNA, 381 bp, Homo sapiens
  misc_feature: GYAE6OF02HKUTI.34.6.A06.1.454.CMB.1.raw
  modified_base (368)..(368): a, c, t, g, unknown or other
  misc_feature (368)..(368): n is a, c, g, or t
  modified_base (374)..(381): a, c, t, g, unknown or other
  misc_feature (374)..(381): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcgaccaagggaccaaggtggaaatcaaacgaactgtggctgcaccatctgtctcatctccgcatctgatcacgtgtactgagcggctggcaaggcncatagnnnnnnnn

SEQ ID NO: 47337 - DNA, 389 bp, Homo sapiens
  misc_feature: GYAE6OF02IGDJ8.34.6.A06.1.454.CMB.1.raw
  modified_base (379)..(389): a, c, t, g, unknown or other
  misc_feature (379)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggcaagggaccaaggtggaaatcaaacgactgtggctgcacatctgtcttcatcttcccgctatctagaactcacgtgtactgagcgggctggcaaggcgcatagnnnnnnnnnnn

SEQ ID NO: 47338 - DNA, 502 bp, Homo sapiens
  misc_feature: GYAE6OF02FPQWJ.34.6.A06.1.454.CMB.1.raw
  modified_base (488)..(488): a, c, t, g, unknown or other
  misc_feature (488)..(488): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtgacgttcgcaagggaccaaggtggaaatcaaacgaactgtggctgcaccatctgtcttcattcttccgcctatcctgactcacgtntactgtagtccggg

SEQ ID NO: 47339 - DNA, 503 bp, Homo sapiens
  misc_feature: GYAE6OF02IR1P1.34.6.A06.1.454.CMB.1.raw
  modified_base (323)..(323): a, c, t, g, unknown or other
  misc_feature (323)..(323): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagccctcccagacctcctcattaatggtgcatactacagggccctggcatcccagacaggttcagtggcagtgggtctggganaggacttcactctcaccatcaccagactggagcctgaagatttgcagtgtattactgtcaacagttgtctcacacacggtgacgttcggccaagggaccaaggtggaaatcgaaacgaactgtggctgcacanctcgtntcatccttccgctatctgaactcacgtgtactgagtccggg

SEQ ID NO: 47340 - DNA, 289 bp, Homo sapiens
  misc_feature: GYAE6OF02HC69G.34.6.A06.1.454.CMB.1.raw
  modified_base (276)..(276): a, c, t, g, unknown or other
  misc_feature (276)..(276): n is a, c, g, or t
  modified_base (281)..(289): a, c, t, g, unknown or other
  misc_feature (281)..(289): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatctccgcatctgaatcagtgtactgagcggctggcaaggcncatannnnnnnnn

SEQ ID NO: 47341 - DNA, 513 bp, Homo sapiens
  misc_feature: GYAE6OF02I9X1D.34.6.A06.1.454.CMB.1.raw
  modified_base (166)..(166): a, c, t, g, unknown or other
  misc_feature (166)..(166): n is a, c, g, or t
  modified_base (506)..(506): a, c, t, g, unknown or other
  misc_feature (506)..(506): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaanagccaccctctcctgcagggccagtcagagtgttaatagcatctacttagcctggtaccagcagaacctggccagcctcccagacctcctcattaatggtgcatactacagggcccctggcatcccagacaggttcagtggcagtgggtctgggacagacttcactctcaccatccaccagactggagcctgaagattttgctagtgtattactgtacaactagttgtctcacacacgtggacgttcggcgaagggaccaaggtaggaaatacgaaacgaacgtgtggctgcaccatctgtcttcactccttcccgctactctgaactcacgtgtactgngtccggg

SEQ ID NO: 47342 - DNA, 507 bp, Homo sapiens
  misc_feature: GYAE6OF02F9QKJ.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatgcatctacttagcctggtaccagcagaacctggccagccctccagacctcctcacttaatggtgcatactacagggcccctgtcatcccagacaggttcagtggcagtgggtctgggacagacttcactctcacatcaccagactggagcctgaagattttgctagtgtattactgtcaactagttggtctcacacacgtgacgttcggccaagggacaaggtggaaatcaaacgactagtgctgcacatctgtcttcacgtcttccgcctatctgaacttcacgttgtactagtaggtccggg

SEQ ID NO: 47343 - DNA, 288 bp, Homo sapiens
  misc_feature: GYAE6OF02FVDEG.34.6.A06.1.454.CMB.1.raw
  modified_base (285)..(288): a, c, t, g, unknown or other
  misc_feature (285)..(288): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagatttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnn

SEQ ID NO: 47344 - DNA, 587 bp, Homo sapiens
  misc_feature: GYAE6OF02IJIJA.34.6.A06.1.454.CMB.1.raw
  modified_base (435)..(435): a, c, t, g, unknown or other
  misc_feature (435)..(435): n is a, c, g, or t
  modified_base (472)..(472): a, c, t, g, unknown or other
  misc_feature (472)..(472): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
tcagtacacgtgatcacgaccggtgctcgatttagatctactgacagggccgagtcagtagtgtttaatagcatctactttagcctggtaccagcaggaaacctggccagacctcccagactccgtcattaagtggtcgcagtaactaactagggccccgtggaccatcccagaccaggttccacgtggccagtggttcctgggacagaccgttccacctctcaccatcaaccagactggagcctcgaacgtacttttagactaagttgtacttactagttctaaacgaagtttgggtaccttcgacaacgaacggtcggaacggtttccggacctaacgggtacccaaagggtgggaaaacttccaaaacggaaacttgtaggtcgttgacacccgattccggtctcttcagttctcccgcatctgaatcagtntaactgagtcggactggaacaggacgacgaagtaggnctgacgatggtaggttatacngacatgcgantcacactcctacacgtcgtacgaggacgagtagagacgtacgaacgaacgtagtgtcgtcgacgacgtactctacgtactctcc

SEQ ID NO: 47345 - DNA, 382 bp, Homo sapiens; identical to SEQ ID NO: 47042
  misc_feature: GYAE6OF02HPAX1.34.6.A06.1.454.CMB.1.raw
  modified_base (372)..(372): a, c, t, g, unknown or other
  misc_feature (372)..(372): n is a, c, g, or t
  modified_base (378)..(382): a, c, t, g, unknown or other
  misc_feature (378)..(382): n is a, c, g, or t

SEQ ID NO: 47346 - DNA, 291 bp, Homo sapiens
  misc_feature: GYAE6OF02IS480.34.6.A06.1.454.CMB.1.raw
  modified_base (279)..(279): a, c, t, g, unknown or other
  misc_feature (279)..(279): n is a, c, g, or t
  modified_base (285)..(291): a, c, t, g, unknown or other
  misc_feature (285)..(291): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgcatctgaatcacgtgtactgagcgggctggcaaggcncatagnnnnnnn

SEQ ID NO: 47347 - DNA, 291 bp, Homo sapiens
  misc_feature: GYAE6OF02JTZUQ.34.6.A06.1.454.CMB.1.raw
  modified_base (277)..(277): a, c, t, g, unknown or other
  misc_feature (277)..(277): n is a, c, g, or t
  modified_base (283)..(291): a, c, t, g, unknown or other
  misc_feature (283)..(291): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtgaaatcaaacgactgtgctgcaccatctgtcttcatcttctcgccatctgaatcacgtgtactgagcggctggcaaggcncatagnnnnnnnnn

SEQ ID NO: 47348 - DNA, 612 bp, Homo sapiens
  misc_feature: GYAE6OF02HKN3W.34.6.A06.1.454.CMB.1.raw
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagtacacgtgatcacgaccggtgctcgatttagatctactgacagggaaccatgggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacaggcccctggcatcccagacagttcagtgcagtggtctgggacagacttcactctcaccatcaccagactggacncctagaagtntttgcgtagtacgttacttacgtcgtacaacgtcggttcgtctacactacgtacggtacggttaccgttaccggacggtaaacggtaacgtaaggtaacgtaaacgtaaccgtaaacgtaacgtaggtacgtacgtaccgtacctaaccgtacgttcgttacggttccttaacgtaccgtttcccgttacccgacttaacttaccgtaacgtaccgttaccgtacggttacgtacggtacggtacggtccgg

SEQ ID NO: 47349 - DNA, 384 bp, Homo sapiens
  misc_feature: GYAE6OF02HSBTX.34.6.A06.1.454.CMB.1.raw
  modified_base (370)..(370): a, c, t, g, unknown or other
  misc_feature (370)..(370): n is a, c, g, or t
  modified_base (376)..(384): a, c, t, g, unknown or other
  misc_feature (376)..(384): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatctcccgcatctgaatcacgtgtactgagcggctggcaggcncatagnnnnnnnnn

SEQ ID NO: 47350 - DNA, 287 bp, Homo sapiens
  misc_feature: GYAE6OF02FFNX1.34.6.A06.1.454.CMB.1.raw
  modified_base (148)..(148): a, c, t, g, unknown or other
  misc_feature (148)..(148): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (286)..(287): a, c, t, g, unknown or other
  misc_feature (286)..(287): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagtatttgcagtgtattacngtcaacagttggtctcacacacgtggacgttcggaccaagggaccaaggtgaatcaaacgactgtggctgcacctatctgtcttcatcttcccgcatctagaatcacgtgtactgagcggntggacaggcncatgntnn

SEQ ID NO: 47351 - DNA, 364 bp, Homo sapiens
  misc_feature: GYAE6OF02FXWCJ.34.6.A06.1.454.CMB.1.raw
  modified_base (359)..(364): a, c, t, g, unknown or other
  misc_feature (359)..(364): n is a, c, g, or t
tcagtacacgtgatcacgaccggtgctcgatttagatctactgacagggaccccgtcggccatccccagacccactcggccaactggaacctgtcgtcgggacagtacttcactcgtcaccgatcaccgagacgtggagccttggaagatttggcaggtgtacttactggtcaacacgttaggtcctaccacactacgtggtacgtttcggtcccaaacgggtaccctaaggttcggaaaacttccgaaaaaccgtaaccttggtagggccggttcgccgacccaagttccgtcgttactttacattcttcccgccatctgaatcacgtgtactgagcgggctggcaaggcgcagtagnnnnnn

SEQ ID NO: 47352 - DNA, 394 bp, Homo sapiens
  misc_feature: GYAE6OF02G7K8E.34.6.A06.1.454.CMB.1.raw
  modified_base (368)..(368): a, c, t, g, unknown or other
  misc_feature (368)..(368): n is a, c, g, or t
  modified_base (374)..(394): a, c, t, g, unknown or other
  misc_feature (374)..(394): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtgacgttcggcaaggccaaggtgaaatcaaacgactgtggctgcaccatctgtcttcatcttcccgcatctgaatcgacgtgtactgagcggtctggcaaggcncatagnnnnnnnnnnnnnnnnnnnnn

SEQ ID NO: 47353 - DNA, 292 bp, Homo sapiens
  misc_feature: GYAE6OF02IZ34R.34.6.A06.1.454.CMB.1.raw
  modified_base (279)..(279): a, c, t, g, unknown or other
  misc_feature (279)..(279): n is a, c, g, or t
  modified_base (285)..(292): a, c, t, g, unknown or other
  misc_feature (285)..(292): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatctcccgcatctgaatcacgtgtactgagcgggctggcaaggcncatagnnnnnnnn

SEQ ID NO: 47354 - DNA, 578 bp, Homo sapiens
  misc_feature: GYAE6OF02INOHM.34.6.A06.1.454.CMB.1.raw
  modified_base (332)..(332): a, c, t, g, unknown or other
  misc_feature (332)..(332): n is a, c, g, or t
tcagtacacgtgatcacgaccggtgctcgatttagatctactgacagggaaccatggaaaccccacgcgcagcttctcttcctcctgctactctggctcccagatatcaccggagaaattgtgttgacacagtctccaggcaccctgtctttgtctccagggggaaagagccaccctctcctgcagggccagtcagagtgttaatagcatctacttagcctggtaccagcagaaacctggccagcctccgagactcctcattaatgtgcatactacacggcccctggcactccagacaggttcagtggcagtgggtctggacagctcactcncaccatcacaagctggagcctagaagatttgacgtagtgtattctagtacactagttgtcgttcaacgacacggtgtaacggttcgaccgaagggaaccgaaggtacggaaatacgaaacgacgtaagtcggtacgagacgaccaagttaccgtgttaccttacgtacttccgtttaccccgcctaacggttaccttaccggtaaattcccgaacggtttaccggtacttacgggaggtcccgggg

SEQ ID NO: 47355 - DNA, 291 bp, Homo sapiens
  misc_feature: GYAE6OF02II4UD.34.6.A06.1.454.CMB.1.raw
  modified_base (287)..(291): a, c, t, g, unknown or other
  misc_feature (287)..(291): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaaacgaactgtggctgcaccatctgtcttcatcttccgccatctgaatcacgtgtactgagcgggctggcaaggcgcatagnnnnn

SEQ ID NO: 47356 - DNA, 291 bp, Homo sapiens
  misc_feature: GYAE6OF02GWS2X.34.6.A06.1.454.CMB.1.raw
  modified_base (287)..(291): a, c, t, g, unknown or other
  misc_feature (287)..(291): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgcatagnnnnn

SEQ ID NO: 47357 - DNA, 389 bp, Homo sapiens
  misc_feature: GYAE6OF02GL7U6.34.6.A06.1.454.CMB.1.raw
  modified_base (382)..(389): a, c, t, g, unknown or other
  misc_feature (382)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaaggggacccaaggtggaaaatcaaacgaactgtggctgcaccatctgtcttcatcttcccgccatctgaatcacgtgtactgagcggctggcaaggcgcatagnnnnnnnn

SEQ ID NO: 47358 - DNA, 287 bp, Homo sapiens
  misc_feature: GYAE6OF02HC0U7.34.6.A06.1.454.CMB.1.raw
  modified_base (283)..(287): a, c, t, g, unknown or other
  misc_feature (283)..(287): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtctcatcttcccgctctgaatcacgtgtactgagcggctggcaaggcgcatagnnnnn

SEQ ID NO: 47359 - DNA, 296 bp, Homo sapiens
  misc_feature: GYAE6OF02JH65J.34.6.A06.1.454.CMB.1.raw
  modified_base (289)..(296): a, c, t, g, unknown or other
  misc_feature (289)..(296): n is a, c, g, or t
tcagtacacgtgatcacgaccggtgctcgatttagatctactgacagggcccctggcatcccagacaggttcagtggcagtgggtttgggacagacttcactctcaccatcaccagactggagcctgaagattttgcagtgtattactgtcaacagttggtctcacacacgtggacgttcggccaagggaccaaggtggaaaatcaaaacgaactgtggctgcaccatctgtcttcatcttcccgccatctgaatcacgtgtactgagcgggctggcaaggcgcatagnnnnnnnn

SEQ ID NO: 47360 - DNA, 299 bp, Homo sapiens
  misc_feature: GYAE6OF02IJF2L.34.6.A06.1.454.CMB.1.raw
  modified_base (290)..(299): a, c, t, g, unknown or other
  misc_feature (290)..(299): n is a, c, g, or t
tcagtacacgtgatcacgaccggtgctcgatttagatctactgacagggcccctggcatccccagaccaggttcagtggcagtgggtctggggacagacttcgactctcaccatcaccagactggagcctgaagatttgcagtgtattactgtcaacagttggtctcacacacgtggacgttcggccaagggaccaaggtggaaatcaaacgaactgtgctgcaccatctgtcttcatcctcccgcatctgaatcacgtgtaactgacgcgggctggcaaggcgcatagnnnnnnnnnn

SEQ ID NO: 47361 - DNA, 306 bp, Homo sapiens
  misc_feature: GYAE6OF02HGWHI.34.6.A06.1.454.CMB.1.raw
  modified_base (285)..(306): a, c, t, g, unknown or other
  misc_feature (285)..(306): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcgcatagnnnnnnnnnnnnnnnnnnnnnn

SEQ ID NO: 47362 - DNA, 391 bp, Homo sapiens
  misc_feature: GYAE6OF02GZP4N.34.6.A06.1.454.CMB.1.raw
  modified_base (369)..(369): a, c, t, g, unknown or other
  misc_feature (369)..(369): n is a, c, g, or t
  modified_base (385)..(391): a, c, t, g, unknown or other
  misc_feature (385)..(391): n is a, c, g, or t
tcagtacacgtgatcacgaccggtgctcgatttagatctactgacagggccagtcagagtgttaatagcatctacttagcctggtaccagcagaaacctggccagcctcccaggctcctcatctatgatgcgtccaacagggccactggcatcccagccaggttcagtggcagtgggtctgggccagacttcactctcaccatcagcagcctagagcctaaagattttgcaatttattactgtcagctgcgtagcaactggcctcccttgagcgccttcggccgagggacacgactggagattaaacgaactgtggctgcaccatctgtcttcatcttcccgcatctgaatcacgtgtactgagcgggntggcaaggcgcatagnnnnnnn

SEQ ID NO: 47363 - DNA, 295 bp, Homo sapiens
  misc_feature: GYAE6OF02HCAYJ.34.6.A06.1.454.CMB.1.raw
  modified_base (286)..(295): a, c, t, g, unknown or other
  misc_feature (286)..(295): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcggctggcaaggcgcatagnnnnnnnnnn

SEQ ID NO: 47364 - DNA, 290 bp, Homo sapiens
  misc_feature: GYAE6OF02HRB5S.34.6.A06.1.454.CMB.1.raw
  modified_base (282)..(290): a, c, t, g, unknown or other
  misc_feature (282)..(290): n is a, c, g, or t
tcagtacacgtgatcacgaccggtgctcgatttagatctactgacagggcccctggcatcccagacaggttcagtggcagtgggtctgggacagacttcactctcaccatcagcagacttgagcctgaagattttgcagtatattactgtcagcaatatcgagacgcactgtgggcgttcggccaagggaccaaggtggaaatcaaacgactgtggctgcacatctgtcttcatctccgcatctgaatcacgtgtactgagcgggctggcaaggcgcatagnnnnnnnnn

SEQ ID NO: 47365 - DNA, 297 bp, Homo sapiens
  misc_feature: GYAE6OF02I3QRR.34.6.A06.1.454.CMB.1.raw
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (288)..(291): a, c, t, g, unknown or other
  misc_feature (288)..(291): n is a, c, g, or t
  modified_base (293)..(297): a, c, t, g, unknown or other
  misc_feature (293)..(297): n is a, c, g, or t
tcagtacacgtgatcacgaccggtgctcgatttagatctactgacagggccctggcatcccagacaggttcagtggcagtgggtctgggacaggacttcactctcaccatcaccagactggagcctgaagatttgctagtgtattactgtcaacagttggtctcacacacgtggacgttcggccaagggaccaaggtggaaatcaaacgaactgtggctagcaccatctgtcttnatcttccgcctatctgaatcacgtntactgagtcggntggcaagcgcaagtgnnnncnnnnn

SEQ ID NO: 47366 - DNA, 381 bp, Homo sapiens
  misc_feature: GYAE6OF02JEXBT.34.6.A06.1.454.CMB.1.raw
  modified_base (376)..(381): a, c, t, g, unknown or other
  misc_feature (376)..(381): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaattaaacgaactgtggctgcacatctgtcttcatcttccgcatctgaatcacgtgtactgagcgggctggcaggcgcatagnnnnnn

SEQ ID NO: 47367 - DNA, 383 bp, Homo sapiens; identical to SEQ ID NO: 46997
  misc_feature: GYAE6OF02F4YW5.34.6.A06.1.454.CMB.1.raw
  modified_base (379)..(383): a, c, t, g, unknown or other
  misc_feature (379)..(383): n is a, c, g, or t

SEQ ID NO: 47368 - DNA, 384 bp, Homo sapiens
  misc_feature: GYAE6OF02I6DWZ.34.6.A06.1.454.CMB.1.raw
  modified_base (248)..(248): a, c, t, g, unknown or other
  misc_feature (248)..(248): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
  modified_base (381)..(384): a, c, t, g, unknown or other
  misc_feature (381)..(384): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagatttgcagtgtattactgtcaaacngttggtctcacactacgtggacgttcggaccaagggaccaaggtggaaatcgaaacgaactgtaggctgcaccatctgtcttcatcttcccgcatctagaatcacgtntactgagcggctgcaaggcnaatgnnnn

SEQ ID NO: 47369 - DNA, 294 bp, Homo sapiens
  misc_feature: GYAE6OF02FL4FO.34.6.A06.1.454.CMB.1.raw
  modified_base (288)..(294): a, c, t, g, unknown or other
  misc_feature (288)..(294): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaaacgaactgtggctgcaccatctgtcttcatcttcccgccatctgaatcacgtgtactgagcgggctggcaaggcgcatagnnnnnnn

SEQ ID NO: 47370 - DNA, 297 bp, Homo sapiens
  misc_feature: GYAE6OF02JCZIQ.34.6.A06.1.454.CMB.1.raw
  modified_base (286)..(297): a, c, t, g, unknown or other
  misc_feature (286)..(297): n is a, c, g, or t
tcagtacacgtgatcacgaccggtgctcgatttagatctactgacagggcccctggcatcccagaccaggttcagtggcagtgggtctgggacagacttcgactctcaccatcaccagactggagcctgaagattttgcagtgtattactgtcaacagttggtctcacacacgtggacgttcggccaagggaccaaggtggaaatcaaacgaactgtggctgcacatctgtcttcatcttccgcatctgaatcacgtgtactgacgcggctggcaaggcgcatagnnnnnnnnnnnn

SEQ ID NO: 47371 - DNA, 530 bp, Homo sapiens
  misc_feature: GYAE6OF02I7ATE.34.6.A06.1.454.CMB.1.raw
  modified_base (479)..(479): a, c, t, g, unknown or other
  misc_feature (479)..(479): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagacctcctcattaatggtgcatactacagggcccctggcatcccagacaggttcaggtgcaggtggtctgggacagacttcactctcacatcaccagactggacgcctagaagtattttgctagttgtattactgtacaacgtgttgtctcacacgacgtggtacgtcggcaagggaccaaggtcggaaatcgaaacgtacgtggtagctacgcacattcgtgtcttacncttccttcccgacctacttctagtaactcgtacgtagtactggagtccggg

SEQ ID NO: 47372 - DNA, 391 bp, Homo sapiens
  misc_feature: GYAE6OF02GN8WU.34.6.A06.1.454.CMB.1.raw
  modified_base (375)..(375): a, c, t, g, unknown or other
  misc_feature (375)..(375): n is a, c, g, or t
  modified_base (381)..(391): a, c, t, g, unknown or other
  misc_feature (381)..(391): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaagggcncatagnnnnnnnnnnn

SEQ ID NO: 47373 - DNA, 387 bp, Homo sapiens
  misc_feature: GYAE6OF02H5CO5.34.6.A06.1.454.CMB.1.raw
  modified_base (380)..(387): a, c, t, g, unknown or other
  misc_feature (380)..(387): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcgaccaaagggaccaaggtggaaatcaaaacgaactgtggctgcacatctgtcttcatcttcccgcatctgaatcacgtgtactgacgcggctggcaaggcgcatagnnnnnnnn

SEQ ID NO: 47374 - DNA, 290 bp, Homo sapiens
  misc_feature: GYAE6OF02G3MQI.34.6.A06.1.454.CMB.1.raw
  modified_base (286)..(290): a, c, t, g, unknown or other
  misc_feature (286)..(290): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatctcccgccatctgaatcacgtgtactgagcgggctggcaaggcgcatagnnnnn

SEQ ID NO: 47375 - DNA, 602 bp, Homo sapiens
  misc_feature: GYAE6OF02H63L1.34.6.A06.1.454.CMB.1.raw
  modified_base (333)..(333): a, c, t, g, unknown or other
  misc_feature (333)..(333): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacacgggccctggcatcccagacaggttcagtgcaggtgggtcgtgggacagactcactcncaccatcaccagactggacgcgtagtaagtattttgacgtagttgtacgtttacgtcgtactaaacgtagttaggtctacgtacacgtacggttacggacgtttaccgggaccgaacgggaaccgtaaagggtaggaaaacgtaccgaaaaccgaacgtacggtaggacttagacctaaccattcgtgttccgttactaccgttcgttaccccgtacacttaccgtagtacgttaccgtaccgttacggtacgttacggtaggtccggg

SEQ ID NO: 47376 - DNA, 517 bp, Homo sapiens
  misc_feature: GYAE6OF02F1L00.34.6.A06.1.454.CMB.1.raw
  modified_base (391)..(391): a, c, t, g, unknown or other
  misc_feature (391)..(391): n is a, c, g, or t
  modified_base (504)..(504): a, c, t, g, unknown or other
  misc_feature (504)..(504): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagccctcccagacctcctcattaatggtgcatactacagggcccctggcatcccagacaggttcagtggcagtgggtctgggacagacgttcactctcaccatcaccagactggacgcctgaagtattttgctagtgtattactgtcaacngttggtctcacacacgtggacgttcggaccgaagggaccaaggtggaaatcgaaacgactagtggctgcaccatctgtctcattcctcccgcctactctagacttcgacgttntacgtgagtcggg

SEQ ID NO: 47377 - DNA, 293 bp, Homo sapiens
  misc_feature: GYAE6OF02GZQZE.34.6.A06.1.454.CMB.1.raw
  modified_base (278)..(278): a, c, t, g, unknown or other
  misc_feature (278)..(278): n is a, c, g, or t
  modified_base (284)..(293): a, c, t, g, unknown or other
  misc_feature (284)..(293): n is a, c, g, or t
tcagtacacgtgatcacgaccggtgctcgatttagatctactgacagggcccctggcatcccagacaggttcagtggcagtgggtctgggacagacttcactctcaccatcagcagacttgagcctgaagattttgcagtatattactgtcagcaatatcgagacgcactgtgggcgttcggccaagggaccaaggtggaaatcaaacgactgtggctgcacatctgtctcatcttcccgcatctgaactcacgtgtactgagcgggctggcaaggcncatagnnnnnnnnnn

SEQ ID NO: 47378 - DNA, 513 bp, Homo sapiens
  misc_feature: GYAE6OF02HQOFT.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaaatggtgcatactacaggccctggcatcccagacaggttcagtgcagtgggtctgggacagacttcactctcaccatcaccagactggagcctgaagtattttgcagtgtattactgtacaacagttggtctcacacacgtggacgttcgctaaagggaccaaggtaggaaatacaaacgaactagtggctagcaacatctgtcttcatcttcccgccattcctagtatcacgtacgtactcgagtccggg

SEQ ID NO: 47379 - DNA, 494 bp, Homo sapiens
  misc_feature: GYAE6OF02FSX32.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacttcggccaagggaccaaggtgaaatcaaacgactgtggctgcaccatctgtctcatctcccgccatctgatcacgtgtactgagtcggg

SEQ ID NO: 47380 - DNA, 386 bp, Homo sapiens
  misc_feature: GYAE6OF02FQ3OL.34.6.A06.1.454.CMB.1.raw
  modified_base (373)..(373): a, c, t, g, unknown or other
  misc_feature (373)..(373): n is a, c, g, or t
  modified_base (379)..(386): a, c, t, g, unknown or other
  misc_feature (379)..(386): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaaacgaactgtggctgcacatctgtctcatcttcccgccatctgaatcacgtgtactgagcgggctggcaaggcncatagnnnnnnnn

SEQ ID NO: 47381 - DNA, 302 bp, Homo sapiens
  misc_feature: GYAE6OF02JU10M.34.6.A06.1.454.CMB.1.raw
  modified_base (155)..(155): a, c, t, g, unknown or other
  misc_feature (155)..(155): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (290)..(302): a, c, t, g, unknown or other
  misc_feature (290)..(302): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacngttggtctcacacacgtggacgttcggccaagggccaaggtggaaatcaaacgactgtgctagcaccatctgtcttcatctcccgctatctagaatcacgtgtactgagcgggctggcaaggcgcagtagncngnnnnnnnnnnnnn

SEQ ID NO: 47382 - DNA, 525 bp, Homo sapiens
  misc_feature: GYAE6OF02GPJM1.34.6.A06.1.454.CMB.1.raw
  modified_base (322)..(322): a, c, t, g, unknown or other
  misc_feature (322)..(322): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagactcctcattaatggtgcatactacagggcccctggcatcccagacaggttcagtggcagtggtctgggacngacttcactctcaccatcaccagactggacgcctgaagtatttgctagtgtattactgtacaactagttggtctcactacacgtggacgttcggaccgaagggaccgaaggtacggaaatcgaaacgtactgtacgctgcactatctgtcttcacgtccttcccgtcctacgaactcgtacgtgtacgtgacgcggtctacgg

SEQ ID NO: 47383 - DNA, 499 bp, Homo sapiens
  misc_feature: GYAE6OF02IBJDP.34.6.A06.1.454.CMB.1.raw
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
tcagtacacgtgatcacgaccggtgctcgatttagatctactgacagggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctccaggctcctcatctatggtgcactcccaccgacgggccactcggtactccccagccaggttcagtggcaggtgggtctgggacagaattcactctcaccatcagcacgcctgccagtctagaagtattttgctaagttttatactgtcagcagtataattactgtccgtccgggtacgttcggacgaagggaccaaggtgaagttacaagactgtcgctgcacntcgtntctntctctccncnctctgatcagtcg

SEQ ID NO: 47384 - DNA, 292 bp, Homo sapiens
  misc_feature: GYAE6OF02GVG3D.34.6.A06.1.454.CMB.1.raw
  modified_base (287)..(292): a, c, t, g, unknown or other
  misc_feature (287)..(292): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaaacgaactgtggctgcaccatctgtcttcatcttcccgcatctgaatcacgtgtactgagcgggctggcaaggcgcatagnnnnnn

SEQ ID NO: 47385 - DNA, 521 bp, Homo sapiens
  misc_feature: GYAE6OF02IHYON.34.6.A06.1.454.CMB.1.raw
  modified_base (263)..(263): a, c, t, g, unknown or other
  misc_feature (263)..(263): n is a, c, g, or t
  modified_base (446)..(446): a, c, t, g, unknown or other
  misc_feature (446)..(446): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaacctggccagcctcccagacctcctcattaanggtgcatactacagggcccctggcatcccagacaggttcagtgcagtgggtctgggacagactcactctcaccatcacagctggacgcctgaagtatttgctagtgtattactgtacaactagttggtctcacacacgtggtacgttcggacaagggacctaaggtgaaatcaaacgactagngctgcaccatcgtgtcttcacgttcttcccgtcacttctagtaacttccgacgttcggtacttaggacggtcggg

SEQ ID NO: 47386 - DNA, 309 bp, Homo sapiens
  misc_feature: GYAE6OF02H0EEW.34.6.A06.1.454.CMB.1.raw
  modified_base (279)..(279): a, c, t, g, unknown or other
  misc_feature (279)..(279): n is a, c, g, or t
  modified_base (284)..(309): a, c, t, g, unknown or other
  misc_feature (284)..(309): n is a, c, g, or t
tcagtacacgtgatcacgaccggtgctcgatttagatctactgacagggccccgtggcatcccagacaggttcagtggcagtgggtctgggacagacttcactctcaccatcaccagactggagcctgaagattttgcagtgtattactgtcaacgagttggtctcacacacgtggacgttcgccaagggaccaaggtggaaatcaaacgaactgtaggctgcaccatctgtcttcatcttccgcatctgaatcacgtgactgagcggctggcaaggcnagtgnnnnnnnnnnnnnnnnnnnnnnnnnn

SEQ ID NO: 47387 - DNA, 293 bp, Homo sapiens
  misc_feature: GYAE6OF02GHAUO.34.6.A06.1.454.CMB.1.raw
  modified_base (287)..(293): a, c, t, g, unknown or other
  misc_feature (287)..(293): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatccttcccgcatctgaatcacgtgtactgagcgggctggcaaggcgcatagnnnnnnn

SEQ ID NO: 47388 - DNA, 289 bp, Homo sapiens
  misc_feature: GYAE6OF02FVOVZ.34.6.A06.1.454.CMB.1.raw
  modified_base (284)..(289): a, c, t, g, unknown or other
  misc_feature (284)..(289): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatcttcccgcatctgaatcacgtgtactgagcgggctggcaggcgcatagnnnnnn

SEQ ID NO: 47389 - DNA, 391 bp, Homo sapiens
  misc_feature: GYAE6OF02GOB93.34.6.A06.1.454.CMB.1.raw
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (379)..(391): a, c, t, g, unknown or other
  misc_feature (379)..(391): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcaacacacgtggacgttcggccaagggaccaaggtggaaatcaaacgaactgtggctgcaccatctgtcttcatcttccgcatctgaatcacgtntactgagcggctggcaaggccgnatagnnnnnnnnnnnnn

SEQ ID NO: 47390 - DNA, 384 bp, Homo sapiens
  misc_feature: GYAE6OF02JGBP6.34.6.A06.1.454.CMB.1.raw
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
  modified_base (376)..(384): a, c, t, g, unknown or other
  misc_feature (376)..(384): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatctcccgcatctgaatcagtntactgagcggctggcaaggcncatagnnnnnnnnn

SEQ ID NO: 47391 - DNA, 294 bp, Homo sapiens
  misc_feature: GYAE6OF02G5OXW.34.6.A06.1.454.CMB.1.raw
  modified_base (289)..(294): a, c, t, g, unknown or other
  misc_feature (289)..(294): n is a, c, g, or t
tcagtacacgtgatcacgaccggtgctcgatttagatctactgacagggcccctggcatcccagaccagttcacgtgcacgtggtctgggacagacttcactctcaccatcaccagactggagcctgaagattttgcagtgtattactgtcagcaatatcgagacgcactgtgggcgttcggccaagggaccaaaggtggaaatcaaaacgaactgtggctgcaccatctgtcttcatcttcccgcatctgaatcacgtgtactgagcgggctggcaaggcgacatagnnnnnn

SEQ ID NO: 47392 - DNA, 302 bp, Homo sapiens
  misc_feature: GYAE6OF02HPU48.34.6.A06.1.454.CMB.1.raw
  modified_base (283)..(283): a, c, t, g, unknown or other
  misc_feature (283)..(283): n is a, c, g, or t
  modified_base (289)..(302): a, c, t, g, unknown or other
  misc_feature (289)..(302): n is a, c, g, or t
tcagtacacgtgatcacgaccggtgctcgatttagatctactgacagggcccctggcatcccagacaggttcagtcggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtctcattcttccgcatctgaaatcaacgtgtactgacgcgggctggcaaggcncatagnnnnnnnnnnnnnn

SEQ ID NO: 47393 - DNA, 389 bp, Homo sapiens
  misc_feature: GYAE6OF02G9JC1.34.6.A06.1.454.CMB.1.raw
  modified_base (380)..(389): a, c, t, g, unknown or other
  misc_feature (380)..(389): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctggggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnnnnnnn

SEQ ID NO: 47394 - DNA, 383 bp, Homo sapiens
  misc_feature: GYAE6OF02IY5HJ.34.6.A06.1.454.CMB.1.raw
  modified_base (378)..(383): a, c, t, g, unknown or other
  misc_feature (378)..(383): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacttcggccaagggaccaaagggtggaaatcaaacgaactgtggctgcaccatctgtcttcatcttcccgcatctgaatcacgtgtactgagcggctggcaaggcgcatgnnnnnn

SEQ ID NO: 47395 - DNA, 383 bp, Homo sapiens
  misc_feature: GYAE6OF02IX21M.34.6.A06.1.454.CMB.1.raw
  modified_base (375)..(383): a, c, t, g, unknown or other
  misc_feature (375)..(383): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagatttcactctcaccatcaccagcctgcagcctgaagatgtggcagtttatactgtcagcaatattatagtcctcgctcactttcggcggagggaccaaggtggagatcaaacgactgtgctgcacatctgtctcatcctccgctatctgaactcacgtgtactggagcgggctggcaaggcgcatagnnnnnnnnn

SEQ ID NO: 47396 - DNA, 296 bp, Homo sapiens
  misc_feature: GYAE6OF02INVP5.34.6.A06.1.454.CMB.1.raw
  modified_base (288)..(296): a, c, t, g, unknown or other
  misc_feature (288)..(296): n is a, c, g, or t
tcagtacacgtgatcacgaccggtgctcgatttagatctactgacagggcccctggcatcccagacaggttcagtggcagtgggtctgggacagacttcgactctcaccatcaccagactggagcctgaagattttgcagtgtattactgtcaacagttggtctcacacacgtggacgttcggccaagggaccaaggtggaaatcaaacgaactgtggctgcaccatctgtcttcatccttccgccatctgaatcacgtgtactgagcgggctggcaaggcgcatagnnnnnnnnn

SEQ ID NO: 47397 - DNA, 298 bp, Homo sapiens
  misc_feature: GYAE6OF02GCX6F.34.6.A06.1.454.CMB.1.raw
  modified_base (286)..(298): a, c, t, g, unknown or other
  misc_feature (286)..(298): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggccaaggtggaaatcaaacgaactgtggctgcaccatctgtcttcatcttcccgccatctgaatcacgtgtactgagcgggctggcaaggcgcatagnnnnnnnnnnnnn

SEQ ID NO: 47398 - DNA, 644 bp, Homo sapiens
  misc_feature: GYAE6OF02JJ1BP.34.6.A06.1.454.CMB.1.raw
  modified_base (332)..(332): a, c, t, g, unknown or other
  misc_feature (332)..(332): n is a, c, g, or t
tcagtacacgtgatcacgaccggtgctcgatttagatctactgacagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgtacttcttcgcctggtaccagcagagacctggccaggctcccgaggcctcctcactctttggtgcgtccaccgagggcccactggcactcccagacaggttcaggtggcaggtgggtcgtggacngactcactctcaccatcagcagacttgacgctgaagtatttgctagtagtatttaactgtctagactaatactacgtagacgtactacgttggtgggtaccgttccgggacccgtaaacgggacccgtaagggtacggtaaacgtaaccgaaaacggtaaccgttaggtcgggacgttacggaccgtaaccgtaaccgttccgttacggttccttttaaccgtaccgtttacccgttacccccggtacccttaacgttaccgttacgtaaaccgtttacccggtaacggtttaccgttaacggttaccgggg

SEQ ID NO: 47399 - DNA, 388 bp, Homo sapiens
  misc_feature: GYAE6OF02HXBL4.34.6.A06.1.454.CMB.1.raw
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (381)..(388): a, c, t, g, unknown or other
  misc_feature (381)..(388): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgcagtgtattactgtcaacagttggtctcacacacgtggacgttcggccaagggaccaaggtggaaatcaaacgaactgtgctgcacatctgtcttcattcctccgctactctgaatcacgtntactgaggcggcnggcaaggcgcaatagnnnnnnnn

SEQ ID NO: 47400 - DNA, 385 bp, Homo sapiens
  misc_feature: GYAE6OF02HL5H0.34.6.A06.1.454.CMB.1.raw
  modified_base (373)..(373): a, c, t, g, unknown or other
  misc_feature (373)..(373): n is a, c, g, or t
  modified_base (379)..(385): a, c, t, g, unknown or other
  misc_feature (379)..(385): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaagggtggaaatcaaacgaactgtggctgcaccatctgtcttcactcttcccgcatctgaatcacgtgtactgagcggctggcaggcncatagnnnnnnn

SEQ ID NO: 47401 - DNA, 506 bp, Homo sapiens
  misc_feature: GYAE6OF02GMVYY.34.6.A06.1.454.CMB.1.raw
  modified_base (493)..(493): a, c, t, g, unknown or other
  misc_feature (493)..(493): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatgtgcatactacagggcccctggcatcccagacaggttcagtggcagtgggtctgggacagacttcactctcaccatcaccagactggagcctgaagattttgcagtgtattactgtcaacagttggtctcacacacgtggacgtttcggccaagggaccaaaggtggaaattcgaaacgaactgtggctgcaccatctagtcttcatcttcccggccatctgaatcacgtntactagagtcggg

SEQ ID NO: 47402 - DNA, 292 bp, Homo sapiens
  misc_feature: GYAE6OF02JA2TH.34.6.A06.1.454.CMB.1.raw
  modified_base (280)..(280): a, c, t, g, unknown or other
  misc_feature (280)..(280): n is a, c, g, or t
  modified_base (285)..(292): a, c, t, g, unknown or other
  misc_feature (285)..(292): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcggctggcaaggcgnatagnnnnnnnn

SEQ ID NO: 47403 - DNA, 555 bp, Homo sapiens
  misc_feature: GYAE6OF02I0S00.34.6.A06.1.454.CMB.1.raw
  modified_base (166)..(166): a, c, t, g, unknown or other
  misc_feature (166)..(166): n is a, c, g, or t
  modified_base (486)..(486): a, c, t, g, unknown or other
  misc_feature (486)..(486): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaangccaccctctcctgcagggccagtcagagtgttaatagcatctacttagcctggtaccagcagaaacctggccagccctccagacctcctcattaatggtgcatactacaggcccctggcatcccagacaggttcaggtggcagtgggtcgtgggacagacttcactctcacctatcaccagactggagccgtgaagtattttgctagttgtacttacgtgtacaactgttgtctctacacgacgtggtacgttcggaccgtaagggaccaagggtacgaaagtacgaaacgtaacgtgtagacgtgaccactatcgttntcttactacgttccttacccgacctacttcctagtaacctcgtaaccgttcgtaacgtcgaggtccggg

SEQ ID NO: 47404 - DNA, 291 bp, Homo sapiens
  misc_feature: GYAE6OF02JAQL2.34.6.A06.1.454.CMB.1.raw
  modified_base (287)..(291): a, c, t, g, unknown or other
  misc_feature (287)..(291): n is a, c, g, or t
tcagtacacgtgatcacgaccggtgctcgatttagatctactgacagggcccctggcatcccagacaggttaagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgcatagnnnnn

SEQ ID NO: 47405 - DNA, 386 bp, Homo sapiens
  misc_feature: GYAE6OF02HD8DI.34.6.A06.1.454.CMB.1.raw
  modified_base (370)..(370): a, c, t, g, unknown or other
  misc_feature (370)..(370): n is a, c, g, or t
  modified_base (376)..(386): a, c, t, g, unknown or other
  misc_feature (376)..(386): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcacatctgtcttcatccttcccgcatctgatcacgtgtactgagcgggctggcaggcncatagnnnnnnnnnnn

SEQ ID NO: 47406 - DNA, 577 bp, Homo sapiens
  misc_feature: GYAE6OF02HOCEO.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacacgggcccctggcactcccagactaggtcgagtggcgtaggtgggtctgggacagtacttcactctccaccactacaccagacgtggacgccgtagtaagtattttcgactagttagtattacgtgtacgaactaggttcgtctacacgacgtacggtggtaccggttcggaccgtaaacgggaaccgaagggtacggtaaagtaccgaaacgtacgtagtggtacgtgaccactagttactcgttcttacgtacgttcctcccgactactactagtactcgtacgtgtacgtcggaggtcgg

SEQ ID NO: 47407 - DNA, 384 bp, Homo sapiens
  misc_feature: GYAE6OF02GWVK9.34.6.A06.1.454.CMB.1.raw
  modified_base (377)..(384): a, c, t, g, unknown or other
  misc_feature (377)..(384): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatcttcccgcatctgatcacgtgtactgagcgggctggcaaggcgcatagnnnnnnnn

SEQ ID NO: 47408 - DNA, 526 bp, Homo sapiens
  misc_feature: GYAE6OF02GP07Q.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaagagccaccctctcctgcagggccagtcagagtgttaatagcatctacttagcctggtaccagcagaaacctggccagcctcccagactcctcattaatggtgcatactacagggccccctggcatcccagacaggttcaggtggcagtgggtctgggacagacttcactctcaccatcaccagactggagcctgaagtatttgctagtgtattactgtcaactgttggtctcacacacgtggtacgttcgggaccaaggggaccaagggtaggaaatcgaaacgactgtggctagccacatctgtcttcacttccttcccgcctattcctagaacttccacgttcgtacctggacgtccggg

SEQ ID NO: 47409 - DNA, 668 bp, Homo sapiens
  misc_feature: GYAE6OF02IQUFM.34.6.A06.1.454.CMB.1.raw
  modified_base (204)..(204): a, c, t, g, unknown or other
  misc_feature (204)..(204): n is a, c, g, or t
  modified_base (368)..(368): a, c, t, g, unknown or other
  misc_feature (368)..(368): n is a, c, g, or t
tcagtacacgtgatcacgaccggtgctcgatttagatctactgacagggaaccatggaaacccagcgcagcttctcttcctcctgctactctggctcccagatatcaccggagaaattgtgttgacacagtctccaggcaccctgtctttgtctccaggggaaagagcccacctctcctgcaagggcctagtcagagtgttaanagcatcgtattagctggtaccagcagaacctggaccagcctcccgagcctcctcactaatgtgcatactacacggcccgtcggacactacccagactacggtacagtcggcgagtgggtcgtgggactaggacttcgactctaccactactaccacagtaacgnggacgtacccgtagtaagtagttttacgacgtagttagtacttaacgtacgtaacgtaacgttacggttcggtacttaccgaacgtacgaacggttcgggtaaccggtttcgggacccggtaaacgggtaccgaaccgggtaaaggtaaacgtaaccgtaaacgtaacccggttagacggtacgtacgggacctaaccgtagtaacccgttgtacccgtttactacgttaacccgtcccggtacctaacgtcgttaaccgtatacccgtacggttaggtaaccgttacggagggtaccgg

SEQ ID NO: 47410 - DNA, 295 bp, Homo sapiens
  misc_feature: GYAE6OF02HQ2KT.34.6.A06.1.454.CMB.1.raw
  modified_base (278)..(278): a, c, t, g, unknown or other
  misc_feature (278)..(278): n is a, c, g, or t
  modified_base (284)..(285): a, c, t, g, unknown or other
  misc_feature (284)..(285): n is a, c, g, or t
  modified_base (287)..(295): a, c, t, g, unknown or other
  misc_feature (287)..(295): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtctcatcttccgcatctgaatcacgtgtactgagcgggctggcaaggcncatagnngnnnnnnnnn

SEQ ID NO: 47411 - DNA, 290 bp, Homo sapiens
  misc_feature: GYAE6OF02F2PO8.34.6.A06.1.454.CMB.1.raw
  modified_base (284)..(290): a, c, t, g, unknown or other
  misc_feature (284)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaaacgaactgtggctgcaccatctgtcttcatcttcccgcatctgaatcacgtgtactgagcggctggcaggcgcatgnnnnnnn

SEQ ID NO: 47412 - DNA, 382 bp, Homo sapiens
  misc_feature: GYAE6OF02ISS1G.34.6.A06.1.454.CMB.1.raw
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
  modified_base (378)..(382): a, c, t, g, unknown or other
  misc_feature (378)..(382): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatccttcccgctatctgatcacgtntactgagcggctggcaaggcncatagnnnnn

SEQ ID NO: 47413 - DNA, 299 bp, Homo sapiens
  misc_feature: GYAE6OF02HCWJN.34.6.A06.1.454.CMB.1.raw
  modified_base (257)..(257): a, c, t, g, unknown or other
  misc_feature (257)..(257): n is a, c, g, or t
  modified_base (287)..(299): a, c, t, g, unknown or other
  misc_feature (287)..(299): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagttgtattactgtcaacagttggtctcacacacgtggacgttcggaccaagggaccaaggtggaaatcaaacgaactgtggctgcaccatctgtctcatctccgcatctgaatcacgtntactgagcggctggcaaggcgacagtacgnnnnnnnnnnnnn

SEQ ID NO: 47414 - DNA, 336 bp, Homo sapiens
  misc_feature: GYAE6OF02F93VD.34.6.A06.1.454.CMB.1.raw
  modified_base (302)..(336): a, c, t, g, unknown or other
  misc_feature (302)..(336): n is a, c, g, or t
tcagtacacgtgatcacgaccggtgctcgatttagatctactgacagggccccctggcatccccagaccagttcacgtggcacgtgggtctggggacagaccttcgacctctcaccatcaccagactggagcctgaagattttgcagtgtattactgtcaacagttgctcacacacgtggtaccgttcggccaagggaccaaggtggaaatccaaacgactgtggctgacacctattctgtcttcattccttcccgcatctgaactcacgtgtaactgacgcgggctggcaaggcgcagtgnnnnnnnnnnnnnnnnnnnnnnnnnnnnnnnnnnn

SEQ ID NO: 47415 - DNA, 350 bp, Homo sapiens
  misc_feature: GYAE6OF02J19MD.34.6.A06.1.454.CMB.1.raw
  modified_base (162)..(162): a, c, t, g, unknown or other
  misc_feature (162)..(162): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (308)..(311): a, c, t, g, unknown or other
  misc_feature (308)..(311): n is a, c, g, or t
  modified_base (313)..(318): a, c, t, g, unknown or other
  misc_feature (313)..(318): n is a, c, g, or t
  modified_base (320)..(320): a, c, t, g, unknown or other
  misc_feature (320)..(320): n is a, c, g, or t
  modified_base (322)..(323): a, c, t, g, unknown or other
  misc_feature (322)..(323): n is a, c, g, or t
  modified_base (326)..(327): a, c, t, g, unknown or other
  misc_feature (326)..(327): n is a, c, g, or t
  modified_base (329)..(350): a, c, t, g, unknown or other
  misc_feature (329)..(350): n is a, c, g, or t
tcagtacacgtgatcacgaccggtgctcgatttagatctactgacagggccctggcagtcccagacaggttcagtggcgagtgggtcctgggacaggacttcactcgtccaccatcacctagactggagcctgaagattttgcagtgttattactgtcaacngttggtctcacacacgtggacgttcggccaagggacctaaggtggaaatcaaagaactgnggctagcaccatcngtctnatcttccgcagttccngaactcacggtatgaagcgggctggcaaggtcnataggctangnttcgatnnnnannnnnnantnntanntnnnnnnnnnnnnnnnnnnnnnn

SEQ ID NO: 47416 - DNA, 310 bp, Homo sapiens
  misc_feature: GYAE6OF02GRZXF.34.6.A06.1.454.CMB.1.raw
  modified_base (279)..(279): a, c, t, g, unknown or other
  misc_feature (279)..(279): n is a, c, g, or t
  modified_base (295)..(310): a, c, t, g, unknown or other
  misc_feature (295)..(310): n is a, c, g, or t
tcagtacacgtgatcacgaccggtgctcgatttagatctactgacagggcccctggcatcccagacaggttcagtggcagtgggtctgggacagacttcgactctcaccatcaccagactggagcctgaagattttgcagtgtattactgtcaaacagttggtctcacacacgtggacgttcggccaagggaccaaggtggaaatcaaaacgaactgtggctagcaccatctgtcttcatccttcccgcatctgaactcgacgtgtactgacgccgggntggcaaggcgacatgnnnnnnnnnnnnnnnn

SEQ ID NO: 47417 - DNA, 387 bp, Homo sapiens
  misc_feature: GYAE6OF02I6RR0.34.6.A06.1.454.CMB.1.raw
  modified_base (378)..(378): a, c, t, g, unknown or other
  misc_feature (378)..(378): n is a, c, g, or t
  modified_base (384)..(387): a, c, t, g, unknown or other
  misc_feature (384)..(387): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatcctgaactcacgtcgtactgaggcggctgggcaaggcncatagnnnn

SEQ ID NO: 47418 - DNA, 327 bp, Homo sapiens
  misc_feature: GYAE6OF02IJZ7I.34.6.A06.1.454.CMB.1.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (294)..(327): a, c, t, g, unknown or other
  misc_feature (294)..(327): n is a, c, g, or t
tcagtacacgtgatcacgaccggtgctcgatttagatctactgacaggggcccctggcatcccagacccactgccactgaacctgtctgggacagacttcactctcaccatcaccagactggagcctgaagattttgcagtgtattactgtcaactagttggtctcacactacgtggacgttcggccaagggaccaaggtggaaatcaaacgaactgtggctgcaccatctgtcttcattccttccgcctatctgaatcacgtgtactgagcggntggacaaggcgcatagnannnnnnnnnnnnnnnnnnnnnnnnnnnnnnnnnn

SEQ ID NO: 47419 - DNA, 538 bp, Homo sapiens
  misc_feature: GYAE6OF02GJT20.34.6.A06.1.454.CMB.1.raw
  modified_base (375)..(375): a, c, t, g, unknown or other
  misc_feature (375)..(375): n is a, c, g, or t
  modified_base (480)..(480): a, c, t, g, unknown or other
  misc_feature (480)..(480): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagccctccagacctcctcattaatggtgcatactacacgggcccctggcactcccagacaggttcagtggcaggtgggtctgggacagacttcactctcaccatcaccagctggagcctgaagtatttgctagtntattactgtacaactagttggtctacacacgtacgtggtacgttccggacgaacgggaccgaaggtaggaaactacgaaacgacgtcgtagctgcacctatcgtnttctacacttccttcccgctacttctagaactcgtacgtacgtacgtcgaggtccggg

SEQ ID NO: 47420 - DNA, 409 bp, Homo sapiens
  misc_feature: GYAE6OF02FXI14.34.6.A06.1.454.CMB.1.raw
  modified_base (134)..(134): a, c, t, g, unknown or other
  misc_feature (134)..(134): n is a, c, g, or t
  modified_base (348)..(348): a, c, t, g, unknown or other
  misc_feature (348)..(348): n is a, c, g, or t
  modified_base (350)..(354): a, c, t, g, unknown or other
  misc_feature (350)..(354): n is a, c, g, or t
  modified_base (356)..(409): a, c, t, g, unknown or other
  misc_feature (356)..(409): n is a, c, g, or t
tcagtacacgtgatcacgaccggtgctcgatttagatctactgactaggggtccccggtggcatccccagacccacgtgccactgaacctggtctgggacaggaccttcactctcaccagtcaccagactggancctgaagtactttggcagtagtattactgtcaacagttggtctcacacacgttcggaccgtttcggccaaggggacctaaaggttggaaaatcgaaaaacgaactggtcgaccttgcaacctagtccgtcgtcttcaagttccttacccgccatcctaggtaaactcctagtagtacctggagtcgggactgggactaacggcggtcagtacgnannnnnannnnnnnnnnnnnnnnnnnnnnnnnnnnnnnnnnnnnnnnnnnnnnnnnnnnnn

SEQ ID NO: 47421 - DNA, 290 bp, Homo sapiens
  misc_feature: GYAE6OF02G7RV4.34.6.A06.1.454.CMB.1.raw
  modified_base (278)..(278): a, c, t, g, unknown or other
  misc_feature (278)..(278): n is a, c, g, or t
  modified_base (284)..(290): a, c, t, g, unknown or other
  misc_feature (284)..(290): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatcttcccgcatctgaatcacgtgtactgagcggctggcaaggcncatagnnnnnnn

SEQ ID NO: 47422 - DNA, 513 bp, Homo sapiens
  misc_feature: GYAE6OF02FHVAK.34.6.A06.1.454.CMB.1.raw
  modified_base (176)..(176): a, c, t, g, unknown or other
  misc_feature (176)..(176): n is a, c, g, or t
  modified_base (348)..(348): a, c, t, g, unknown or other
  misc_feature (348)..(348): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctntcctgcagggccagtcagatgttaatagcatctacttagcctggtaccagcagaacctggccagccctccagactcctcattaatggtgcatactacagggcccctggcatcccagacaggttcagtggcagtggtctgggacagacttcactctcacatcacagactggancctgaagtatttgcagtgtattactgtcaacagttgtctcacacgacgtggacgttcggaccaacgggacaaggtaggtaaatacgaaacgaacgtagtacggctgcaccatctgtctacacgtctcccgcctactctagactcacgtgtacgtgaccccgtggg

SEQ ID NO: 47423 - DNA, 542 bp, Homo sapiens
  misc_feature: GYAE6OF02FWBZP.34.6.A06.1.454.CMB.1.raw
  modified_base (296)..(296): a, c, t, g, unknown or other
  misc_feature (296)..(296): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacagggcccctggcatcccagacngttcagtggcaggtggtctgggacagtacttcactctcaccatccaccagactggactccgtagaagtattttgctagttgtacttactgtactaactagttcggtctacacacacgtggtacgttcggaccaagggaccgtaaggtacgaaactcgaaacgacgtggtacgtctacgcaactagtctgtcttcgacgttccttcccgcctatacctagtactcgacgttgtactaggagtccggg

SEQ ID NO: 47424 - DNA, 291 bp, Homo sapiens
  misc_feature: GYAE6OF02IQ1MN.34.6.A06.1.454.CMB.1.raw
  modified_base (285)..(291): a, c, t, g, unknown or other
  misc_feature (285)..(291): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgccatctgaatcacgtgtactgagcggctggcaaggcgcatagnnnnnnn

SEQ ID NO: 47425 - DNA, 510 bp, Homo sapiens
  misc_feature: GYAE6OF02HXDPN.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacaggcccctggcatcccagcaggttcaggtggcagtgggtctgggacagacttcactctcaccatcaccagactggagcctgaagtattttgcgtagtgtattactgtcaactgttgtctcacacacgtggacgttcggaccgaagggaccaaggtggaaatcgaaacgacgtgtgctgcaccatctgtcttcacttcttcccgctactcagtactctacgttgtactgagtccggg

SEQ ID NO: 47426 - DNA, 387 bp, Homo sapiens
  misc_feature: GYAE6OF02G469T.34.6.A06.1.454.CMB.1.raw
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (380)..(387): a, c, t, g, unknown or other
  misc_feature (380)..(387): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcattcttcccgcatctagaactcacgtgtactgagcggntggacaggcncatagnnnnnnnn

SEQ ID NO: 47427 - DNA, 507 bp, Homo sapiens
  misc_feature: GYAE6OF02F8UCY.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccagggggaaagagccaccctctcctgcagggccagtcagagtgttaatagcatctacttagcctggtaccagcagaaacctggccagcctcccagacctcctcattaatggtgcatactacagggcccctggcatcccagacaggttcagtggcagtgggtctgggacaggacttcactctcaccatcaccagactggagcctgaagtattttgcagtgtattactgtcaatagttggtctcacacacgtggacgttcggaccaagggaccaaggtggaaatcaaacgaactgtgctgcacatctgtcttcattcctcccgccatctgtaatcacgtgtactgagtccggg

SEQ ID NO: 47428 - DNA, 385 bp, Homo sapiens
  misc_feature: GYAE6OF02HTIXQ.34.6.A06.1.454.CMB.1.raw
  modified_base (378)..(385): a, c, t, g, unknown or other
  misc_feature (378)..(385): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccgcatctgaatcacgtgtactgagcgggctggcaaggcgcatagnnnnnnnn

SEQ ID NO: 47429 - DNA, 293 bp, Homo sapiens; identical to SEQ ID NO: 47321
  misc_feature: GYAE6OF02IOH8I.34.6.A06.1.454.CMB.1.raw
  modified_base (286)..(293): a, c, t, g, unknown or other
  misc_feature (286)..(293): n is a, c, g, or t

SEQ ID NO: 47430 - DNA, 291 bp, Homo sapiens
  misc_feature: GYAE6OF02GVAX0.34.6.A06.1.454.CMB.1.raw
  modified_base (282)..(282): a, c, t, g, unknown or other
  misc_feature (282)..(282): n is a, c, g, or t
  modified_base (287)..(291): a, c, t, g, unknown or other
  misc_feature (287)..(291): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgnatagnnnnn

SEQ ID NO: 47431 - DNA, 631 bp, Homo sapiens
  misc_feature: GYAE6OF02I38V6.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagacctcctctattaatggtgcatactaccgagggcccctggcactcccgagacaggttcaggtggcaggtgggtcgtgggacagtacttcactcctcaccatccaccgagactggacgcctagaatagtttgctagttgtaattacgttgtaccaacgtaggttggttcctacaacgaccgtacggtacggtaccggtttcgggaccgtaagggaacccgtaagggtacggaaacgtacaaaaccggtacgtaggtcggtacgtacggaccaaccgtagttccgttcgttacctttcgtaccgttcccgtttccccggacctacgttacgtaacggtaacttacccggtaaccgttacggttaccgttggaccggtaccgggg

SEQ ID NO: 47432 - DNA, 394 bp, Homo sapiens
  misc_feature: GYAE6OF02IBWNJ.34.6.A06.1.454.CMB.1.raw
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (378)..(379): a, c, t, g, unknown or other
  misc_feature (378)..(379): n is a, c, g, or t
  modified_base (381)..(394): a, c, t, g, unknown or other
  misc_feature (381)..(394): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctctacacacgtggacgttcggccaagggaccaggtggaaatcaaacgaactgtggctgcacatctgtcttcatcttcccgccatctgatcacgtntacngagcgggctggcaaggcgnatagnngnnnnnnnnnnnnnn

SEQ ID NO: 47433 - DNA, 386 bp, Homo sapiens
  misc_feature: GYAE6OF02GA0AW.34.6.A06.1.454.CMB.1.raw
  modified_base (375)..(375): a, c, t, g, unknown or other
  misc_feature (375)..(375): n is a, c, g, or t
  modified_base (381)..(386): a, c, t, g, unknown or other
  misc_feature (381)..(386): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctagaactcacgtgtactgagcgggctggcaaggcncatagnnnnnn

SEQ ID NO: 47434 - DNA, 422 bp, Homo sapiens
  misc_feature: GYAE6OF02JUCDM.34.6.A06.1.454.CMB.1.raw
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (388)..(422): a, c, t, g, unknown or other
  misc_feature (388)..(422): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccngactggagcctgaacgnttttgcagtgtattactgtcaacagttggtctcacacacgtgacgttcgaccaagggaccaagggtgaaatcaaacgaactgtggactgacaccatctgtcttcatctcccgcatctgatcagtgtactgacgcgggctggctaaggccgacaagtagngntnnnnnnnnnnnnnnnnnnnnnnnnnnnnnnnnnnn

SEQ ID NO: 47435 - DNA, 303 bp, Homo sapiens
  misc_feature: GYAE6OF02I1D55.34.6.A06.1.454.CMB.1.raw
  modified_base (295)..(303): a, c, t, g, unknown or other
  misc_feature (295)..(303): n is a, c, g, or t
tcagtacacgtgatcacgaccggtgctcgatttagatctactgacagggcccctggcatccccagaccaggttcagtggcacgtgggtctggggacagacttcgactctcaccatcaccagactggagcctgaagattttgcagtgtattactgtcaacagttggtctcacacacgtggacgttcggccaagggaccaaggtggaaatcaaacgaactgtggctgcaccatctgtcttcattccttcccgccatctgaattccacgtgtactgagcgggctggcaaggcgcatgnnnnnnnnn

SEQ ID NO: 47436 - DNA, 580 bp, Homo sapiens
  misc_feature: GYAE6OF02IFAWI.34.6.A06.1.454.CMB.1.raw
  modified_base (359)..(359): a, c, t, g, unknown or other
  misc_feature (359)..(359): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttagcggctacttagcctggtaccagcagaaacctggccaggctcccaggctcctcatctatgatgcgtccaacagggccactggcatcccagccaggttcagtggcagtggtctgggccagacttcactctcaccatcagcagcctagacgacctaaagnttttagactaatttattactgtcagtctgcgtagcaactggtcccttccgttgacgtccgtccgttccgggccgtaacggggaccaaccgggtacgtgggaacgtaacgttaaaccgaacgtcggtacggcgtacgacctacccagttccgtcgttaccttaccgtacttccccgttaccccgaccgtacttcccgtacgtaacttcccgtacgttaccgg

SEQ ID NO: 47437 - DNA, 309 bp, Homo sapiens
  misc_feature: GYAE6OF02GCBVN.34.6.A06.1.454.CMB.1.raw
  modified_base (282)..(282): a, c, t, g, unknown or other
  misc_feature (282)..(282): n is a, c, g, or t
  modified_base (289)..(309): a, c, t, g, unknown or other
  misc_feature (289)..(309): n is a, c, g, or t
tcagtacacgtgatcacgaccggtgctcgatttagatctactgacagggcccctggcatcccagaccaggttcagtggcagtgggtctgggacagacttcgactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcncaatagnnnnnnnnnnnnnnnnnnnnn

SEQ ID NO: 47438 - DNA, 500 bp, Homo sapiens
  misc_feature: GYAE6OF02GW5N2.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgtttcggccaagggaccaaggtggaaatcaaacgactgtggctgcacatctgtcttcatcttcccgcactctgactcacgtcgtatgagtccggg

SEQ ID NO: 47439 - DNA, 299 bp, Homo sapiens
  misc_feature: GYAE6OF02F17F3.34.6.A06.1.454.CMB.1.raw
  modified_base (292)..(299): a, c, t, g, unknown or other
  misc_feature (292)..(299): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttccccgcctatctagaatccacgtgtactgacggcgggctggcaaggcgcatgnnnnnnnn

SEQ ID NO: 47440 - DNA, 618 bp, Homo sapiens
  misc_feature: GYAE6OF02IUWA3.34.6.A06.1.454.CMB.1.raw
  modified_base (359)..(359): a, c, t, g, unknown or other
  misc_feature (359)..(359): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctcccagctcctcattaatggtgcatactacacgggcccctggcactcccagacaggttcagtggcaggtggtcgtgggacagacttcacgtctccacatccaccagacgtggacnccgtagaagtagttttcgactagttcgtaatttactagtacaacgtaggtttcggttcctacaactacgacggttacggtaccggtttcggacccggtaacgggaccgtaaacggtacgggaaacttacgaaaacgtacgtacggtagggtaccttacgacctaccaacgttcttaggtaccttacgtacttccgtttaccccgacctacgtccgttagtaacttccgtaaccgttcgtaaccgtcggaggtaccgggg

SEQ ID NO: 47441 - DNA, 393 bp, Homo sapiens
  misc_feature: GYAE6OF02ICPZT.34.6.A06.1.454.CMB.1.raw
  modified_base (366)..(366): a, c, t, g, unknown or other
  misc_feature (366)..(366): n is a, c, g, or t
  modified_base (383)..(393): a, c, t, g, unknown or other
  misc_feature (383)..(393): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagatttgcagtgtattactgtcaaacagttggtctcacacacgtaggacgttcggcaaagggaccaaggtggaaaatcaaaacgaactgtgctgcaccatctgtcttcatcttcccgcatctagaatcacgttgtactgagcggntggacaaggcacatagnnnnnnnnnnn

SEQ ID NO: 47442 - DNA, 549 bp, Homo sapiens
  misc_feature: GYAE6OF02JJX52.34.6.A06.1.454.CMB.1.raw
  modified_base (260)..(260): a, c, t, g, unknown or other
  misc_feature (260)..(260): n is a, c, g, or t
  modified_base (502)..(502): a, c, t, g, unknown or other
  misc_feature (502)..(502): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaacctggccagcctccagctcctcattaanggtgcatactacagggccccctggcatcccagacaggttcagtggcagtgggtctgggacagacttcactctcaccatcaccagactggagcctgaagattttgcctagtgtattacgtgtcaactagttgtcttcacacacgttggaacggttcgaccgtaagggaccaaaggtcgggaaattccaaaacgacgtcgtagcgttacgccactagtctagtctttaccagttccctttcccnccgtaactcgttacgtaactctaccggttagtacgtgacggtacggg

SEQ ID NO: 47443 - DNA, 294 bp, Homo sapiens
  misc_feature: GYAE6OF02HXHAJ.34.6.A06.1.454.CMB.1.raw
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (288)..(294): a, c, t, g, unknown or other
  misc_feature (288)..(294): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagtattttgcagtgtattactgtcaacagttggtctcacacacgtggacgttcggaccaaggaccaaggtggaaatcaaaacgactgtggctgcaccatctgtcttcatcctccgcctatctgaatcacgtntactgagcgggctggcaaggcgcanagnnnnnnn

SEQ ID NO: 47444 - DNA, 412 bp, Homo sapiens
  misc_feature: GYAE6OF02F541I.34.6.A06.1.454.CMB.1.raw
  modified_base (344)..(344): a, c, t, g, unknown or other
  misc_feature (344)..(344): n is a, c, g, or t
  modified_base (391)..(392): a, c, t, g, unknown or other
  misc_feature (391)..(392): n is a, c, g, or t
  modified_base (394)..(412): a, c, t, g, unknown or other
  misc_feature (394)..(412): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaaacagttggtctcacacacggtggacgttcggcctaaaggggacccaaaggtggaaatcaaaacgaactgtggctgcacatctgtcttcattcttcccnctatctgaatcacgtgtactgaggcgggctggcaagggcgcagtagnngnnnnnnnnnnnnnnnnnnn

SEQ ID NO: 47445 - DNA, 299 bp, Homo sapiens
  misc_feature: GYAE6OF02JJ1N8.34.6.A06.1.454.CMB.1.raw
  modified_base (278)..(278): a, c, t, g, unknown or other
  misc_feature (278)..(278): n is a, c, g, or t
  modified_base (285)..(288): a, c, t, g, unknown or other
  misc_feature (285)..(288): n is a, c, g, or t
  modified_base (292)..(299): a, c, t, g, unknown or other
  misc_feature (292)..(299): n is a, c, g, or t
tcagtacacgtgatcacgaccggtgctcgatttagatctactgacagggcccctggcagtcccagacaggttcagtggcagtgggtctgggacagacttcactctcaccatcaccagactggagcctgaagattttgcagtgtattactgtcaacagttggtctcacacacgtggacgttcggccaagggccaaggtggaaatcaaacgactgtgctgcaccatctgtcttcatcttcccgcatctgaatccagtgtactgagcgggctggcaaggcncatagannnntcannnnnnnn

SEQ ID NO: 47446 - DNA, 520 bp, Homo sapiens
  misc_feature: GYAE6OF02FR3YD.34.6.A06.1.454.CMB.1.raw
  modified_base (166)..(166): a, c, t, g, unknown or other
  misc_feature (166)..(166): n is a, c, g, or t
  modified_base (490)..(490): a, c, t, g, unknown or other
  misc_feature (490)..(490): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaangccaccctctcctgcagggccagtcagagtgttaatgcatctacttagcctggtaccagcagaaacctggccagccctccagacctcctcacttaatggtgcatactacgacgggcccctggcactcccagacaggttcagtggcgaggtgggtctgggacagacttcactctcaccatcaccagactcggacgcctagtaagtatttgctagtgtattactgtacaagtagttgtctcacacacgtggtacgttcgacgaaggacctaaggtagaaatacgaaacgacgtgtcggctacgcacatctgtctcacttcctaccnctatcgtagactcagtcgtacgtgagtcgg

SEQ ID NO: 47447 - DNA, 306 bp, Homo sapiens
  misc_feature: GYAE6OF02IIO3V.34.6.A06.1.454.CMB.1.raw
  modified_base (280)..(280): a, c, t, g, unknown or other
  misc_feature (280)..(280): n is a, c, g, or t
  modified_base (286)..(306): a, c, t, g, unknown or other
  misc_feature (286)..(306): n is a, c, g, or t
tcagtacacgtgatcacgaccggtgctcgatttagatctactgacagggcccctggcatcccagaccaggttcagtggcagtgggtctgggacaggaccttcgactctcaccatcaccagactggagcctgaagattttgcagtgtattactgtcaacagttggctcacacacgtgacgttcggccaagggccaaggtgaaatcaaacgactgtgctgcaccatctgtcttcatcctccgccatctgaatcacgtgtactgacgcgggctggcaaggccncatagnnnnnnnnnnnnnnnnnnnnn

SEQ ID NO: 47448 - DNA, 296 bp, Homo sapiens
  misc_feature: GYAE6OF02JCFRS.34.6.A06.1.454.CMB.1.raw
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (283)..(296): a, c, t, g, unknown or other
  misc_feature (283)..(296): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggcaagggaccaaggtgaaatcaaacgaactgtggctgcacatctgtcttcattcctcccgcatctgaatcacgtgtactgacgcggntggcaggcnagtagnnnnnnnnnnnnnn

SEQ ID NO: 47449 - DNA, 387 bp, Homo sapiens
  misc_feature: GYAE6OF02I1Q48.34.6.A06.1.454.CMB.1.raw
  modified_base (381)..(387): a, c, t, g, unknown or other
  misc_feature (381)..(387): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgctagtgtattactgtcaacagttgtctcacacacgtggacgttcggaccaagggaccaaggtggaaatcaaacgactgtggctgcacatctgtcttcatctcccgcatctgaatcacgtgtactgagcggcgtggacaacggcgacatagcnnnnnnn

SEQ ID NO: 47450 - DNA, 405 bp, Homo sapiens
  misc_feature: GYAE6OF02JZDJS.34.6.A06.1.454.CMB.1.raw
  modified_base (264)..(264): a, c, t, g, unknown or other
  misc_feature (264)..(264): n is a, c, g, or t
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (389)..(390): a, c, t, g, unknown or other
  misc_feature (389)..(390): n is a, c, g, or t
  modified_base (393)..(405): a, c, t, g, unknown or other
  misc_feature (393)..(405): n is a, c, g, or t
tcagtacacgtgatcacgaccggtgctcgatttagatctactgacagggccgagtcagagtgttaatagcatctacttagcctggtaccagcagaaacctggccagcctccagactcctcattaatggtgcatactacagggccctggcatcccagacaggttcagtggcagtggtctgggacagacttcactctcacatcaccagactggagcctgaacgtattttgctagtgtattactgttacactagttggtcacacacngtgacgttcggccaaggtcaaggtggaatcaaacgtatgaggtctgccacagtctgtctanactctacccgcatcctgaactcactgtacngtacggnggcctgacgacggngtacaatcgcngnngcnnnnnnnnnnnnn

SEQ ID NO: 47451 - DNA, 426 bp, Homo sapiens
  misc_feature: GYAE6OF02JF5G8.34.6.A06.1.454.CMB.1.raw
  modified_base (379)..(380): a, c, t, g, unknown or other
  misc_feature (379)..(380): n is a, c, g, or t
  modified_base (382)..(382): a, c, t, g, unknown or other
  misc_feature (382)..(382): n is a, c, g, or t
  modified_base (387)..(389): a, c, t, g, unknown or other
  misc_feature (387)..(389): n is a, c, g, or t
  modified_base (392)..(426): a, c, t, g, unknown or other
  misc_feature (392)..(426): n is a, c, g, or t
tcagtacacgtgatcacgaccggtgctcgatttagatctactgacaggggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaagggtggaaatcaaacgactgtggctgcaccatctgtcttcatctccgcatctgaatcacgtgtactgagcggctggcaagggcacagtagnngnagctnnnacnnnnnnnnnnnnnnnnnnnnnnnnnnnnnnnnnnn

SEQ ID NO: 47452 - DNA, 304 bp, Homo sapiens
  misc_feature: GYAE6OF02GJJX3.34.6.A06.1.454.CMB.1.raw
  modified_base (290)..(304): a, c, t, g, unknown or other
  misc_feature (290)..(304): n is a, c, g, or t
tcagtacacgtgatcacgaccggtgctcgatttagatctactgacagggccccctggcatccccagaccaggttcagtggcagtgggtctggggacagacttcgacctctcaccatcaccagactggagcctgaagattttgcagtgtattactgtcaacagttggtctcacacacgtggacgttcggccaagggaccaaggtggaaatcaaacgactgtggctgcacatctgtcttcatctcccgcatctgaatcacgtgtactggagcgggctggcaaggcgcatagnnnnnnnnnnnnnnn

SEQ ID NO: 47453 - DNA, 470 bp, Homo sapiens
  misc_feature: GYAE6OF02I48H7.34.6.A06.1.454.CMB.1.raw
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (431)..(470): a, c, t, g, unknown or other
  misc_feature (431)..(470): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggtccagtggcagtgggtctgggacagacttcactctcaccatcaccagactggagcctgaagattttgcagtgtattactgtcaactagttggtctcacacacgtggacgttcggaccaaacggggaccaagggtagaaatcaaaacgaactgtagctgcaccatctgtcttcatccttcccgacctatctagtaaactcacggttataacgttggacggtcggggtctgggaccgaaacgggccgtacgtaagttaacgcngngtgngnnnnnnnnnnnnnnnnnnnnnnnnnnnnnnnnnnnnnnnn

SEQ ID NO: 47454 - DNA, 294 bp, Homo sapiens
  misc_feature: GYAE6OF02HVNWL.34.6.A06.1.454.CMB.1.raw
  modified_base (279)..(279): a, c, t, g, unknown or other
  misc_feature (279)..(279): n is a, c, g, or t
  modified_base (284)..(294): a, c, t, g, unknown or other
  misc_feature (284)..(294): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgactgtggctgcaccatctgtcttcatccttccgccatctgaatcaacgtgactgagcggctggcaaggcncatgnnnnnnnnnnn

SEQ ID NO: 47455 - DNA, 392 bp, Homo sapiens
  misc_feature: GYAE6OF02F34W7.34.6.A06.1.454.CMB.1.raw
  modified_base (309)..(309): a, c, t, g, unknown or other
  misc_feature (309)..(309): n is a, c, g, or t
  modified_base (371)..(371): a, c, t, g, unknown or other
  misc_feature (371)..(371): n is a, c, g, or t
  modified_base (376)..(392): a, c, t, g, unknown or other
  misc_feature (376)..(392): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctggggacagacttcactctcaccatcaccagactggagcctgaagattttgcagtgtattactgtcagcagtataataactggcctcggggacttcggccaagggaccaaggtggaatcaaacgaactgnggctgcacatctgtctcactctccgccatctgaatcacgtgtactgagcggctggcaaggcnatagnnnnnnnnnnnnnnnnn

SEQ ID NO: 47456 - DNA, 353 bp, Homo sapiens
  misc_feature: GYAE6OF02IYJR4.34.6.A06.1.454.CMB.1.raw
  modified_base (300)..(302): a, c, t, g, unknown or other
  misc_feature (300)..(302): n is a, c, g, or t
  modified_base (304)..(306): a, c, t, g, unknown or other
  misc_feature (304)..(306): n is a, c, g, or t
  modified_base (308)..(308): a, c, t, g, unknown or other
  misc_feature (308)..(308): n is a, c, g, or t
  modified_base (310)..(311): a, c, t, g, unknown or other
  misc_feature (310)..(311): n is a, c, g, or t
  modified_base (315)..(353): a, c, t, g, unknown or other
  misc_feature (315)..(353): n is a, c, g, or t
tcagtacacgtgatcacgaccggtgctcgattttagatctactgacagggcccctggcagtcccagacaggttcagtggccagtgggtctgggacaggacttcactctcaccatcaccagactggagcctgaagattttgcagtgtatttactgtcaacagtttggttctcacacacgttggacgtttcggccaaggaccaaggtggaaatcaaacgaactgtggctggcaccatctgtcttcactccttccgccatctgaatcacgtgtactgagtcgggtctggcaaggcgacatagnnngnnngncnncagnnnnnnnnnnnnnnnnnnnnnnnnnnnnnnnnnnnnnnn

SEQ ID NO: 47457 - DNA, 604 bp, Homo sapiens
  misc_feature: GYAE6OF02IJ7L2.34.6.A06.1.454.CMB.1.raw
  modified_base (166)..(166): a, c, t, g, unknown or other
  misc_feature (166)..(166): n is a, c, g, or t
  modified_base (223)..(223): a, c, t, g, unknown or other
  misc_feature (223)..(223): n is a, c, g, or t
tcagtacacgtgatcacgaccggtgctcgatttagatctactgacaggggaaccatggaaaccccagcgcagcttctcttcctcctgctactctggctcccagatatcaccggagaaattgtgttgacacagtctccaggcacctgtctttgtctccaggggaaangccacctctcctgcagggccagtcagagtgttaatagcatctacttagcctggtacngcagaacctggccagcctccagactcctcattaatggtgacatactacacgggccctggctactcccagactaggttcagtggcaggtgggtctgggacagacttcgactctcactatcacagctggactctagaagtatttcgacgtagtgttattacgtagtacaacgtaggttggtactactacacgtacggtagtaccgttacggacgtaaacgggaccgtaaagggtacgtaaacgtaccgaaacgtacgtaggttcggacgttcgaccgtactaacgttcgttacgttcttaccgtactttacccgttacccgtacctaacgttcttaaccggtaacttccggtaaccgttacggtacgtacgtacggtaccggg

SEQ ID NO: 47458 - DNA, 293 bp, Homo sapiens
  misc_feature: GYAE6OF02HNNS6.34.6.A06.1.454.CMB.1.raw
  modified_base (286)..(293): a, c, t, g, unknown or other
  misc_feature (286)..(293): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaaatcaaaacgaactgtggctgcaccatctgtcttcatcttccgcatctgaatcacgtgtactgagcggctggcaaggcgcatagnnnnnnnn

SEQ ID NO: 47459 - DNA, 309 bp, Homo sapiens
  misc_feature: GYAE6OF02GQ47Y.34.6.A06.1.454.CMB.1.raw
  modified_base (283)..(284): a, c, t, g, unknown or other
  misc_feature (283)..(284): n is a, c, g, or t
  modified_base (286)..(309): a, c, t, g, unknown or other
  misc_feature (286)..(309): n is a, c, g, or t
tcagtacacgtgatcacgaccggtgctcgatttagatctactgacagggccccctggcatccccagaccagttcacgtgcacgtgggtctgggacagacttcgacctctcaccatcaccagactggagcctgaagatttgcagtgtattactgtcaacagttggtctcacacacgtggtacgttcggaccaaggaccaaggtggaaatcaaacgactgtgctgcacatctgtctcatctccgcatctgatcacgtgtactgacgcggctggcaggcgacatgnngnnnnnnnnnnnnnnnnnnnnnnnn

SEQ ID NO: 47460 - DNA, 298 bp, Homo sapiens
  misc_feature: GYAE6OF02ICBAE.34.6.A06.1.454.CMB.1.raw
  modified_base (288)..(288): a, c, t, g, unknown or other
  misc_feature (288)..(288): n is a, c, g, or t
  modified_base (293)..(298): a, c, t, g, unknown or other
  misc_feature (293)..(298): n is a, c, g, or t
tcagtacacgtgatcacgaccggtgctcgatttagatctactgacagggccccctggcatccccagacaggttcagtggcagtgggtctggggacagacttcgacctctcaccatcaccagactggagcctgaagattttgcagtgtattactgtcaacagttggtctcacacacgtggacgttcggccaagggaccaaggtggaaatcaaacgactgtggctgacaccatctgtcttcatccttcccgccatctgaattcacgtgtactgagcgggctggcaaggcnatagnnnnnn

SEQ ID NO: 47461 - DNA, 665 bp, Homo sapiens
  misc_feature: GYAE6OF02GGD5I.34.6.A06.1.454.CMB.1.raw
  modified_base (168)..(168): a, c, t, g, unknown or other
  misc_feature (168)..(168): n is a, c, g, or t
tcagtacacgtgatcacgaccggtgctcgatttagatctactgacagggaaccatggaaaccccagcgcagcttctcttcctccgtgctactctggctcccagatatcaccggagaaattgtgttcgacacagtctccaggcaccctgtctttgtctccaggggaaanagacctatcctctcctgcagggccagtcagagtattagcaccaattagcctggtaccagacagaaacctggccagacctcccgagtcctcctcatctatggtgcatccacgacgggccactggtactcccgaggctagggttcaggtggactaggtcgggtctggggacagtacgttcacttctcaccatcagtcctagtactggctaggtccttagggaacttagttttgaccgttagttttactttactgtacagtacaacttaataacgtaagtcggaccttaccgattccgtacccgttacgggaccgtaaacggggaccgtaaccggtacgtacgggtaacgtaaacgttaaaccggtaacgttcgggtacggtaccgtacgacccgttacccgtacgtaccgtttacggtaccttttaccgtaaccgtttaccccgttaccccggtacttaaccgtttacctacggtaaacgttcccgtaacggttaccgg

SEQ ID NO: 47462 - DNA, 292 bp, Homo sapiens
  misc_feature: GYAE6OF02FX4FT.34.6.A06.1.454.CMB.1.raw
  modified_base (234)..(234): a, c, t, g, unknown or other
  misc_feature (234)..(234): n is a, c, g, or t
  modified_base (287)..(292): a, c, t, g, unknown or other
  misc_feature (287)..(292): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttnatcttcccgccatctgaatcacgtgtactgagcgggctggcaaggcgcatagnnnnnn

SEQ ID NO: 47463 - DNA, 428 bp, Homo sapiens
  misc_feature: GYAE6OF02JE1ES.34.6.A06.1.454.CMB.1.raw
  modified_base (393)..(394): a, c, t, g, unknown or other
  misc_feature (393)..(394): n is a, c, g, or t
  modified_base (396)..(397): a, c, t, g, unknown or other
  misc_feature (396)..(397): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (403)..(428): a, c, t, g, unknown or other
  misc_feature (403)..(428): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagacctggagcctgaagattttgcagtgtattactgtcaacagttggtctcacacacgtggacgttcggccaagggaccaaggtggaaatcaaacgactgtggctgcaccatctgtcttcacttcttccccgcctatcctgtaactcacgtgtactgaggcgggtctcgggctaaggcgcagtcgnnannangnannnnnnnnnnnnnnnnnnnnnnnnnn

SEQ ID NO: 47464 - DNA, 667 bp, Homo sapiens
  misc_feature: GYAE6OF02HQGCN.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaagagccaccctctcctgcagggccagtcagagtgttaatagcatctacttagcctggtaccagcagaaacctggccacgcctcccagacctcctacattaagtggtgcatactacgaggcccctggcactcccagactggtcagtggctaggtgggtcgtgggacagtacttcactctccaccactcaaccacgacgtaggacgtccgtagtaagtagtttcgcgtaagtagtttactttaccgtgtaacctaacgtaggtttacggtctacgacctacgacggtcggtacgttaccgggaccggaacgggaccgtaagggtacgaaacgtacccgtaaaacggtaccgttagggtacgtacgtacgaacccgtaaaccgtacgttaccgttacggtttacctttaccgtaccggtttccccgttaccccgaccttacgttaccttacggttaaccgttacctaaccgggtttacggtaaccggttacgggacggtacccgggg

SEQ ID NO: 47465 - DNA, 295 bp, Homo sapiens
  misc_feature: GYAE6OF02HF69P.34.6.A06.1.454.CMB.1.raw
  modified_base (279)..(279): a, c, t, g, unknown or other
  misc_feature (279)..(279): n is a, c, g, or t
  modified_base (286)..(295): a, c, t, g, unknown or other
  misc_feature (286)..(295): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtctcatcttccgcatctgaatcacgtgtactgagcgggctggacaaggcncaatagnnnnnnnnnn

SEQ ID NO: 47466 - DNA, 685 bp, Homo sapiens
  misc_feature: GYAE6OF02HTIUA.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcgagggccagtcagagtgttaatagcatctacttagcctggtaccagcagaaacctggccagccctccagacctcctcattaatggtgcactactacacgggcccctggcactcccgagacgtacggttcaggtcggcgtaggtgggtctgggacagtacttcgactctaccgacctatcaccgtagacgtcggacgccgtagtaagtattttcgacgtagttacgttactttaccgtgtacctaaacgtaggtttacgtcgttaccaacgtaaccgtaaccgggttacggtaaccggtttaccgggaacccgtaaacgggggaacccgtaaaggggttaaacgggaaaattaaccggaaaaccggtaacgttagggacggtaccgttagtacccgaaccgtaacttccgttcggttacctttccaccgttcccgttaccccgtacctacgttaccgtacgtaacttccggaccgttacggttaaccgtggaccggtaccgggg

SEQ ID NO: 47467 - DNA, 311 bp, Homo sapiens
  misc_feature: GYAE6OF02G6H9U.34.6.A06.1.454.CMB.1.raw
  modified_base (283)..(284): a, c, t, g, unknown or other
  misc_feature (283)..(284): n is a, c, g, or t
  modified_base (286)..(290): a, c, t, g, unknown or other
  misc_feature (286)..(290): n is a, c, g, or t
  modified_base (292)..(311): a, c, t, g, unknown or other
  misc_feature (292)..(311): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaaacgaactgtgctgcaccatctgtctcatcttccgcatctgaatcacgtgtactgagcggctggcaaggcgcatagnngnnnnnannnnnnnnnnnnnnnnnnnn

SEQ ID NO: 47468 - DNA, 606 bp, Homo sapiens
  misc_feature: GYAE6OF02I1T6O.34.6.A06.1.454.CMB.1.raw
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
  modified_base (341)..(341): a, c, t, g, unknown or other
  misc_feature (341)..(341): n is a, c, g, or t
  modified_base (371)..(371): a, c, t, g, unknown or other
  misc_feature (371)..(371): n is a, c, g, or t
tcagtacacgtgatcacgaccggtgctcgatttagatctactgacagggcccctggcatcccagacccactgccactgaacctgtctgggatgccaggggccctgtagtatgcaccattaatgaggagctgctcagttaggacccagacggaaccatggaagccccagcgcagcttctcttcctcctgctactctggcctcccagacaccactggaagaaatagtgatcgacgcagtctccagccacctgtctgtcgtctccgaaggggaaacngccctaccctctcctgcgacgggccagtcagngtgttgcagtactgcctgacagcacgaactggccnggcctccgagactcctcatctatcgctacnctacccaccgacggcctacgtcgaccttacgttaccacggtccctaagggtttcccagggtttcgggacgttacgggttcgggtaccgtacggggtaacgtacggttaccgtttacgtaccttccgttaaccaaccgtactaccgaacgtccgacgtccgtacggaacgtcgttacgtaacgtaagttacttcgtaccgttactttaaccgttttacgttaccgttagtaaccgg

SEQ ID NO: 47469 - DNA, 561 bp, Homo sapiens
  misc_feature: GYAE6OF02H4USW.34.6.A06.1.454.CMB.1.raw
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaatggtgcatactacgaggcccctggcatcccagactaggttcagtggcaggtgggtntgggacagactcactctcaccatcaccagacngacgcctagaagtagtttgactagttgttattactcgtactaacgtagttgtctcacacgtacgttaggtacgttcggaccgaacgggaccgtaagggtaggtaaactaccgaaacgactggtacggctagaccaacctatcttagtcttactacgtccttacccgctatccgtacgtaacgtccgttagtaccgtggtacggtcgggtacg

SEQ ID NO: 47470 - DNA, 965 bp, Homo sapiens
  misc_feature: GYAE6OF02IPMZN.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggccaccctgtctttgtctccgaaggggaaagacgcccaccctctcctgcgagggccagtcagagtgttagcggctacttacgcctggtaccagcacgaaacctggaccaggcctccgaggcctcctcatctatgatcgccgtaccaacgacgggccacgtcggacctacgtccccagtccgtaggttcgaaggttcggacgtagggttcggggttccgtacggggaccctaaggtaccctttaccgacccgttcctaacccaacccgtactaccggaacggaccgtaacggtacccgttaaacggaaccgtaaaccctttaaaaaggtttacgttttttacggaacctttttaaaacgttttttaacgttttaaccgttacggttaaccgtaacgggttacccgttacgggtaaccggttaaacggtaacccgttaaacccgggtttcccgggttacccccgttttacccggtttaacgggtaacccgggttccccgggtttaccccggggtttaccccgggggaaccccggggtaaaccgggggtaaacccgttaacccggggttaaaccgggttaacgggggtaaaaccgtttaaaaaccgggtttaaaacccgggttaaccgggtttaacggggttaccggggttaacccgttaaccgggtaaccccttaacccggttaaccggtttacccggtttaccggttttaaccccgttttacccgttaacccggttttaccccccggtttacccccggttaaccctttaaccggttttaacccgttaaccggttaaacccgttacccgggttaaccggtttaaccggg

SEQ ID NO: 47471 - DNA, 293 bp, Homo sapiens
  misc_feature: GYAE6OF02GEZN9.34.6.A06.1.454.CMB.1.raw
  modified_base (281)..(281): a, c, t, g, unknown or other
  misc_feature (281)..(281): n is a, c, g, or t
  modified_base (287)..(293): a, c, t, g, unknown or other
  misc_feature (287)..(293): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaaacgaactgtggctgcaccatctgtcttcatcttcccgcatctgaatcacgtgtactgagcgggctggcaaggcncatagnnnnnnn

SEQ ID NO: 47472 - DNA, 295 bp, Homo sapiens
  misc_feature: GYAE6OF02IUKT1.34.6.A06.1.454.CMB.1.raw
  modified_base (288)..(295): a, c, t, g, unknown or other
  misc_feature (288)..(295): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcgaaacgaactgtggctgcaccatctgtcttcatcttcccgcatctgaatcacgtgtactgagcgggctggcaaggcgcagtagnnnnnnnn

SEQ ID NO: 47473 - DNA, 294 bp, Homo sapiens
  misc_feature: GYAE6OF02H5P0I.34.6.A06.1.454.CMB.1.raw
  modified_base (280)..(280): a, c, t, g, unknown or other
  misc_feature (280)..(280): n is a, c, g, or t
  modified_base (286)..(294): a, c, t, g, unknown or other
  misc_feature (286)..(294): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggccaaggtggaaatcaaacgaactgtaggctgcaccatctgtcttcatccttccgccatctgaatcagtgtactgagcgggctggcaaggcncatagnnnnnnnnn

SEQ ID NO: 47474 - DNA, 627 bp, Homo sapiens
  misc_feature: GYAE6OF02GU0ZU.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccagggggaaagagcccaccctctcctgcagggccagtcagagtgttaaatgcatcttacttagccttggtaccagcaagaaacctggccagccctccagacctcctcaattatggtgcactactacgacggccctggcactcccagactaggttcgaggtggactaggtgggtcgtagggacagtacttcgactccgtacacactacaccagacgtggacgccgtagaagtatttcgctagtcgttattactgtactaacgtagttcgtctacaacaccgtcggtaggttaccggttaccggaccggtaaacgggaaccgtaagggtaacggtaaagtaacgtaaaccgtaacgtaggtcggtctacgaccgactaactcgttacgttcttacgtacttcccgtacccgtcctaacgttccgttaacgtaccttaccgtaccggttacgtacggttacggacgggtccggg

SEQ ID NO: 47475 - DNA, 432 bp, Homo sapiens
  misc_feature: GYAE6OF02FR6LZ.34.6.A06.1.454.CMB.1.raw
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (401)..(403): a, c, t, g, unknown or other
  misc_feature (401)..(403): n is a, c, g, or t
  modified_base (405)..(405): a, c, t, g, unknown or other
  misc_feature (405)..(405): n is a, c, g, or t
  modified_base (407)..(432): a, c, t, g, unknown or other
  misc_feature (407)..(432): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgctagtgtattactgtcaacagttggtctcacacacgtggacgttcggccaagggaccaagggtggaaatcaaacgatgtggctgcactatctgtcttcatcttcccgctntctagaacttccggtntaccgttgacggcgggtcttcgggacgaacgggcgaccagttagnnngnannnnnnnnnnnnnnnnnnnnnnnnnn

SEQ ID NO: 47476 - DNA, 288 bp, Homo sapiens
  misc_feature: GYAE6OF02FF6OH.34.6.A06.1.454.CMB.1.raw
  modified_base (280)..(280): a, c, t, g, unknown or other
  misc_feature (280)..(280): n is a, c, g, or t
  modified_base (285)..(288): a, c, t, g, unknown or other
  misc_feature (285)..(288): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcncatannnn

SEQ ID NO: 47477 - DNA, 677 bp, Homo sapiens
  misc_feature: GYAE6OF02GVO6U.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagcctccagactcctcattaagtggtgcatactacgacgggcccctggcactcccagacaggttcagtggcaggtgggtcgtgggacagacttcactctccacctatccaccagacgtcggacgtcctagtaagttacgttttacgacgtaaggtttacggttaactttaccgttacgttacgtaaacgttaggtttacggttaccttacgaaccgtaaccgtacgggttacgggtaccggtttacccgggaaccggaaacggggtaaccgtaaaggggtaacgggtaaacgttaaccgtaaaaccggtaacgttcggtacgggtacgtcgaaccgtacctagttccgttacgtttaccttttacgttacccgttcccgaccttattaccgttacgtacttacgtacggttacgttacgtcggtacggtcgggtacg

SEQ ID NO: 47478 - DNA, 296 bp, Homo sapiens
  misc_feature: GYAE6OF02FHM8X.34.6.A06.1.454.CMB.1.raw
  modified_base (289)..(296): a, c, t, g, unknown or other
  misc_feature (289)..(296): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaaatcaaaacgaactgtggctgcaccatctgtcttcatcttcccgccatctagaatcacgtgtactgagcgggctggcaaggcgcatagnnnnnnnn

SEQ ID NO: 47479 - DNA, 406 bp, Homo sapiens
  misc_feature: GYAE6OF02GP9AA.34.6.A06.1.454.CMB.1.raw
  modified_base (262)..(262): a, c, t, g, unknown or other
  misc_feature (262)..(262): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (388)..(406): a, c, t, g, unknown or other
  misc_feature (388)..(406): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatccaccaggccactggtatcccagccaggttcagtggcagtgggtctgggacagaattcactctcaccatcagcagccctgcagtctgaagattttgctagttttattactgtcagcagttataataacnggcctccggggacttcggccaagggaccaaggtggaattcaaacgaactgtgctgcacagtctgtcttcatcttcccgcatctgaatcacgtntatcgagccgggntggactaaggcganaatgcnnnnnnnnnnnnnnnnnnn

SEQ ID NO: 47480 - DNA, 413 bp, Homo sapiens
  misc_feature: GYAE6OF02HOTF1.34.6.A06.1.454.CMB.1.raw
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (394)..(413): a, c, t, g, unknown or other
  misc_feature (394)..(413): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggacgcctgaagtattttgctagtgttattactgtacaactagttgtctcacacacgtggacgttcggaccgaagggaccaaggtaggaaataccgaaacaacgtgtggctgcacatctgtctacatcctcccgctatctgactcacgtgtacnggacgcggctggacaggcnctagtacgnnnnnnnnnnnnnnnnnnnn

SEQ ID NO: 47481 - DNA, 294 bp, Homo sapiens
  misc_feature: GYAE6OF02HOHLE.34.6.A06.1.454.CMB.1.raw
  modified_base (279)..(279): a, c, t, g, unknown or other
  misc_feature (279)..(279): n is a, c, g, or t
  modified_base (285)..(294): a, c, t, g, unknown or other
  misc_feature (285)..(294): n is a, c, g, or t
tcagtacacgtgatcacgaccggtgctcgatttagatctactgacagggccccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcacatctgtcttcatcttccgcatctgaactcacgtgtactgagcggctggcaaggcncatagnnnnnnnnnn

SEQ ID NO: 47482 - DNA, 688 bp, Homo sapiens
  misc_feature: GYAE6OF02FGO26.34.6.A06.1.454.CMB.1.raw
  modified_base (166)..(166): a, c, t, g, unknown or other
  misc_feature (166)..(166): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccgaggggaanagccaccctctcctgcagggccagtcagagtgtaatgcatctatagctggtaccagcaagaacctggccagccctccagacctccacattaagtggtgcatactacgacgggccctggcactcccagacaggttcgagtggcgaggttcgggtctggggactaggtaccttcacgtcctacacctactccaaccaggacgtaggacgccgtaggtaagttacttttcggacgtacggttagtttaacgttacgtacgttactaacgtaggtttcggtacctacacctaacggtacggtacgggttaaccggttccgggaaccgtaaacggggtaacgtaagggtaccggtaaaacgtaccggaaaacgtacggttagggtacggtacgtacgaccctaaccgtacgttaccttagttaccttaccgtaccgtttacccgtcccccggtacctaaccgttacgtaacgttaacccgttccgttaaccgggttacgtaaccggttacgggacggttacccgggg

SEQ ID NO: 47483 - DNA, 309 bp, Homo sapiens
  misc_feature: GYAE6OF02JAW3P.34.6.A06.1.454.CMB.1.raw
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
  modified_base (286)..(288): a, c, t, g, unknown or other
  misc_feature (286)..(288): n is a, c, g, or t
  modified_base (290)..(309): a, c, t, g, unknown or other
  misc_feature (290)..(309): n is a, c, g, or t
tcagtacacgtgatcacgaccggtgctcgatttagatctactgacagggcccctggcatcccagaccaggttcagtggcagtgggtctgggacagacttcgactctcaccatcaccagactggagcctgaagattttgcagtgtattactgtcaacagttggtctcacacacgtggacgtttcggccaagggaccaaggtggaaatcaaacgaactgtggctgcaccatcngtctcatctccgcatctgaatcagtgtactgacgcgggctggcaaggcncatagnnngnnnnnnnnnnnnnnnnnnnn

SEQ ID NO: 47484 - DNA, 710 bp, Homo sapiens
  misc_feature: GYAE6OF02IYXIZ.34.6.A06.1.454.CMB.1.raw
  modified_base (169)..(169): a, c, t, g, unknown or other
  misc_feature (169)..(169): n is a, c, g, or t
  modified_base (207)..(207): a, c, t, g, unknown or other
  misc_feature (207)..(207): n is a, c, g, or t
tcagtacacgtgatcacgaccggtgctcgatttagatctactgacagggaaccatggaaaccccagcgcagcttctcttcctcctgctactctggctcccagatatcgaccggagaaattgtgttgacacagtctccaggcaccctgtctttgtctccgaggggaaagngccaccctctcctgcgacgggccagtcagagtgttaanagcatctacttagcctggtaccagcaagaaacctggccagcctccccagacctcctacacttaagtggtgactataacctacgacgggtccccttggccactccccagactacggttcagtggcaggtgggtcgtgggacaggtaccttcacttctacacactcacctagactggacgtccgtagtaaagtattttcggcgtaagttgtaattcgtacgtactaacgtacggtttcggtctactaaccgtaccgtaccggttacgggtaccgggtttaccgggaaccgtaaacggggaacccgtaaaggggtaacgggtaaacgtaaaccgaaaacggttaaaccggttaggtaccgggtaaccggttcgtacccgtaaaccgtactttaccgggttcgttacccgttactaccgtttccccgtttaaccccggtccttaacgttacccgttacgttaactcccgttaacggttcgttaaccggtacggtaccgggtaccggg

SEQ ID NO: 47485 - DNA, 857 bp, Homo sapiens
  misc_feature: GYAE6OF02F8D18.34.6.A06.1.454.CMB.1.raw
tcagtacacgtgatcacgaccggtgctcgatttagatctactgacagggcccctggcatcccagacccactgccactgaacctgtctgggatgccaggggccctgtagtatgcaccattaatgaggagctgctcagttaggacccagagggaaccatcggaaacccagcgcagcttctcttcctctgctactctggctccagatactcaccggtaataattgtgttcgacactagtcctaccgaggcctacccgttgttaccttttcgtccttaccggaagggggaaaacgacgccccgtaaccccttccgttcccgttcggccgtaacggggccctaaggtccgtaaggtacggtttcggtttacgggaccgaacggtaccgtaaaccgtttacggaccccgtttacgggtaaccccaggtaccgaaaccggtaaaacccggttcggaacccgaacgggtccccgttaaccccggaaggtacccgttcccgttaactaacgtttacgttaacgttaccggtaaccctttaaaccaacccgtttacccccgaaacccgggtaacggggtacccctaacggttaccggtaccctttaaccgtttacccgaaccggtacccgttaacgggtttaccgaagggttaccgggtaccgttaagggttccgggttacggttacggggaaccgttaagggtaccgtttaccgacgtttccctaccgtaccgtaacgttacccgagtcccgtaacgtccctagggtaccctaggttaccgtaaacggtaaccggttactttacccgtaggtttacccttttaacgttttaaccgtttacccggtagttacccggttataacccgg

SEQ ID NO: 47486 - DNA, 606 bp, Homo sapiens
  misc_feature: GYAE6OF02JLGCF.34.6.A06.1.454.CMB.1.raw
  modified_base (167)..(167): a, c, t, g, unknown or other
  misc_feature (167)..(167): n is a, c, g, or t
  modified_base (240)..(240): a, c, t, g, unknown or other
  misc_feature (240)..(240): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
  modified_base (469)..(469): a, c, t, g, unknown or other
  misc_feature (469)..(469): n is a, c, g, or t
  modified_base (501)..(501): a, c, t, g, unknown or other
  misc_feature (501)..(501): n is a, c, g, or t
  modified_base (540)..(540): a, c, t, g, unknown or other
  misc_feature (540)..(540): n is a, c, g, or t
  modified_base (565)..(565): a, c, t, g, unknown or other
  misc_feature (565)..(565): n is a, c, g, or t
  modified_base (594)..(594): a, c, t, g, unknown or other
  misc_feature (594)..(594): n is a, c, g, or t
tcagtacacgtgatcacgaccggtgctcgatttagatctactgacagggaaccatggaaacccagcgcagcttctcttcctcctgctactctggctccagatatcaccggagtaaattgtgttgacacagtctccaggcaccctgtctttgtctaccgagggggaanacgtccaccctctcctggacacgggtccagtcacgtgttacgttaatacgcattcgtcttagccgttggaccnggctaaacggaactgggtcccatccctccaagtcctccgtactagttaatcggtagcacttaacncgacggggcccctgggctaaccgtcccaaagctacggtctaggtcncgtacgtggtacgtcggganatcgtctacgtcctnaaccgntccggaactgtcgaaggctaccgngtaaactcgtttcagtctgtacttacgntactaacgtgtcgtctanaccgtanacgttgaaccggttgacggacggtcgtaacgnggaactaggacggtactaggcggactcggacaacgtccngtacctggtaacctgtccttaccgntatccgtataccgtctaagttaccctggnggttcgacgggg

SEQ ID NO: 47487 - DNA, 704 bp, Homo sapiens
  misc_feature: GYAE6OF02H375U.34.6.A06.1.454.CMB.1.raw
  modified_base (165)..(165): a, c, t, g, unknown or other
  misc_feature (165)..(165): n is a, c, g, or t
  modified_base (374)..(374): a, c, t, g, unknown or other
  misc_feature (374)..(374): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctcaggggaaangccacctctcctgcagggccagtcagagttgttaatagcatctacttagcctggtaccagcaagaaacctggccacgcctacccagtacctcctactacttaagtggtgacaatacgtacgacgggcccctggacactcccagacgtacggttcaggtcggctagggttgggtcgtagggacagtaccttcaactctcacctatcaccngaactgggactaccgtagtaaacgtagttttacgcgtaagttcgtttaacgttaccgttacgttaccgttaaacgtacgggttttacggtaccttaccgtaaccgtaccgttaccgggtttacggtaccggttttaccggggaacccgttaaacggggaaacccgtaaaggggtaaccggtaaaagtaaccgtaaaaccgtaacggttggtaccgggtactacggtaccaaacgttacttcgttacgttccttacgtacgtttcccgtacccctacgttaactaccgtagtaactaccgtacggttacgtaaccggtggaccggtacggg

SEQ ID NO: 47488 - DNA, 315 bp, Homo sapiens
  misc_feature: GYAE6OF02GGRSC.34.6.A06.1.454.CMB.1.raw
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (300)..(315): a, c, t, g, unknown or other
  misc_feature (300)..(315): n is a, c, g, or t
tcagtacacgtgatcacgaccggtgctcgatttagatctactgacagggcccctggcatcccagacaggttcagtggcagtgggtctgggacagacttcactctcaccatcaccagactggagcctagaagtattttgctagtgtattactgtcaacagttggtctcacactacgtggacgttcggaccaagggaccaaggtggaaatcaaacgactgtggctgcaccatctgtcttcatcctcccgcatcatacnctacgtntacgtgacggcggtgtcggacgacggcgactaagtgnnnnnnnnnnnnnnnn

SEQ ID NO: 47489 - DNA, 414 bp, Homo sapiens
  misc_feature: GYAE6OF02JEXC9.34.6.A06.1.454.CMB.1.raw
  modified_base (344)..(344): a, c, t, g, unknown or other
  misc_feature (344)..(344): n is a, c, g, or t
  modified_base (398)..(398): a, c, t, g, unknown or other
  misc_feature (398)..(398): n is a, c, g, or t
  modified_base (404)..(414): a, c, t, g, unknown or other
  misc_feature (404)..(414): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacacgggcccctggcatcccagacaggttcagtggcagtgggtctgggacagacttcactctcaccatcaccagactggacgcctagaagtatttttagcagttgtattactgtcaacagttggtcttcacactacggtggacgttcgaccgaagggaccaagggtaggaatccaaaacgacgtgtaggctgacaccatctgtcttcncttcctcccgcatctgtactctacgtctacgttgacggcggcgtggcgtaggcncatagnnnnnnnnnnn

SEQ ID NO: 47490 - DNA, 300 bp, Homo sapiens
  misc_feature: GYAE6OF02G3LS6.34.6.A06.1.454.CMB.1.raw
  modified_base (281)..(286): a, c, t, g, unknown or other
  misc_feature (281)..(286): n is a, c, g, or t
  modified_base (288)..(300): a, c, t, g, unknown or other
  misc_feature (288)..(300): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagattttgcagtgtattactgtcaacagttggtctcacacacgtggacgttcggccaaggaccaaggtggaaatcaaacgaactgtgctgcaccatctgtctcatctccgcatctgatcacgtgtactgagcgggctggcaaggcgcagtagnnnnnntnnnnnnnnnnnnn

SEQ ID NO: 47491 - DNA, 381 bp, Homo sapiens
  misc_feature: GYAE6OF02HVEA8.34.6.A06.1.454.CMB.1.raw
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (373)..(376): a, c, t, g, unknown or other
  misc_feature (373)..(376): n is a, c, g, or t
  modified_base (378)..(381): a, c, t, g, unknown or other
  misc_feature (378)..(381): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctagaagtattttgcagtgtattactgtcaacagttggtctcacacacgtggacgttcggccaaggccaaggtggaaatcgaaagactgtgctgcacatctgtcttcatccttcccgctatctgaatcagtgtactgagcggntggcaggcnatgnnnngnnnn

SEQ ID NO: 47492 - DNA, 321 bp, Homo sapiens
  misc_feature: GYAE6OF02F1PX1.34.6.A06.1.454.CMB.1.raw
  modified_base (288)..(288): a, c, t, g, unknown or other
  misc_feature (288)..(288): n is a, c, g, or t
  modified_base (294)..(321): a, c, t, g, unknown or other
  misc_feature (294)..(321): n is a, c, g, or t
tcagtacacgtgatcacgaccggtgctcgatttagatctactgacagggccccctggcatccccagaccaggttcagtggcagtgggtctggggacagacttcgactctcaccatcaccagactggagcctgaagattttgcagtgtattactgtcaacagttggtctcacactacgtggaccgttcgccaagggaccaaggtggaaatcaaacgaactgtggctgcaccatctgtcttcatcctcccgccatctgaatcacgttgtactgagcgggctggcaaggcncatagnnnnnnnnnnnnnnnnnnnnnnnnnnnn

SEQ ID NO: 47493 - DNA, 732 bp, Homo sapiens
  misc_feature: GYAE6OF02HW4V1.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagcccaccctctcctgcagggccagtcagagtgttaatagcatctacttagcctggtaccatcagaaacctggccagccctcccagtacctcctctaattaatggtcgacattacgtacgacgggccccctggccactcccgagacgtacggtctaggtggcgtagggttcggggtcgtacggggactaacggtacctttaccgtacctccgttacaacccgtaactacccgaacctaggtaacccgtgggtaacgtcccgttaacggtaaagttacgtttttacggaaccgttaggtttacgtttaaactttacgtttacgttaaccttaaacggttacggttttacggttcctacccgtactaaccggtaccgggttacgggtaaccggtttaccggaacccggtaacgggaaacccgtaagggtaacggaaacgttaaccgaaacgtaacgtcgtacggtacgtcgtacctacgtagttccttgttaccttctaccgttcccttcccgaccctagtacccgttagtaccttcgtaaccgttcggtacgttcggacggtccggg

SEQ ID NO: 47494 - DNA, 823 bp, Homo sapiens
  misc_feature: GYAE6OF02GUDZT.34.6.A06.1.454.CMB.1.raw
  modified_base (153)..(153): a, c, t, g, unknown or other
  misc_feature (153)..(153): n is a, c, g, or t
  modified_base (163)..(163): a, c, t, g, unknown or other
  misc_feature (163)..(163): n is a, c, g, or t
tcagtacacgtgatcacgaccggtgctcgatttagatctactgacagggaaccatggaaaccccagcgcagcttctcttcctcctgctactctggctcccagatatcaccggaagaaattgtgtgacacagtctccaggcacctgtcttgtcnccgagggaanacgccacctctcctgcgagggccagtcgaagtagtagttaaatagactattacctaagttaacgcccgttagggtaaccaaggtaccaaacggtaaaacccgtgggacccaacggtccctacccgagtaaccttcctactaagtttaaacgtgggtactacaagttaaccgtaacggaacccggggtcccccttagggaccaaccgtttaccccgaacggtaacccgtaaggggtttacccgaggttacgggacgtaggggttacggggttcgtacgggggaactaacggtaccttcgtactccgtccaaaccgtactacccgaactaagacgtaggaacctacgtaaggtaaactttgtttacgacgttaagttagttaacttacgtagtaacgtaaacgtcggttagtacctacaacggtacccggttaacggggttacggttaacccggttaccgggtaaacccgggtaaaacgggtaacccgtaaaaggggttaaacggtaaaacctaaaacggtaaaacccggtaacggtttcggtacggtaccgtacgaacccgtacttaaacgttcgtttaccttacgtaccttaacggttccctaaccggtacttacgtacttaggtaacctcgttaccggagttacgcggacggtaccggg

SEQ ID NO: 47495 - DNA, 487 bp, Homo sapiens
  misc_feature: GYAE6OF02HTDFE.34.6.A06.1.454.CMB.1.raw
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
tcagtacacgtgatcacgaccggtgctcgatttagatctactgactagggtccgagtcagagtgttaatagcatctacttagcctggtaccagcaggaaaccctggccaggctcccaggctcctcatctatgatgcgtcaacaggcactgcatcccagccaggttcacgtgccagtggtctgggccagtacttcactctcaccatcagcagcctanagcctaaagnttttgcaatttattactgtcagctagacgtagcaactggcctccttgacgcgtccttcggccgaaggcacgctaggagaattaacgactggcgctcgctacctgtctgtacttcgactccttccgacctatctgaacttcacgtcgtactcgagtcgggctgggactaggctctagtagtntactntcatacagtcacctntanacgtncgtancgagcngananantncgcgacncactctcgtctctctactctcgctc

SEQ ID NO: 47496 - DNA, 397 bp, Homo sapiens
  misc_feature: GYAE6OF02HVG84.34.6.A06.1.454.CMB.1.raw
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
  modified_base (389)..(397): a, c, t, g, unknown or other
  misc_feature (389)..(397): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgcagtgtattactgtcaacagttggtctcacacacgtggacgttcggaccaagggaccaaggtcggaaatcaaaacgaactgtaggctgcaccatctgtcttcactcttcccgcctatctgaactcacgtgtactgacgngggtctggcaaggcncatgnnnnnnnnn

SEQ ID NO: 47497 - DNA, 435 bp, Homo sapiens
  misc_feature: GYAE6OF02GS3QR.34.6.A06.1.454.CMB.1.raw
  modified_base (250)..(250): a, c, t, g, unknown or other
  misc_feature (250)..(250): n is a, c, g, or t
  modified_base (351)..(351): a, c, t, g, unknown or other
  misc_feature (351)..(351): n is a, c, g, or t
  modified_base (399)..(399): a, c, t, g, unknown or other
  misc_feature (399)..(399): n is a, c, g, or t
  modified_base (402)..(435): a, c, t, g, unknown or other
  misc_feature (402)..(435): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgctagtgtattactgtcaacngttggtctacacacgacgtggtacgttcggaccaagggaccaaggtaggaaatcaaacgtaactggtgctgacaccatctgtcttcacttctcccgcatcngaatcgacgtgtactgaggccggtacgtgggacaggcgacgtataggnagnnnnnnnnnnnnnnnnnnnnnnnnnnnnnnnnnn

SEQ ID NO: 47498 - DNA, 442 bp, Homo sapiens
  misc_feature: GYAE6OF02H43CE.34.6.A06.1.454.CMB.1.raw
  modified_base (398)..(398): a, c, t, g, unknown or other
  misc_feature (398)..(398): n is a, c, g, or t
  modified_base (420)..(421): a, c, t, g, unknown or other
  misc_feature (420)..(421): n is a, c, g, or t
  modified_base (423)..(442): a, c, t, g, unknown or other
  misc_feature (423)..(442): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctagaagtattttgctagtgtattactgtcaactagttggtctcgaacacacgtgggtaccgttcggaccgaaaggggaccaacgggttaggaaaactacgaaaacgaaccgttgtggcctgccaaccagtctgtcttcatccttcccgctatctagtaatcaacgtgtactgacggcggntacgggcaaggtcactatacgnnannnnnnnnnnnnnnnnnnnn

SEQ ID NO: 47499 - DNA, 627 bp, Homo sapiens
  misc_feature: GYAE6OF02H5MP6.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgtgacacagtctctaggcaccctgtctttgtctccaggggaaagagccaccctctcctgcagggccagtcagagtattagtagctacttcttagcctggtatcagcagaaaacctggcctggcgcccgaggctcctctatctatatgcctatagcagggccaacgtggccgtaccagacgtaggttacgagtcggcgaggtgggtcgtaggggaagtacttcgaactccgtacaccgtatcaggacacgacgtaggacgcgtagtaagtattttcgactagttgttaactttattgtacgtagacaacgactatctagtaccggttacgtaaccgtacgttacgttttacggaccggtacggggaaccgtaaggtacgtaggaacgtactaacgaaaacgtaaccgtaggtcggtacgtagacctaaccgacgttacgtacgttaccgttacttacgttacccgttcccggtacccacgtttaccgtacgtacgtacttaacccgg

SEQ ID NO: 47500 - DNA, 505 bp, Homo sapiens
  misc_feature: GYAE6OF02G59W5.34.6.A06.1.454.CMB.1.raw
  modified_base (353)..(353): a, c, t, g, unknown or other
  misc_feature (353)..(353): n is a, c, g, or t
  modified_base (499)..(499): a, c, t, g, unknown or other
  misc_feature (499)..(499): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaacctggccagcctccagactcctcattaatggtgcatactacacgggcccctggcatcccagacaggttcagtggcagtgggtctgggacagacttcactctcaccatcaccagactggacncctagaagtatttgctagtgtattactgtacaactgttggtctacacacacgtggacgttcggacaagggacaaggtgaaactacaaacgacgtgtggctagcacatctgtctcactcctccgctatctagactcacgtgtactgngtcggg

SEQ ID NO: 47501 - DNA, 417 bp, Homo sapiens
  misc_feature: GYAE6OF02I6R6V.34.6.A06.1.454.CMB.1.raw
  modified_base (356)..(356): a, c, t, g, unknown or other
  misc_feature (356)..(356): n is a, c, g, or t
  modified_base (388)..(388): a, c, t, g, unknown or other
  misc_feature (388)..(388): n is a, c, g, or t
  modified_base (398)..(417): a, c, t, g, unknown or other
  misc_feature (398)..(417): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgcagttgtattactgtcaacagttggtctcacacacgtggacgttcggccaagggaccaagggtggaaatcgaaacgaactgtaggctgccacatctgtcttcactcttccgcctatcctgaactcncgtgtactgtagcgggtctcggtcaagggtcnctaagtacgnnnnnnnnnnnnnnnnnnnn

SEQ ID NO: 47502 - DNA, 372 bp, Homo sapiens
  misc_feature: GYAE6OF02HNU7P.34.6.A06.1.454.CMB.1.raw
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (319)..(320): a, c, t, g, unknown or other
  misc_feature (319)..(320): n is a, c, g, or t
  modified_base (325)..(372): a, c, t, g, unknown or other
  misc_feature (325)..(372): n is a, c, g, or t
tcagtacacgtgatcacgaccggtgctcgattttagatctactgacagggccccctggcatccccagacaggttcagtggcagtgggtctggggacagacttcactctcaccatcaccagactggagcctgaagatttttgcagttgtattactgtcaacagttggtctcacacacgtggacgttcggccaagggaccaaggtggaaatcaaacgaactgtgctggccacgtatctcgttcttcacttccttccgccattctagtaactctacgtgtacnggacgcggtctggacgtaaggcggacataggcngancanngctannnnnnnnnnnnnnnnnnnnnnnnnnnnnnnnnnnnnnnnnnnnnnnn

SEQ ID NO: 47503 - DNA, 680 bp, Homo sapiens
  misc_feature: GYAE6OF02HGZFD.34.6.A06.1.454.CMB.1.raw
  modified_base (167)..(167): a, c, t, g, unknown or other
  misc_feature (167)..(167): n is a, c, g, or t
tcagtacacgtgatcacgaccggtgctcgatttagatctactgacaggggaaccatggaaaccccagcgcagcttctcttcctcctgctactctggctccagatatcaccggagaaattgtgttgacacagtctccaggcaccctgtctttgtctccgaggggaaanagccaccctctcctgcagggccagtcagagtgttaatagcatctacttagcctggtaccagcaagaaaccctggcccagccctccagacctcctcattaatggtgcactactacacgggcccctggccactcccagacaggttcaggtcggcaggtgggtctgggacagacttcactcacaccatcaccagacgtggacgccgtgaagtattttgacgtagttgttaattactcggtaactaaacgtaggtttcggtaccttacgaactaccgtaaccggttcgggtaacccggttttccgggacccgtaaacggggacccgtaaaagggtaggtaaaacgttaaccgaaaaaccggtaacgttacgggtcggtaaccgtacggtaacctaacccgtaacttccggtttacgtaccgtttacctaccgttttcccgttacccccgtcccgtaacttaccgttaacgttaacgttaccgtacggttacggttaacgtacggtacggtaccgggg

SEQ ID NO: 47504 - DNA, 792 bp, Homo sapiens
  misc_feature: GYAE6OF02JBL0Q.34.6.A06.1.454.CMB.1.raw
  modified_base (218)..(218): a, c, t, g, unknown or other
  misc_feature (218)..(218): n is a, c, g, or t
  modified_base (296)..(296): a, c, t, g, unknown or other
  misc_feature (296)..(296): n is a, c, g, or t
tcagtacacgtgatcacgaccggtgctcgatttagatctactgacagggcccctggcatcccagacccactgccactgaacctgtctgggatgccaggggccctgtagtatgcaccattaatgaggagctgctcagttaggacccagagggaaccatggaaaccccagcgcagcctctcttcctcctgctactctggcctcccagatactcaccgganaaatttcgtgttagactacagttctccacgccctaccctgtctttgtctccgaggggtacagacgtccaccctctccncggccgggctagtcgagtagtatacggtatctactttctacgtccgttggtactcgagcctaaacgtaaaccgttgggcccttcggggcccgtacccgaggaccttcccgtacaacttccggttactgtaccctaacgtacctacccgacccgtacggggaccctaaccgtcggtaccttaactccccgtaacggtcccggttaaaccgggtttaccagggtttacggggtacccttaacgggggtttaccggggtttaaccggtccggggaaaccgttacgggggttaaccgttttacccgaacgtttacccttcccgtaaaaccccttaaggttaccccaaacgggttacccgtaacggtccccgttacggtaccgtaaacggttttaacccgttaagggtaacccgttaaacgtttttccgtaacccgggttttaaccttttaaacccggtttttttataaaccccggtttttcgggaacccgtttaaaccgg

SEQ ID NO: 47505 - DNA, 385 bp, Homo sapiens
  misc_feature: GYAE6OF02I43EK.34.6.A06.1.454.CMB.1.raw
  modified_base (326)..(326): a, c, t, g, unknown or other
  misc_feature (326)..(326): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (378)..(385): a, c, t, g, unknown or other
  misc_feature (378)..(385): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttgatctcacacagtgacgttcggccaagggaccaaggtggaaaatcgaaacgaactgtggctgcacatctgtcttnatctccgccatctgaatcacgtntacngagcgggctggctaaggcctcatgnnnnnnnn

SEQ ID NO: 47506 - DNA, 722 bp, Homo sapiens
  misc_feature: GYAE6OF02I7J6H.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagcccaccctctcctgcagggccagtcagagtgttaatagcatctacttagcctggtaccagcaagaacctggccagccctacccagacctccctctattaatggtgcaatacctacgcgggccccctggcactaccccgacgacgtacgggttacctaggtcggaccgagggttcggggtaccgttagggggaaccgtaacggtaccgtttacctaaccgttcctacccaaccctacgttacccaacccaacggtacccgtacggggtacggtaccccgttaagggtaaacgttaatttttacggacctaggtttacggttaaacttttacgtacgttaaccgtaaaccggtaggttttaccgggttctaccgtaacctaccgtaccggttacggtacgtttacccggaaccggtaaccggggaacctaaacggggtaggaaacgtacgaaacgtagtacggtgtacgtacgaccactatcgtgtcttactaccgttccttcccgtactactaccgttagtacttccggacgttgtaccggttaggacggtcggg

SEQ ID NO: 47507 - DNA, 630 bp, Homo sapiens
  misc_feature: GYAE6OF02JGQ4Q.34.6.A06.1.454.CMB.1.raw
  modified_base (132)..(132): a, c, t, g, unknown or other
  misc_feature (132)..(132): n is a, c, g, or t
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (564)..(564): a, c, t, g, unknown or other
  misc_feature (564)..(564): n is a, c, g, or t
  modified_base (597)..(599): a, c, t, g, unknown or other
  misc_feature (597)..(599): n is a, c, g, or t
  modified_base (601)..(630): a, c, t, g, unknown or other
  misc_feature (601)..(630): n is a, c, g, or t
tcagtacacgtgatcacgaccggtgctcgatttagatctactgacagggccagtcagagtgttaatagcatctacttagcctggtaccagcagaaacctggccagcctcccagactcctcattaatgggtancatactacaggcccctggcatcccagacaggttcagtgcagtggtctgggacngacttcactntcacatcacanactgggancctgaagtattttgcagttcgattacgtgttcaacgtacgttggtacctcgacacgtacggtggtacgtttaccggaccaaaggggaacccgtaaggttcgggaaaaacttccggaaaaaaccggttaaacgttcggtacgggtcctttaggggacccctaaaaccccgtaagttccccttaaggggtttcccttacgaaccctttcccggtttacccccgacccttaagttacctacgggttaaaacctccgttaccgggtttaacgtttacccaaggggtacgggtaccgggtacccggtttagggaaccgttaaaccgggggctaaccctaagggttagttaaacgngaaacgtgtaccagtttgcacggtttcagttcnnngnnnnnnnnnnnnnnnnnnnnnnnnnnnnnn

SEQ ID NO: 47508 - DNA, 297 bp, Homo sapiens
  misc_feature: GYAE6OF02GUQR7.34.6.A06.1.454.CMB.1.raw
  modified_base (292)..(297): a, c, t, g, unknown or other
  misc_feature (292)..(297): n is a, c, g, or t
tcagtacacgtgatcacgaccggtgctcgatttagatctactgacagggcccctggcatcccagacccactgccactgaacctgtctgggacagacttcactctcaccatcaccagactggagcctgaagtattttgcagtgtattactgtcaacagttggtctcacacacgtggacgttcggccaagggaccaaggtggaaatcaaacgactgtggctgcaccatctgtcttcatcttcccgctatctgaatcacgttgtactggagccgggctggacaaggcacagtagnnnnnn

SEQ ID NO: 47509 - DNA, 659 bp, Homo sapiens
  misc_feature: GYAE6OF02IMOG5.34.6.A06.1.454.CMB.1.raw
  modified_base (383)..(383): a, c, t, g, unknown or other
  misc_feature (383)..(383): n is a, c, g, or t
tcagtacacgtgatcacgaccggtgctcgatttagatctactgacagggaaccatggaaaccccagcgcagcttctcttcctcctgctactctggcctcccagatatcaccggagaaattgtgttgacacagtctccaggcaccctgtctttgtctccaggggaagagccacctctacctgcagggccagtcagagtgttaatagcatctacttagcctggtaccagcagaaacctggaccagcctccagacctcctcaattaatggtcgctatacgtaccgagggcccctggccactcccgagaacgtaggttaccaggtcggacgtaggttgggtctgggactacgtacttcactctacaccactcaccgagactcggacncctagaacgtagtttcgacgtagtgtaagttacgtagtactaaacgtacggtttagtactacacgtaacgtacggttacggtaccggttacggaccgtaaacgggtaccgtaaagggtcggaaaaaacgtcgaaaacggtacgtaggtacggtacgtacgaccgtaccgtacgtccgttacgtcttaccgtaacgttcccgttaccccgaccgtaacgttacctaacgtaacgttaccgtaaccggtttacgtaaccgtacggtaaccggtccggg

SEQ ID NO: 47510 - DNA, 578 bp, Homo sapiens
  misc_feature: GYAE6OF02F7L1W.34.6.A06.1.454.CMB.1.raw
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaaacctggccagccctcccagacctcctcattaatggtgctatactacagggcccctggcactcccagacnggttcagtggcaggtgggtctgggacagtactcactctcaccatccacagacgtagganccgtagaagttatttcgactagttgtattactgtacaacgtgttcgtctacactacacgtggtaccgtcggaccgaacgggtacgaagggtacgtaaactacgaaacgtacgtgtacggacgtacgacgacctagttccgtgtccttacgtacgtttcccgtcccgtacctacttcgtacgtacttcggaaccgttacgtaccgttggacggtccggg

SEQ ID NO: 47511 - DNA, 806 bp, Homo sapiens
  misc_feature: GYAE6OF02GX0PO.34.6.A06.1.454.CMB.1.raw
  modified_base (209)..(209): a, c, t, g, unknown or other
  misc_feature (209)..(209): n is a, c, g, or t
  modified_base (614)..(614): a, c, t, g, unknown or other
  misc_feature (614)..(614): n is a, c, g, or t
  modified_base (653)..(653): a, c, t, g, unknown or other
  misc_feature (653)..(653): n is a, c, g, or t
  modified_base (671)..(671): a, c, t, g, unknown or other
  misc_feature (671)..(671): n is a, c, g, or t
  modified_base (693)..(693): a, c, t, g, unknown or other
  misc_feature (693)..(693): n is a, c, g, or t
  modified_base (756)..(756): a, c, t, g, unknown or other
  misc_feature (756)..(756): n is a, c, g, or t
tcagtacacgtgatcacgaccggtgctcgatttagatctactgacagggcccctggcatcccagacccactgccactgaacctgtctgggatgcctagggaccctgtacgtaactgtccaacctattaagtcgtagggaaggccttggacgttacgttaaggttacggacccgtaagaacgggttaaccaggttacggaaaacccccgngaaccgtcgtaacggtctttaccgtccttcccgtccgttggtccgttaccgtccgtagggaccctaccgtaaggtaacttaccgtaaccgaaccggtaaggttaagttcggttacggtacgaaccgtacgtacggttaccgtaccgtacgtaccgttacccccgttcgttacccgttacgttaccggttccgtaaccgggtaaagggtaaccggtaccgtaccccgtaacccgttccggtccggtcggtacggtacgggtacctacggtacgacggttaccgtacgttaaccgaccttaccgttccgttccggtaccttcgggtaccagcgtaacgaccgtaccgtgacccgtacgacccgttccagtcctaccgtctgttccggttgtaccgccgtaccgacgnggacctcgtacgcacctccggataacgacggttcacggngttacggtagtcgggtancgtctacgacttacgtaccgtntaaccgctaacgtcgactacggtcgttactagggtactacgtaggttaacccttgttacggtnttaacgttaatttccgttactcggaaacgttcggttaaccaagttaccgg

SEQ ID NO: 47512 - DNA, 441 bp, Homo sapiens
  misc_feature: GYAE6OF02HQDMC.34.6.A06.1.454.CMB.1.raw
  modified_base (379)..(379): a, c, t, g, unknown or other
  misc_feature (379)..(379): n is a, c, g, or t
  modified_base (397)..(398): a, c, t, g, unknown or other
  misc_feature (397)..(398): n is a, c, g, or t
  modified_base (404)..(441): a, c, t, g, unknown or other
  misc_feature (404)..(441): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagaccaggttcagtggcagtgggtctgggacagacttcgactctcaccatcaccagactggagcctagaacgtattttgcagtgttattactgtcaactagttggtctcacacacgtggacgttcggaccaagggaccaagggtggaaaatcgaaacactgtggctgcaccatctgtcttcactctccccgctattctgaatcgacgttgacttggagccgggntcgggcaaggcgcagtanngatcgnnnnnnnnnnnnnnnnnnnnnnnnnnnnnnnnnnnnnn

SEQ ID NO: 47513 - DNA, 723 bp, Homo sapiens
  misc_feature: GYAE6OF02I5PR4.34.6.A06.1.454.CMB.1.raw
  modified_base (426)..(426): a, c, t, g, unknown or other
  misc_feature (426)..(426): n is a, c, g, or t
  modified_base (650)..(650): a, c, t, g, unknown or other
  misc_feature (650)..(650): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaagacgccaccctctcctgcagggccagtcagagtgttaatagcatctacttagcctaggtaccagcagaaacctggccacgccctccgagacctccgtcaattaagtcggtgaccaatacctacgacggggtccccctggctacgtcccgagtacctagggtttccaaggtcgggactagggtcggggtactacgggggaacacgttcccgttcaccgttctacccgtaaccactacccgtaaccgacggtactaggggaccnccgttaagaacgttagttttcgacgtaagtttacggtttaactttaacgtcggttaacctaaacggttacggtttacggtcctaacctaccgtaaaccggtacggtttaaccgggtcgttaaccgggacccggtaaacggggacctaagggtaacggtaaactaaccgaaacggtactgggtaaccggtctaacggtccaacttacgtcgttactcgtttaacnccggtttacccttaccgaccgtacttacggtacgtaacttcgtaccggttattaccggtaggaccggtacggg

SEQ ID NO: 47514 - DNA, 671 bp, Homo sapiens
  misc_feature: GYAE6OF02IYUXT.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagttgttaatagcatctacttagcctggtaccagacagaaacctggccacgcctacccagacctcctcaattaactgtgacatactacgacggcccctggaccatccccgagtaccgaggttccgagtcggctaggtgggtcgtagggacctagaccttcactctacaccataccaccagacgtaggacgtacctagtaaacgtagttttgacgttagttagtttaatttactacgttactaacgtaggtttacggtcctacaacgaaccgtaccggttacggtaacggtttaccgggaacccggtaaaccggggtaaacgtaaacggggtaacggtaaaacgtaccgaaaaccggtacgttacgtaggtaccgttaggactaaaccgagttcgtacgttaccttacgtacgttaccttacccgtaacttctaacgttgaacttacgtacgttacggttacgtacggacgtacgggg

SEQ ID NO: 47515 - DNA, 731 bp, Homo sapiens
  misc_feature: GYAE6OF02INJEA.34.6.A06.1.454.CMB.1.raw
  modified_base (302)..(302): a, c, t, g, unknown or other
  misc_feature (302)..(302): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacgcagtctccagcccaccctgtctttgtctccgaggggacagagccaccctctccgttcggggccagtcagtagtattagtagcttacttcttagccgtggtaccagcacgaaacctggcccagccctccagaccttcctcaatttaagtggtgacctatactacgacgggccccnggctactcccgagacgtaggttcaggtggacgtaggtcgggtcgtgggacaggtacttccgacttctaccacctactaccaactagtacgtcggacgtcgtaggtaagttacgttttgacgtaggtttacgtttaacgtttaccgttacggttacgtaaacgtttacgggttacggttaccctacgtaccgtaccgtaccgggttacggtaccggttaccgggacccggaaacggggtaaccgtaaaggggtaacgtaaaccgtaaccgtaaacggtaccggttaggtaccggtacgttacgacccgttaactaacgttcgttaacgttacctttaccgtaccttcccggttaccccgtacttacgttacgttacgtaaccgttacgttacggttacgttacggtacggtaccggtcgggtctaccggg

SEQ ID NO: 47516 - DNA, 799 bp, Homo sapiens
  misc_feature: GYAE6OF02I7P8K.34.6.A06.1.454.CMB.1.raw
  modified_base (265)..(265): a, c, t, g, unknown or other
  misc_feature (265)..(265): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtgttaatagcatctacttagcctggtaccagcagaacctggccagcctccagacctcctcattatggtncatactacgacgggcccctggcctactcccagactaggttccaggtcggcaggtcgggtctgggactagtaccttcactcctacaccactcaccagacgtggactccgtagtaacgttagttttcggactagttagtttaacgttacgttacggttaccaaagtttacgggtttacggttaccctaccgtaacgtaacccggttaccgggttcgggtaaacccgggttttcccgggaacccgtaaaaccggggggtaaccgtaaaacgggggttaaccggggtaaaaaacttacccggtaaaaaccgggtaaccggtttacggggttaacgggtacccgttaaccggtaacccgtaaaccccgttaagtttacccgggtttaaccggttttacccttttaaccggacccgtttttaacccccggtttacccccggaacccgtttaacgtttaaccccggttaaagtttaacccgttacccggttaaccgggtttaccggtttaacccggtaggggtaccgggttaacccggggg

SEQ ID NO: 47517 - DNA, 698 bp, Homo sapiens
  misc_feature: GYAE6OF02HGQ8H.34.6.A06.1.454.CMB.1.raw
  modified_base (168)..(168): a, c, t, g, unknown or other
  misc_feature (168)..(168): n is a, c, g, or t
  modified_base (691)..(691): a, c, t, g, unknown or other
  misc_feature (691)..(691): n is a, c, g, or t
tcagtacacgtgatcacgaccggtgctcgatttagatctactgacagggaaccatggaaaccccagcgcagcttctcttcctcctgctactctggctcccagatatcaccggagtaaattgtgttgacacagtctccaggcaccctgtctttgtctccgaaggggaanagccacctctcctgcgagggccagtcagtagttagttaatagctattactacttagcctaggtaccagacgaacgaaccgtcggaccacgtcctaccgagtaccttccctactaagttaaacgtggtacacgtaacttaacgtacggtacccgggtccccgtaaggcctaaccgttacccgaacgtaccggtaggttacctaacgggtcggtacgtagggtcgggttacggaggggtaactacgtacttcccgtaatccgtaccaccgtacaccaacgcgtacgtacggtacgtccgtagtaaacgttgttttcgaacgtacgttagttacttacgtacgtaactaggttacgtttcggtactacacgtacgtagtacggttaaccgtcgaccggtaaggaaccgtaagggtacaacgtaacggaacttacgtaggacgtgtaccgacgaccctatcgttcgttacgtacttacgtccttaccggactacgtcgtaactcggaccttcgtaggtacgtcgggngtaccgg

SEQ ID NO: 47518 - DNA, 734 bp, Homo sapiens
  misc_feature: GYAE6OF02GZYDO.34.6.A06.1.454.CMB.1.raw
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
tcagtacacgtgatcacgaccggtgctcgatttagatctactgacagggaaccatggaaaccccagcgcagcttctcttcctcctgctactctggctcccagatatcaccggagaaatttgtgttgacacagtctccaggccaccctgttctttgtctccgaaggggaaagcgcccaccctctcctgcngggccagtcagagttgttaancgctattcacttgcctggacagaccagaacctggccctacgaccgtcccacgtacctaccttactaattagtggtcgctaacctaaccgtaccggaccggtcccgtcgggaccaccttaccccgaagtaccgtagggttccagggttcgggactaggggttcgggtcgttacggggaacctacgttacttaccaccgttccttaccaacctaagtaccgaaccctagtacggtacgtaaccggtctaaggtaaagtttctttacgtcgtaaggttcgtttaacttacggtttactaacgtaacgtaggtttactacgtaactacgcgtaaccggtggttaaccggtcggtaccggaacgggtccgaagggtacggaaactacgggtaaacgtaacttcgggaacgtacttagacccttacagttacccgtattccgtttactacccgtttcccgttcccgaatttaccggttccctaagtaccgttttcgaaaccgtttgtaaccgggttcacgggttacccgg

SEQ ID NO: 47519 - DNA, 286 bp, Homo sapiens
  misc_feature: GYAE6OF02F9SGW.34.6.A06.1.454.CMB.1.raw
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (281)..(286): a, c, t, g, unknown or other
  misc_feature (281)..(286): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtgaaatcaaacgactgtggctgcaccatctgtcttcatcctcccgcatctgatcacgtntacngagcggctggcaggcncatagnnnnnn

SEQ ID NO: 47520 - DNA, 705 bp, Homo sapiens
  misc_feature: GYAE6OF02II589.34.6.A06.1.454.CMB.1.raw
  modified_base (168)..(168): a, c, t, g, unknown or other
  misc_feature (168)..(168): n is a, c, g, or t
  modified_base (237)..(237): a, c, t, g, unknown or other
  misc_feature (237)..(237): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggccaccctgtctttgtctccgaaggggaanacgcccaccctctcctgcgacgggccagtcgagagttagttaatagctatctacttagcctaggtaccngacaagaaacctggccagtcctccagacctcctactattaagtggttcgactactaccgtacgaccgggtccctagggcctaacgtccccgaaggaccgttacggttcctaaggtcggaccgtagggtcggtcgtacgggatacgtctacgtactcctacaccgataccacgtagtacgtcggactcgtagtaaacgttgtttacgacgttagttagttaacgttacgttcgtaactaacggttagtttaccgggttactaccgtaacgtaccgtacggtacggttacccggttaccggaaccggtaacgggaaccggttaaggtaacggtaaactacggaaaacgttacggtaggtcggtacgtacgacctactaacgtcgttacgttaccttcgtaccgttcccgtacccgtactacgtaccgttagtacgttacgtaccgttacgtacgtagggtaccgtacggg

SEQ ID NO: 47521 - DNA, 792 bp, Homo sapiens
  misc_feature: GYAE6OF02IPCQX.34.6.A06.1.454.CMB.1.raw
  modified_base (481)..(481): a, c, t, g, unknown or other
  misc_feature (481)..(481): n is a, c, g, or t
tcagtacacgtgatcacgaccggtgctcgatttagatctactgacagggaaccatggaaaccccagcgcagcttctcttcctcctgctactctggctcccagatatcgaccggagtaattgtgttcgacacagtctcgagccaccttgttcttttgcctaccggaaggggaaacgcgccctacctcctccgtcgcgacgggccagtcgaggtagttagttaagtacgtactacgttaccttacgttacgtccggttaccggtaaccgaacggaaccgtaaacggtaaacccggttaccggacccgacccggtaccccgtaccccgaacgttaccccttaccgttaatttaaagttaacggttcgggactaactaaccgtttaaccgacggcccggggttcccctaggacctacctacccggaagtaccgttcggttacgcgtagggtactcgggtcggtacgtaggaacttctccgttacncgtccacgacttacaccgaagcgtaggtcgaccgtagttacgttaagtttcgttcgatacgtttatttactacgtacgtaagtacgtagttcgtacctacgacgtaccggtaggtccggtaacgggttccggaacgtaaacgggttaccggtaaagggaaccgtaaacgttaccgaaacgggttacgtacggtacggtccgtaaccgtacctacgttaccggtcttaccggttacctaccgtttccgtcccttcccgacttacgtaccgtagtaaccttcggaaccgtttcggaacgttccggcgggtacg

SEQ ID NO: 47522 - DNA, 412 bp, Homo sapiens
  misc_feature: GYAE6OF02FKNZZ.34.6.A06.1.454.CMB.1.raw
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
  modified_base (394)..(412): a, c, t, g, unknown or other
  misc_feature (394)..(412): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagtattttgcagtgtattactgtcaacagttggtctcacacacgtggacgttcggccaagggaccaagggtggaaatcaaaacgaactgnggctgcaccatctgtctcatccttccgccatctgaatctacgtntacctggacggcgggctggacgaagggccagtagtagcnnnnnnnnnnnnnnnnnnn

SEQ ID NO: 47523 - DNA, 489 bp, Homo sapiens
  misc_feature: GYAE6OF02JE2Q1.34.6.A06.1.454.CMB.1.raw
  modified_base (130)..(130): a, c, t, g, unknown or other
  misc_feature (130)..(130): n is a, c, g, or t
  modified_base (197)..(197): a, c, t, g, unknown or other
  misc_feature (197)..(197): n is a, c, g, or t
  modified_base (390)..(390): a, c, t, g, unknown or other
  misc_feature (390)..(390): n is a, c, g, or t
  modified_base (454)..(489): a, c, t, g, unknown or other
  misc_feature (454)..(489): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtncatactacagggcccctggcatcccagacaggttcagtggcagtgggtctgggacagaattcactcncaccatcagcagcctgcagtctgaagtattttgctagttttattactgtcagcagtataaatacgtggacccgtccggggacttcggaccgtaacgggaccaagggtcggtaaattaccaaaacggatcggtgctcgacacctatcgttataccgttcacgttccctcccgcaatttccagtaactcacgttntaacgtgaacggtccgggtacgtacggggaacgtacgggacgttgaacgtagagtccatcgagnnnnnnnnnnnnnnnnnnnnnnnnnnnnnnnnnnnn

SEQ ID NO: 47524 - DNA, 848 bp, Homo sapiens
  misc_feature: GYAE6OF02IP9MF.34.6.A06.1.454.CMB.1.raw
tcagtacacgtgatcacgaccggtgctcgatttagatctactgacagggaaccatggaaaccccagcgcagcttctcttcctcctgctactctgctccagatatcaccggagaattgtgttgacacagtctccaggcaccctgttctttgtctccgaaggggaaagacgccctaccctctcctgcgacggccagtcagtagttagttaaagtacgcattacctaacgttagtccgttacggtaaccgacgacgaacgaaacccgtccggacccgacgaccctaccccggaacggtccctcccttctaacttcctaacgtgtaacgttcggccgtaaccccgaacgaaccgggaccctaccgtcgacacgtaccccacggtccgtacggttacgacggttcggacggtacgggtgggttccgtacgggtacccgagtaccttccgacctttacccgacctaccgaactacgtaacgtccgtaacgtaccgtaagggaacctaacgttaaaacgttttacttttaggtaactttaaacgttttaaactttaacgttcgttaacgtacggttagtacggttacgtaaacgttaccgaacggttacccggttcccgtaccgttacgtacgtcccgggttacccggtaccgggtaccgggtaacggtaaccgaccgtaggtaacggtaaacggttaaaccgtttaaaaaccgggtcgttacgggtacggtttacccggaccggttaaccgtaccgttaccggtttaacctttaccgttaacccgtttacgtttaccctttaccccggttaccccgtaccgttacttcccggttaacgtaacccggttaaccgg

SEQ ID NO: 47525 - DNA, 775 bp, Homo sapiens
  misc_feature: GYAE6OF02HOPRA.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggccaccctgtctttgtctccgaggggaaagagcccacctctcctagcacgggccagtcagagtgttaatagcatctacttagcctggtacagcagaacctgccacgcctaccacgacctccctacgtaactttaagtggtcgacattaaccgtaccgacggggccccctggtaccactccccgaagtaccgtacgggttccaaggttcggaccgtagggtcggggttctaggggaactaggtaccttcgaaccttcctaccaaccctactacccgaaaccgagtaaccgttacgggacctacccgttaagggtaaacgttttcgttttacggactttacggttagtttaactttacgtcgtaactaacggttcggtttcgtacctacgacctaacggtaccgggttacggtacccggtttaccgggaaccgtaaacggggacccgtaaaggggtaacggtaaacttaaccggaaaaccgtacgttagggtacgtccgttacgaccttaccgtaacttcgttacgttaccctttcgtaccgtttccccttaccccggtaccttaactttcccggtaacgttaacccgttaccgtaacccgggttttacggtaccgttacggggaacgggttcccgggg

SEQ ID NO: 47526 - DNA, 675 bp, Homo sapiens
  misc_feature: GYAE6OF02HJ16E.34.6.A06.1.454.CMB.1.raw
  modified_base (170)..(170): a, c, t, g, unknown or other
  misc_feature (170)..(170): n is a, c, g, or t
  modified_base (213)..(213): a, c, t, g, unknown or other
  misc_feature (213)..(213): n is a, c, g, or t
  modified_base (367)..(367): a, c, t, g, unknown or other
  misc_feature (367)..(367): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
tcagtacacgtgatcacgaccggtgctcgatttagatctactgacaggggaaccatgaaaaccccagcgcagcttctcttcctcctgctactctggctcccagatatcaccggagaaattgtgttgacacagtctccaggccaccctgtctttgtctccgagggggaaancgcccaccctctcctgcgagggccaggtcaggtagttgttaanagcatctacttagccttggtaccagcagaaacctggaccagccctcccagacctcctactattaatggtgctactactacgacgggcccctggctactccagactaggttccaggtggcaggtcgggtcgtgggacagtacttcgactctaccncctatcaccgacgtacgtggacnccgtagtaacgtnttttacgacgtagttagtacttacgtacgtactaacgtaggtttcggtacttacacgtaaccgacggtacggttaccgttaccgggaccgtaaacgggaaccgtaacgggtacggtaaacgtaaccggtaaaccgtaacggttaggtacggtctacggacctaacctacgttacgttaccttacgttcctaacgtttccccttacccggaccttaacgttaccgtaagtaccttaccggtaccgttacgtaccggttggtacggtcccgggg

SEQ ID NO: 47527 - DNA, 737 bp, Homo sapiens
  misc_feature: GYAE6OF02JWYKY.34.6.A06.1.454.CMB.1.raw
  modified_base (167)..(167): a, c, t, g, unknown or other
  misc_feature (167)..(167): n is a, c, g, or t
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
tcagtacacgtgatcacgaccggtgctcgatttagatctactgacagggaaccgatggaacccagcgcagcttctcttcctcctgtctactctggctcccagatactcgaccggagaaattggtgttgacacagtctcaggcaccttgtctttgtctcgaggggaanagtccacctctccgtgccagggcctagtcaggattaggtaatacgcattctacttagcccgttcgggtaccagnaaacgtaaccgtggccgacctccctaccagtacctcccttcgtaactttaagtgggtcntaactaccgttacgaccggggtcccagccgtaaccgtacccgaggtacaacggtttcaaggtcgacggtggtacgggtacgtgggaaccgtagtcttaccgactcctaccgtaccaacgtcaaccgtcgtaaccgtggtaacgccgtaaggtaacttagttttgaaccgtgttacgtattacgtaggtactacgtaggtcgttctaccgttacaccgtacggtaacgtcggttaccgtaacggaacggaccggttaaggtagggtaaacctaacgggtaaactaacgggacgtttagggtacccgtgtaacccggtccttaaacttaccgtacggtttcctttaacgtacccggttacccctttacccggtaccctaacttccggttaattacggttaccttacgggtcgtttaaccggtccgggacccgggtaggg

SEQ ID NO: 47528 - DNA, 482 bp, Homo sapiens
  misc_feature: GYAE6OF02FMFM9.34.6.A06.1.454.CMB.1.raw
  modified_base (123)..(123): a, c, t, g, unknown or other
  misc_feature (123)..(123): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
tcagtacacgtgatcacgaccggtgctcgatttagatctactgacagggcccgtggcatcccagacccactgccactgaacctgtctgggacagacttcactctcaccatcaccagactggancctgaagattttgcagtgtattactgtcaacagttggtctcacacacgtggacttggccaagggccaaggtggaatcaaacgactgtggctgcaccatctagtcttcatcttcccgccaatctgaatcacgtntactgancgggctgggcaaggcgcaagttagcngcgnagntcanctgtctgctagctgctacgccngtncgntctaanccgaancctaagntacgcngatcgatatncgngtccntaccgtngcttcngaagtcaacttgcagtnacgntcgtacnaacggttcaatggtcagtagngtcaagtcctgaagttcgaaccngaacnccggtaatcccggattccgga

SEQ ID NO: 47529 - DNA, 775 bp, Homo sapiens
  misc_feature: GYAE6OF02H8SWS.34.6.A06.1.454.CMB.1.raw
  modified_base (167)..(167): a, c, t, g, unknown or other
  misc_feature (167)..(167): n is a, c, g, or t
  modified_base (202)..(202): a, c, t, g, unknown or other
  misc_feature (202)..(202): n is a, c, g, or t
  modified_base (386)..(386): a, c, t, g, unknown or other
  misc_feature (386)..(386): n is a, c, g, or t
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtcctcaaggggaaangccaccctctctgcagggcagtcagagtagttaanagcatctacttagcctggtaccagcaaacgtaaacctggaccaacggccctacccagtacctcctactaattaagtggtgactatacctaacgacgggtcccctggacctactaccccgaagtaaccgtagggtttcaggtacggcgtaggttggggtccgtagggactaacgcttacacttcnctaacctatcaacctaggtaacgtcggactaccgtagtaaacgttacttttaggcctaggttacgtttaaagtttaccgtaacgttaaactaaacgttacggtttagggttacctaccgtaaccgtaacggttaacggttaccgggtaaaccgggttttccggggaaacccgtaaacggggggtaaaccgtaaagggtaaacgggtaaaaacgtaaaccgtaaaaccggtaacgttgggtaaccgggtaccttaacggacccgttaaacgaacggtttccttaccgtttacgttaaccctacgttttacccgttaccccgtaacgttacttaccgtaacgtaacttacccgtaaaccggttacttaacggtacggacgggtacccgggg

SEQ ID NO: 47530 - DNA, 679 bp, Homo sapiens
  misc_feature: GYAE6OF02J0Q37.34.6.A06.1.454.CMB.1.raw
  modified_base (167)..(167): a, c, t, g, unknown or other
  misc_feature (167)..(167): n is a, c, g, or t
  modified_base (195)..(195): a, c, t, g, unknown or other
  misc_feature (195)..(195): n is a, c, g, or t
tcagtacacgtgatcacgaccggtgctcgatttagatctactgacagggaaccatggaaaccccagcgcagcttctcttcctcctgctactctggctcccagatatcaccggagtaaatttgtgttgacacagtctccaggcaccctgtctttgctaccagggaaancgccacctctcctgcagggccagtcagngtgttggcagacaacttagcctggtaccagcaacggaaccgtggaccaggtcctacccgagtaccgttcctctaagttctaagtcgactacgtactacccgacgaacggtcccacggtcgaccttacttacccggacgtacccgtaggttccgaacggtggtaccgtagggttcgggttacgacgggtaactacggttacgttaccgtacccgtcctacgtaacccgtattacggacgtccaacggtcctacggtaccgtacgtacgtacgtaaagtcgttaccgtacgtacttacgtttactacgtcgtactcgactagacttagacgtgtaccgttagtccgtacgaccgtaacggtacgtaagtacgtaacgtaccgtaaacgtacgttacgacgtacgtcgtacgtacctacgttctacgtaccttcgtacctcccgtccctagtacgttactacgtaccgtagtaccggttacgtacgg

SEQ ID NO: 47531 - DNA, 784 bp, Homo sapiens
  misc_feature: GYAE6OF02IVFHN.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgtctttgtctccaggggaaagagccaccctctcctgcagggccagtcagagtagttaatagcatctacttagcctggttaccagacaacgaaacctggacccagcccttcccagccttccctcgtaatttaacgtgggtcgactaattaaccttacccgacggggtcccccccttagggacctaaccgttcccccgaaggtaacccgtacgggttttacccaaggtccgggtacgacgggggttttcggggttaccgttagggggaaacctacggtacctttaaccgaccgttctaacccaacctaatccccgaacctaaggaacgttcggaacgtacccgtaggtaacgttacgttttacgaccgttagttagttactttacgtcgtaacgtaaacgtacgggtttcgtacctaccaacgtacgtaccgggtagggttaaccgttccgggaacccgtaagggacccgtaagggttacggaaactaaccggaaacggttacgtcgggttagtaccgacggtacctacgtaacgtttcctaggtttaccttacgtaacccgttcccttacccggtacctacgtttacccgtagtaacgttaccgtaccggttggttaaccggttcgagggttacccgggg

SEQ ID NO: 47532 - DNA, 295 bp, Homo sapiens
  misc_feature: GYAE6OF02FYJ7W.34.6.A06.1.454.CMB.1.raw
  modified_base (165)..(165): a, c, t, g, unknown or other
  misc_feature (165)..(165): n is a, c, g, or t
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (281)..(295): a, c, t, g, unknown or other
  misc_feature (281)..(295): n is a, c, g, or t
tcagtacacgtgatcacgaccggtgctcgatttagatctactgacagggccccctggcatcccagacaggttcagtggcagtgggtctgggacagacttcactctcaccatcaccagactggagcctgaagatttgcagtgtattactgtcaacagttgtctcanacacgtgacgttcggccaaggaccaaggtggaaatcaaacgaactgtgctgcaccatctgtcttcatctcccgcatctgatcacgtntactgagcggactggcaggccnatagnannnnnnnnnnnnnnn

SEQ ID NO: 47533 - DNA, 732 bp, Homo sapiens
  misc_feature: GYAE6OF02JMG98.34.6.A06.1.454.CMB.1.raw
  modified_base (127)..(127): a, c, t, g, unknown or other
  misc_feature (127)..(127): n is a, c, g, or t
  modified_base (171)..(171): a, c, t, g, unknown or other
  misc_feature (171)..(171): n is a, c, g, or t
  modified_base (181)..(181): a, c, t, g, unknown or other
  misc_feature (181)..(181): n is a, c, g, or t
  modified_base (212)..(212): a, c, t, g, unknown or other
  misc_feature (212)..(212): n is a, c, g, or t
  modified_base (636)..(636): a, c, t, g, unknown or other
  misc_feature (636)..(636): n is a, c, g, or t
tcagtacacgtgatcacgaccggtgctcgatttagatctactgacagggaaccatggaacccagcgcagcttctcttcctcctgctactctggctccagatatcgaccgagaattgtcgttagacanagtctccaggccaccctgttctttgtactccgaaggggaagacncctaccctcncctgcacgggtccagtcagagttgttaatancataccttacttaggccttagggtaccagacctaacgaaacccgtggcccacggtccctaccccgagacccttcctacaatttaactgggttacactaagttaacctaaccggccgggtaccccccgttgggaaccctaccgtaccccaggaccgttaacgggtttcaagggtttcggaccgttaagggttcgggtcggtacgggaccgtacgtaacctttcgaaccttcctacccgtacaacttacaacccgttaagggacctacggggacttccgagtaaaccgttagtttgacgtagttacgtattactcgtacgtaacgtgttcgtctaccgactacgtaacggtggtaaccgttcgaacccgtaaggaacccgtaaggtacgaactacgaactacgtacggtgtccgtacaccggtacngttaccttcgtacgttacgacctttacccggttacctcccgtaattcgttaacggtactaccggttacctaggttacggtagtaccgggtaccggg

SEQ ID NO: 47534 - DNA, 296 bp, Homo sapiens
  misc_feature: GYAE6OF02FTQ9N.34.6.A06.1.454.CMB.1.raw
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (284)..(296): a, c, t, g, unknown or other
  misc_feature (284)..(296): n is a, c, g, or t
tcagtacacgtgatcacgaccggtgctcgatttagatctactgacagggcccctggcatcccagacaggttcagtggcagtgggtctgggacagacttcactctcaccatcaccagactggagcctgaagtattttgcagtgtattactgtcaaactgttggtctcacacacgtggacgttcgcgaaggaccaaggtgaaatcaaagactgtgactgcacatctgtctnacttctcccgcatctagactcacgtgtactgaggccggntggcgaggcntagtgnnnnnnnnnnnnn

SEQ ID NO: 47535 - DNA, 494 bp, Homo sapiens
  misc_feature: GYAE6OF02GUAGL.34.6.A06.1.454.CMB.1.raw
  modified_base (197)..(197): a, c, t, g, unknown or other
  misc_feature (197)..(197): n is a, c, g, or t
  modified_base (460)..(461): a, c, t, g, unknown or other
  misc_feature (460)..(461): n is a, c, g, or t
  modified_base (463)..(464): a, c, t, g, unknown or other
  misc_feature (463)..(464): n is a, c, g, or t
  modified_base (468)..(494): a, c, t, g, unknown or other
  misc_feature (468)..(494): n is a, c, g, or t
tcagtacacgtgatcacgaccggtgctcgatttagatctactgacagggccagtcagagtgttaatagcatctacttagcctggtaccagcagaaacctggccaggctcccaggctcctcatctatgatgcgtccaacagggccactggcactcccagccaggttcagtgcagtggtctgggccagacttcactccncaccatcagcacgcctagacgcctagaagttattttgctagttaattatttactgtacagacaaattagcgagacgcactagggtcgggccgttacgggaccgaagggaccgaaggtaggaaaactacgaaaacgtacgtaggtggcctagaccaccgtatctcgttccgttactacgtcccgttccccgctacttactacaactccgtaacggttctacgtaggacggcgggtctacgggacgtacggctaacgtaatcggnngnntcgnnnnnnnnnnnnnnnnnnnnnnnnnnn

SEQ ID NO: 47536 - DNA, 796 bp, Homo sapiens
  misc_feature: GYAE6OF02IB4FH.34.6.A06.1.454.CMB.1.raw
  modified_base (690)..(690): a, c, t, g, unknown or other
  misc_feature (690)..(690): n is a, c, g, or t
  modified_base (729)..(729): a, c, t, g, unknown or other
  misc_feature (729)..(729): n is a, c, g, or t
  modified_base (751)..(751): a, c, t, g, unknown or other
  misc_feature (751)..(751): n is a, c, g, or t
  modified_base (759)..(759): a, c, t, g, unknown or other
  misc_feature (759)..(759): n is a, c, g, or t
  modified_base (763)..(763): a, c, t, g, unknown or other
  misc_feature (763)..(763): n is a, c, g, or t
  modified_base (765)..(765): a, c, t, g, unknown or other
  misc_feature (765)..(765): n is a, c, g, or t
tcagtacacgtgatcacgaccggtgctcgatttagatctactgacgagggccagtcagagtgttaatagcatctacttagcctggtaccagcaagaaacctggccagcctcccagactcctcattaatggtgcatactacgacgggcccctggtctactcccagacgtaggttcagtggcgaggttgggtcgtgggacagtaccttcgtacctcctacacccgatccgaaccgaagtaccgtcggggtaaccggtccttagggtaaacgttacgtttttccggacgttaagggttacgtttaacgtttaaccgtttacggtaccgtaaaaccggtttgggtttaccggttacctaacgtaaccgtaccgtacgggttacgggtaccggtttccgggaacccgggtaaaccggggtaacgacgggttaaacggaaaactaaccgggtaaaacgggtacgttacgggcgggtaccgtcgtaaccaacgtaacgttaccggttacgttaccgttacgtaccgtttaccccggtcccgtacgtttaacctacgttaacggtaacgtttaccgtaaccggtttcggtaaacgttcgggggaccgggtacccgggtacggtaaccgggtaaccgggtaaccggtaccggtaacggtaaacggtaggaccctaggtaccgagaacggtcacgtaacncgtgcttacggactcggccttaggcgtacgctaggaacncgttaagcttgccgtaggttancgactcgngcgngngtacgacgacgaggagtggagtacgtagtcg

SEQ ID NO: 47537 - DNA, 535 bp, Homo sapiens
  misc_feature: GYAE6OF02HFAWH.34.6.A06.1.454.CMB.1.raw
  modified_base (219)..(219): a, c, t, g, unknown or other
  misc_feature (219)..(219): n is a, c, g, or t
  modified_base (488)..(488): a, c, t, g, unknown or other
  misc_feature (488)..(488): n is a, c, g, or t
  modified_base (492)..(493): a, c, t, g, unknown or other
  misc_feature (492)..(493): n is a, c, g, or t
  modified_base (497)..(535): a, c, t, g, unknown or other
  misc_feature (497)..(535): n is a, c, g, or t
tcagtacacgtgatcacgaccggtgctcgattttagatctactgacagggccagtcagagtgttaatagcatctacttagcctggtaccagcagaaacctggccagcctcccagactcctcattaatggtgcatactacagggcccctggcatcccagacaggttcagtggcagtgggtctgggacagtacttcactctcaccatcaccagactggacnctagaagtattttgcagttgtaattactgtacaaacgtaggtttggtactcaacacgtacggtgggtacgttccggaaccgaagggaccaaaggggttggaaaaactacgaaaacgtacgtggtacggctgaccgactagttcctagttcctacaactttccccttacccgcctaacttccaggtaaacttaccgacggttacttaacggtaggacgggttccgggacgttggggaaccgttaaaggggccctaacgttaagacggtangtanncgannnnnnnnnnnnnnnnnnnnnnnnnnnnnnnnnnnnnnn

SEQ ID NO: 47538 - DNA, 828 bp, Homo sapiens
  misc_feature: GYAE6OF02HLMKA.34.6.A06.1.454.CMB.1.raw
tcagtacacgtgatcacgaccggtgctcgatttagatctactgacagggaatcatggaaaccccagcgcagcttctcttcctcctgctactctggctcccagatatcaccggagaaattgtgttgacacagtctccaggcaccctgtctttgtctccgaggggaagcgccaccctctcctgcagggccagtcagagttgttaaatagcattctacttagccttaggtaccagacaacgtaaaccgtggacccagcccctcccagacctcctactaattaatggtcgactaagttaaccgtaacgaccggggtcccccttggacctacgtacccccgaaggtaccgtaacgggttactagggtcgggtactaacggggttcggggtccgtaggggaaccgtaacggtacctttaccaccgttcccttaccgaaccctacgttacccaaccgtaacggtaccgtagggaccgtaccgtaggtaaacgtttacgtttttcggaccgttagggtttacgtttaaacgttttaccgttacggttaaccgtaacgttacgtttcggttacctaccgaaccgtacgtaccgggttacggtacccgggttccgggaacctaaacgggggaccgtaaaggggttacgtaaaacgttaacccggaaaacggtaccgttagggttacggtcccgtaagggtacccaaacccgtttacttacccggtttacgttacccttttaacgtaacccgtttccccgtttaccccggacttaaccgtttccgtaacggtttacctaacccggtacggtttacggttaccggtaggttaacccgggg

SEQ ID NO: 47539 - DNA, 733 bp, Homo sapiens
  misc_feature: GYAE6OF02FVRB0.34.6.A06.1.454.CMB.1.raw
  modified_base (170)..(170): a, c, t, g, unknown or other
  misc_feature (170)..(170): n is a, c, g, or t
  modified_base (209)..(209): a, c, t, g, unknown or other
  misc_feature (209)..(209): n is a, c, g, or t
tcagtacacgtgatcacgaccggtgctcgatttagatctactgacagggaaccatggaaaccccagcgcagcttctcttcctcctgcgtactctggctcccagatatcaccggagaaatagtgatgacgcacgtctccagccaccgtgtctgtcgtcctccgaggggaanacgtcaccctctccgtgcacgggccagccagagtgttancagcaacgttcgctaggaccacgacaacgaacctggaccacggtcctacccgaggcctccgtcaacttctagtggtacgctactcccgacgacggggccctacggttacggtacctaccccgacggacccggttaacggttacgacggggtacggacgtacggggtttcgggtacggttaccggggaactaacggtacttccgaccttaccgtaccacgtacgttacgacgacgtaccgccgttaggacctaggttccgaagtagtttagtttacgactttagtttaacttcgtacgtactagtacgtaagttaactacgtacggttccggacccggtccggggttaccggttaccggaaccggtaacgggaacgttagggtaacctaacggttacctaaacgggtaccttaggggtctaccggttgacccgactacggtccttggttaacccttactacccgtttacccgtcccgtaacctcggttaaccttaccgaacgttcccggtaacgttgtaaccggg

SEQ ID NO: 47540 - DNA, 766 bp, Homo sapiens
  misc_feature: GYAE6OF02IB609.34.6.A06.1.454.CMB.1.raw
  modified_base (122)..(122): a, c, t, g, unknown or other
  misc_feature (122)..(122): n is a, c, g, or t
  modified_base (655)..(655): a, c, t, g, unknown or other
  misc_feature (655)..(655): n is a, c, g, or t
tcagtacacgtgatcacgaccggtgctcgatttagatctactgacagggccccctggcatcccagacccactgccactgaacctgtctgggatgccagggccctgtagtatgcaccattaangaggagctgctcagttaggacccaggaggaaccagtacggaaccccagcgcagtcttctcttcctctgctactctcggcctaccacgaccaccacgtaggaagtaaagtagtcgagtacggacgcgtacgtcctaccgaccgccctacccgttgttccgttggttaccgtccgtaacgggtaaaggggaaaccgaccgtacccccgtaccccttcccgtaccggtcgaaccggaaccggggaccccaacgggtaacccgtaagggttacggttacggtttaacggaccgtaaacggttacccgttaaaccggttccgggttaacccgttaccgggtaacccgacggtaaccgaaaccggtaaccccgcgggtaccccgaaggtcccctaccggacgtcccttaccgactacttcgtagtcggcaccgtactccgaacgtcgacctgtacgtacccacgcgacgttagttaccgacggtcgacgttggtaccgggtcgtacggaagtacttaacttccgacttaccgcctaacnccgtagaaccaggtacctaccggctaaccgttccgtaacgttaggtaaccgtttttagtacgtttaacgtttaacgtttaaccggttacgttcggttaacacgttaaacgg

SEQ ID NO: 47541 - DNA, 737 bp, Homo sapiens
  misc_feature: GYAE6OF02FKHZU.34.6.A06.1.454.CMB.1.raw
  modified_base (166)..(166): a, c, t, g, unknown or other
  misc_feature (166)..(166): n is a, c, g, or t
  modified_base (659)..(659): a, c, t, g, unknown or other
  misc_feature (659)..(659): n is a, c, g, or t
tcagtacacgtgatcacgaccggtgctcgatttagatctactgacagggaaccatggaaaccccagcgcagcttctcttcctcctgctactctggctcccagatatcaccggagaatttgtgttgacacagtctccaggcaccctgtctttgtctcgaggggaaangccaccctctctgcagggccagtcagtagtgttaatagcattctacttacgtctggtacctagcaagaaccgtggacctagccctaccgagacctcctacgtaatttacgtcgtgaccatacctaacggaccggggacccccttgggaccacctaaccccgaggtaccgacggttttcgaacggttcggaccgtagggttcgggtacggtacggtacgtaacggttacttacccacgtttaaccgtccctaaccaacttacccgtaaccaaggtaccggtaacggtaccgtaaccgttaacgaagggttttacttttacgggccttaaggtttacgtttacgtttaacgtaccgtttacaaacggtttcggtttacgtacttaccgtaacctaccgggtacggtttcgggtacccggttacggacccgtaaacgggtaccgtaagggtaacgtaaacgaccgtaaacgtaccgtgtacggcttcgacctactnttacgtccgttactccgtaccgtccgttacccacttctagtaccgaattccgaacgttagaccgtcggtacggtacgg

SEQ ID NO: 47542 - DNA, 870 bp, Homo sapiens
  misc_feature: GYAE6OF02HFBF6.34.6.A06.1.454.CMB.1.raw
tcagtacacgtgatcacgaccggtgctcgatttagatctactgacagggaaccatggaaaccccagcgcagcttctcttcctcctgctactctggctcccagatatcaccggagaaattgtgttgacacagtctccaggcaccctgttctttgtctccgaggggaaagacgccaccctctcctgcgagggccagtcagagtagttaaagtagcacttctaacgttacgccgtacggtaaccagacaacgaaacctggaccctacgccctacccgagtaccttccctactaattaagttggtacgactaacgttaacctaaccggaaccggggccccccttagggaccctaaccttaccccgaaacggtaaccgttacgggttaccgtaagggttcgggaccgtaaggggttcggggttccgtacgggggactaacggttacccgttcctaaccgttcctacccgtaacccgtaccttaacccgaaccgaacggttaccggtacggggaaccgtaccggttaaaggtaaacggtttacgttttacggaccgtttaacggttacgtttaacgtttacggtacgtttaaccgaaacggttacggtttcggttacctaccgaacgtaacgtaccgggttagggttaccggttacccgggaacgggaaacgggtaaaccgtaaagggtaacggtaaaacgtacggtaaaaccgtaacggtacggtcgggtaccgtaccggtaaccaaaccgttagttccgttacgtttaccttacgttaccgttccccggttaacccgaaccttaccgttacgttaacgtaacgttacccggacggttttaaccggtaccggttacgggaaccgggttcccgggg

SEQ ID NO: 47543 - DNA, 309 bp, Homo sapiens
  misc_feature: GYAE6OF02GENV6.34.6.A06.1.454.CMB.1.raw
  modified_base (290)..(309): a, c, t, g, unknown or other
  misc_feature (290)..(309): n is a, c, g, or t
tcagtacacgtgatcacgaccggtgctcgatttagatctactgacagggccccctggcatcccagacaggttcagtggcagtgggtctgggacagacttcgactctcaccatcaccagactggagcctagaagtattttgcagtgtattactgtcaacagttggtctcacacacgtggacgttcggccaagggaccaaggtgaaatcaaacgactgtgctgcacatctgtcttcatcttcccgcatctgaatcacgtgtactggacgcgggctggcaaggcgacagtagnnnnnnnnnnnnnnnnnnnn

SEQ ID NO: 47544 - DNA, 582 bp, Homo sapiens
  misc_feature: GYAE6OF02F1DEF.34.6.A06.1.454.CMB.1.raw
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (407)..(407): a, c, t, g, unknown or other
  misc_feature (407)..(407): n is a, c, g, or t
tcagtacacgtgatcacgaccggtgctcgatttagatctactgacagggaaccatggaaaccccagcgcagcttctcttcctcctgctactctggctcccagatatcaccggagaaatttgtgttgacacagtctccaggccaccctgtctttgtctccgaagggggaaagacgcccaccctctcctgcagggccagtcagagtagttaatagcaatcttacttagccttggtacccagcaagaaacctggccaagccctcccgagtacctcctcacttaaagtggtagcactaactaacacgggcccctggcactacccgagactaggtcagtggacaggtcgggtctgggacnggtactcactcncaccntcacagtacgtgcacctgaagtattttgactagtntacttactagtacaataagttggtactacacacagtcggacgttcggaaccgaacgggaacaaggtacgaaaataccgaaacgtaacgtgtagaccttagaccgtaccatacttcgtctttacacttccttcccgcacttctaagtctactaggttacttacgtagacggtcggg

SEQ ID NO: 47545 - DNA, 449 bp, Homo sapiens
  misc_feature: GYAE6OF02G3QR8.34.6.A06.1.454.CMB.1.raw
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (294)..(295): a, c, t, g, unknown or other
  misc_feature (294)..(295): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (314)..(315): a, c, t, g, unknown or other
  misc_feature (314)..(315): n is a, c, g, or t
  modified_base (319)..(319): a, c, t, g, unknown or other
  misc_feature (319)..(319): n is a, c, g, or t
  modified_base (322)..(323): a, c, t, g, unknown or other
  misc_feature (322)..(323): n is a, c, g, or t
  modified_base (325)..(326): a, c, t, g, unknown or other
  misc_feature (325)..(326): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (334)..(335): a, c, t, g, unknown or other
  misc_feature (334)..(335): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
tcagtacacgtgatcacgaccggtgctcgatttagatctactgacagggcccctggcatcccagacccactgccactgaacctgtctgggacagacttcactctcaccatccaccagactggagcctgaagtatttttggcagttgttattactgtaccaactagttggtctcacacgtacgtggtacgttcggaccaagggaccaaggtgaaatcaaacgactgtgtncacntcgtgtctcactctccgcatcnancagtgactgagcgggntggacaggcananagncancnngangangntnactcgacgnnctantcnnanncncgntannangcanatancgctntgcngntngtacgntacngcgtnagtctcgngancgtagtctcngcncgngcgtcgctgngtcgtatagtctcgtctcgtacactcgacgacgagtacg

SEQ ID NO: 47546 - DNA, 310 bp, Homo sapiens
  misc_feature: GYAE6OF02F307O.34.6.A06.1.454.CMB.1.raw
  modified_base (298)..(310): a, c, t, g, unknown or other
  misc_feature (298)..(310): n is a, c, g, or t
tcagtacacgtgatcacgaccggtgctcgatttagatctactgacagggcccctggcatcccagacaggttcagtggcagtgggtctgggacagacttcgactctcaccatcaccagactggagcctgaagatttgcagtgtattactgtcaaactagttgtctcacacacgtggacgttcggccgaaggaccaaggtggaaatcaaacgaactgtgctgcactatctgtcttcatcttccccgacctatctagaatcacgtgtactgacgtcgggactggacaaggcgacaagtagnnnnnnnnnnnnn

SEQ ID NO: 47547 - DNA, 781 bp, Homo sapiens
  misc_feature: GYAE6OF02ICTTS.34.6.A06.1.454.CMB.1.raw
  modified_base (167)..(167): a, c, t, g, unknown or other
  misc_feature (167)..(167): n is a, c, g, or t
tcagtacacgtgatcacgaccggtgctcgatttagatctactgacagggaaccatggaaaccccagcgcagcttctcttctcctgctactctggctcccagatatcaccggagaaattgtgttgacacagtctaccaggcaccctgtctttgtctccgagggaaagngccaccctctcctgcgacgggccagtcagtagttgttaaatagaccatactacgttacgccgtagggtaccagacaagaaaccgtggaccacgccctacccgagtaccttcctactaattaagtgggtagtacctaataacctaacggtaccgggtcccccgttggacctatcccccgaaggtaccgtacgggtttcgaaggttcggaccgtagggttcggggttacgtgggacgaagttccctttacgaccttaccgtaccaacccagttacccaaccggaggtaaacgtacgggaacgtaccgttaagaaacgttttagttttaccggaacgtttacggttagtttaacgttaaccgttacggttaaccgtaacggtacggttttaggtaccgtacctaaaccgtaccggttaccgggttaacgggttaaccggtttaccgggaaaccgggtaaacgggtaaccggtaaagggtaaacgggtaactaaaccggtaaaacgtacggtaggtacggtaccttacgaacctaaccgtgttacctcttacctacttacgttcccttaccactcgttacgtctaacttcgtaacggttcgtacgttcggaggtcggg

SEQ ID NO: 47548 - DNA, 602 bp, Homo sapiens
  misc_feature: GYAE6OF02GMN6A.34.6.A06.1.454.CMB.1.raw
  modified_base (171)..(171): a, c, t, g, unknown or other
  misc_feature (171)..(171): n is a, c, g, or t
  modified_base (173)..(173): a, c, t, g, unknown or other
  misc_feature (173)..(173): n is a, c, g, or t
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (571)..(602): a, c, t, g, unknown or other
  misc_feature (571)..(602): n is a, c, g, or t
tcagtacacgtgatcacgaccggtgctcgatttagatctactgacagggccagtcagagtgttaatagcatctacttagcctggtaccagcagaaacctggccagcctcccagactcctcattaatggtgcatactacagggcccctggcatcccagacaggtcagtaggngngtgggtcggtcggaggagactctacnctcaccactnaccacgacacggtaggacgtcgtaagaagtttgttcgagtgttagttaacttcgtcgtaacaacgttgggtttcgtctacaaccaacgtcgggtacggttaccggtccggtaaccggaaccggaaacggtaagggtaaaggtaactaaaccggaaaaaccggtacggttgggtacggtctaccggaaccctaacgtcgttacgttcgtttaccttactaacccttttcccccgttaccccgtaacttaccttccggttaaactaaccttacccggtacggttttaacgtaaccgggtaggtaaccgggggccgggttacgggtaccggggaacgggaacggggcccaacgttaagaggtcannnnnnnnnnnnnnnnnnnnnnnnnnnnnnnn

SEQ ID NO: 47549 - DNA, 334 bp, Homo sapiens
  misc_feature: GYAE6OF02FMY73.34.6.A06.1.454.CMB.1.raw
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
  modified_base (307)..(334): a, c, t, g, unknown or other
  misc_feature (307)..(334): n is a, c, g, or t
tcagtacacgtgatcacgaccggtgctcgatttagatctactgacagggccccctggcatcccagacccactgccactgaacctgtctgggacagacttcactctcaccatcaccagactggagcctgaagattttgcagtgtattactgtcaacagttggtctcacacacgtggacgttcggccaagggaccaaggtggaatcaaacgactgtggctgcaccatcgtcgtcttcactccttcccgctatcttagaatccacgttntactggacggtcgggctagggacaagggtccganattacgnnnnnnnnnnnnnnnnnnnnnnnnnnnn

SEQ ID NO: 47550 - DNA, 674 bp, Homo sapiens
  misc_feature: GYAE6OF02HD0QC.34.6.A06.1.454.CMB.1.raw
  modified_base (437)..(437): a, c, t, g, unknown or other
  misc_feature (437)..(437): n is a, c, g, or t
  modified_base (451)..(451): a, c, t, g, unknown or other
  misc_feature (451)..(451): n is a, c, g, or t
  modified_base (482)..(482): a, c, t, g, unknown or other
  misc_feature (482)..(482): n is a, c, g, or t
  modified_base (506)..(506): a, c, t, g, unknown or other
  misc_feature (506)..(506): n is a, c, g, or t
  modified_base (522)..(522): a, c, t, g, unknown or other
  misc_feature (522)..(522): n is a, c, g, or t
  modified_base (565)..(565): a, c, t, g, unknown or other
  misc_feature (565)..(565): n is a, c, g, or t
  modified_base (610)..(610): a, c, t, g, unknown or other
  misc_feature (610)..(610): n is a, c, g, or t
  modified_base (625)..(625): a, c, t, g, unknown or other
  misc_feature (625)..(625): n is a, c, g, or t
tcagtacacgtgatcacgaccggtgctcgatttagatctactgacagggcccctggcatcccagacaggttcagtggcagtgggtctgggacagacttcactctcaccatcaccagatggatcctagaatattttgactagtgttattactgtacaaagtgtttacgtctacaacacgtacggtacgggtaccgttacgggacccgtaaaggggaaccaaaggggttaggaaaacttaccgaaaaacgtacgttggtacgggcaggtacccaacctattcgttcgtttacgtttttaacgtccccgtttaccccgaccatttaccgttacgaaacgtttcctaaccggttaccggttacgtacggaccggggtcccgggtaggtaccggaaccgtaacgggcggttaacacggtaatggtatacgtccaagcgttcngacagtcatacgancgtaccagtgacttgggacactaggtaccgngtatatacgtagagtacgacgtanacgtagtactagtacnctagttagtgtacgacgtaccggacgtacgacgtcgtcgtacncgtcgtagtataggtactacgtatacgttacgttaacgtcgtagngtaggtagtagacgngtacacgttaggtacgtacgtacgtacggtcgcggttcgttcgtagacg

SEQ ID NO: 47551 - DNA, 993 bp, Homo sapiens
  misc_feature: GYAE6OF02F43NA.34.6.A06.1.454.CMB.1.raw
tcagtacacgtgatcacgaccggtgctcgatttagatctactgacagggaaccatggaaaccccagcgcaggcttctcttcctactgctactctggctccagatatcaccggagaattgtgttgacactacgtcctaccaggcctacccgtgttcttttggtcctaccggaaagggggaaacgacgtaccctaccccttctacccttcggaccggacgggtaccccaaggtccgaaggtagttacggtttaaagtaccggacctattaccttaactttaaccggccgtttaacggaccgttacgaccgaaccggtaacctcgggaccttaaccgcccctaacccggtacttaccgtcccttagaagtttaacgtcgttcgaacttaactaaccgttaaccggccgggttaccccaggtaccaccgtaccccgtaaggacctggggtttaccaggtacgggacttggggtaccgggttaaccggagggggtaaccttcggtaacccctacggttaccgttcccttaaccgacggttaccctacctaacggggtaaacttcccggggtaataccgggtaccttaagggtttaaacccgttttgggtttaacccctaaggggtttcgttttaaacgggttttaatttacccgttaacgggtttaaaccgttaaccgtttacggggtttaaccgggttaccttaacccggtaacggtaaacccggtttaccgggtttaaaccgggttacccgggtttaccggggaaacccgggttaaaaccggggttaccgggtaaagggttaaaccgggtaaaccgtttaaaccgggaaaaccggttacggtaaccgggttacggttaaccggccgttaacccggtaaaccttcgtttaaccgccgttttaccgacttaccggttcccggtaaccctcgtaacgttaaccgttacggtaaccttaacggttagttaaccggtccggttaagggcccgggttaccgg

SEQ ID NO: 47552 - DNA, 824 bp, Homo sapiens
  misc_feature: GYAE6OF02I7D28.34.6.A06.1.454.CMB.1.raw
  modified_base (127)..(127): a, c, t, g, unknown or other
  misc_feature (127)..(127): n is a, c, g, or t
tcagtacacgtgatcacgaccggtgctcgatttagatctactgacagggaaccatggaaaccccagcgcagcttctcttcctcctgctactctggctcccagatatcaccggagtaaatttgtgttnacacagtctccaggccacccttgttcttttgtcctccgaagggggaaacgtacgccctacccttctcccgtgcgacgggcctacttcgaagtcgttagttaatagctaattacctacgtttacgcccttggtaaccaggacaacgtaaacccgtggtcccagccccgtacctcgtaaccttccttataacgtttaatcgggtacacctaataaccgttaccggaccgggtccccgtaggtaccctactaccccggaaggtccgtaagggtttaccgaacgggtccgacggtaacgggtttccgggggttacgaccggggtaacctagggtaacccttccggacttccgtacctaaacctaacgaccctaacccggaacggtttaaccacggggtaaaccgttccgttaaaggtaccgttttaacgttttccggaacgttaggttttaacccggttacttttaaccggttcgttaacgtaacgtttaacggtttccgttaccgtaactacccggactaccgggtttacggttaacgttacggaaccgtaaacgggtaccgtaacggaaagtaaaccgacgttaaacgaggtgtacgtacgtcacgaaccttggtacttataccttactaccttaccggttaccaccttacctacgagttaccgtacttacggggttactcggtaccggtaggtccggg

SEQ ID NO: 47553 - DNA, 813 bp, Homo sapiens
  misc_feature: GYAE6OF02FZ28R.34.6.A06.1.454.CMB.1.raw
  modified_base (467)..(467): a, c, t, g, unknown or other
  misc_feature (467)..(467): n is a, c, g, or t
tcagtacacgtgatcacgaccggtgctcgatttagatctactgacaggggaaccatggaaaccccagcgcagcttctcttcctcctgctactctggctcccagatatcaccggagtaattgtgttgacacagtctccaggccacccttgttctttgtctccgaaggggaaagcgccaccctctctgcagggcctagtcaaggtagttacgttaatacgactacgttccgttaacttacggccgttacgggtaaccacgactaacggtaaacccgttcgggaccctacgaccccctaccgacggtacccttaccctactaaattaacgttcgggtactaccgtaagttaaccccgttacgggaccgggtccccgtacggtacaaccgtacccgacggtaccgtacgggttaccgaggtcggacggagggttcggtacgtacggggactacgtacttcaccgtctaccncgtactacacgacgtagcggtactcgttaagaactttacgttgacgtagttacgtttaacgtactacggtaacgtaacgtttacgggttcgtaccgtaccgtaacggtaaccgtaccggggttccggttaacgggttaacccgggtacggtaaacgggtaaccgttaaacgggttaacggaaaaccgttaccgggtaaaaccgttaccgggttaggttacggacgttacggtaaccctaccggtatttaccgtttacgtaccgttaccgtaccgtttccccgtacctacgtaccttagtaaccgagtttacccggtaacgttacgtacggttacggccggtaccgg

SEQ ID NO: 47554 - DNA, 735 bp, Homo sapiens
  misc_feature: GYAE6OF01DL8KH.43.69.G03.1.454.CMB.1.raw
  modified_base (226)..(226): a, c, t, g, unknown or other
  misc_feature (226)..(226): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtcgtcccaggacagacggccaggatcacctgctctgganatgaattcgaccaaggctaattttgttattggtaccagcagaagccacgccaggccctgtgttggtgatgtaataagacagtgagacgcctcgagggactcccgngacgcgtattctcgtcggcnccgagtctcgaaggaacctaggttacgtctaacggtttcgaacctaagtacgtaggtacgggacgttaccgagggacaaggaacggaacggaggacgttaggtaactttaacgtttaacgtttgtaaccgtaaaggtaccgtaaggttaacgaacgtaacgggaccgttaacgggttaccgggttttaccggtttaagggttccggggggtttaccggggttaccggggggtaaccggggggggtaaaccctaaacggggtcccgttaacccgggtaaccccgggttacccggttacggggttacccgaaccgggtaccccggtaaacgggttccccggttaccccgggtacccccccggtttccgggttccttaacccccggg

SEQ ID NO: 47555 - DNA, 519 bp, Homo sapiens
  misc_feature: GYAE6OF01BHPVJ.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttctcccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctgagggatccctgagcgattctcgtggcgccagctcaggaacagtagtcacgttgaccatcagtggagtccaggcagaagacgaggctgactattagttgtcaagcagtagacagctaggtgttccttagtcgggtgttcgggcggggaccagcgtcgaccgtcgtaggtcgacgcccgaaggcctcgccccgtcggtcgtacg

SEQ ID NO: 47556 - DNA, 691 bp, Homo sapiens
  misc_feature: GYAE6OF01DSDZ8.43.69.G03.1.454.CMB.1.raw
  modified_base (226)..(226): a, c, t, g, unknown or other
  misc_feature (226)..(226): n is a, c, g, or t
  modified_base (294)..(294): a, c, t, g, unknown or other
  misc_feature (294)..(294): n is a, c, g, or t
tcagtgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctgganatgaattgaccaaggctaattttgttattggtaccagcaagaagccagcccaggcccctgtgttggtnatgtaataaagacagtgagcggccctgagggactcccgtgacgcgtactttcgtcgtcggccgtaccagtcctacgaacgggaaacaggttacgtccgaacgtttcgaaccctaatcgtaggtacggacgtaccgaggacaaggaacggacggaggtctaggtaacctttaagtttacttacggtactaacgacgtaaggtaacgaacgacggtacgtagggttcggtttaacccgtttagggtccggggttagggttacccggggggaacggggggtaaacccaacgggtaccgtaccgggtaaccccgggttacggttaacgggtaccgaacccggaccccggtaaacgggtcccgttacccggtcccccccggttaccgggtcccgttacccgg

SEQ ID NO: 47557 - DNA, 562 bp, Homo sapiens
  misc_feature: GYAE6OF01DIT51.43.69.G03.1.454.CMB.1.raw
  modified_base (314)..(314): a, c, t, g, unknown or other
  misc_feature (314)..(314): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtcccaggacagacggccaggatcacctgctctggagatgaattgccaaggctaattttgttattggtacagcagaagccagccaggcccctgtgttggtgatgtataagacagtgagaggccctnagggatcccgtgacgcgattctcgtggcgccagctcaggaacagtacgtcacgttgacctatcgaggtcggacgtaccgaggacaggaacgacggaggctagaacttagttattgtacgaagcagtaagacagctagtggttacttagtcgggttggttacggggccgggggtaaccaggcgtacggtacccgttcgtacggtcgacggcccgtaaacggccttaccggccccctcgggtcctacccg

SEQ ID NO: 47558 - DNA, 537 bp, Homo sapiens
  misc_feature: GYAE6OF01BHI8S.43.69.G03.1.454.CMB.1.raw
  modified_base (228)..(228): a, c, t, g, unknown or other
  misc_feature (228)..(228): n is a, c, g, or t
  modified_base (311)..(311): a, c, t, g, unknown or other
  misc_feature (311)..(311): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctcccccctcctcactctctgcacaggctctgaggccgcctatgaggtgacacagccacactcggtgtcagtgtcccccaggacagacggccaggatcacctgctctgganatgaattgccaaggcaatttgttattggtaccagcagaagccagcccaggcccctgtgttggtgatgtataaagacagtgagnggccctgagggatcccgtgagcgattctctggcgccagcctacgaggaacagtacgtcacgttgacctatcagtggagtccaggcagaagacgaggctagactattattgtacaagcgaagtacgacagctagtgtaccttagtcgggtgttcgggacggggtaccaaggtcgtcggaccgtcgtaggtccgacgcccgtaaggctccgccccgtcggtctacccg

SEQ ID NO: 47559 - DNA, 573 bp, Homo sapiens
  misc_feature: GYAE6OF01E15KJ.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgttattggtaccagcagaagccagcccaggcccctgtgttggtgatgtataaagacagtgagaggccctcgagggactcccgtgagcgattctctggcgccagctcaggaacagtagtcacgttgaccatcagtggagtccgaggcagaagacgaggctgacttattattgtacaagcaagtacgacagctaggttgttccttagtcggggttgttcggggacgggggtaccaaggtccgtacggtacccggttaccgttacgggtcccgaacggaccccgtaaacgggtccctacccggcccccccgttgggtcccttacccgg

SEQ ID NO: 47560 - DNA, 529 bp, Homo sapiens
  misc_feature: GYAE6OF01CACOG.43.69.G03.1.454.CMB.1.raw
  modified_base (316)..(316): a, c, t, g, unknown or other
  misc_feature (316)..(316): n is a, c, g, or t
tcagtgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctnagggatccctgacgcgattctcgtggcgccagctcaggaacagtagtcacgttgaccatcagtggagtccgaggcaagaagacgaggctgactattatgtcaagcagtagacagctagtgttcttagtcgggtgttcgggcgggggtaccaaggcgtacgtacccggtcgtaggtcacggtcccgaagggcctggccccccgtggtcctaccg

SEQ ID NO: 47561 - DNA, 631 bp, Homo sapiens
  misc_feature: GYAE6OF01ENHWN.43.69.G03.1.454.CMB.1.raw
  modified_base (226)..(226): a, c, t, g, unknown or other
  misc_feature (226)..(226): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcactgctctgganatgaattcgaccaaggtctaattttgtttagttggtaccagcaagaacgccacgcccgacggcccctgtgttggtgatgtaataaagacagtgagacggccctgacgggactccgtagacgtcgtattctcgtggccgaccgagtctacgaacggaactaggtacgtacgtacgttacgacctagtcgaggtacggacgtccgaagggacaaggaacgacggacggctagtacttatttagttcgtacgaacgcgtaagtacgacgagacgtaggttcggttaccgttaggtcggggttacgggtacggggacgggggtaccgtaaggtccggtcggtacccgttacgtcggtaccgaccggacccgtacggtcccgtacccggccccgttcggtcccgtacccg

SEQ ID NO: 47562 - DNA, 553 bp, Homo sapiens
  misc_feature: GYAE6OF01AG0VC.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgccaaggctaattttgtttattggtaccagcagaagccacgccaggcccctgtgttggtgatgtaataaagacagtgagaggccctcgagggactccctgacgcgtattcgtcgtcggcgccagctcgaggaacagtagtactacgttcgactatcgagtggacgtcgaggacaggaacgacgaggctagacttagttatgtacaagcgtagtacgacagacgtaggtcgttcgttagtcgggtaggttcgggcggggacgagcgtcgaccgtcgtacggtacgacgaccgacggctccggccccgtcggtccgtaccg

SEQ ID NO: 47563 - DNA, 535 bp, Homo sapiens
  misc_feature: GYAE6OF01AZ2NN.43.69.G03.1.454.CMB.1.raw
  modified_base (347)..(347): a, c, t, g, unknown or other
  misc_feature (347)..(347): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgccaaggctaattttgttattggtaccagcagaagccagcccaggcccctgtgttgtgatgtataaagcagtgagacggccctcgagggactcccgtgagcgattctctggcnccagctcgaggaactagtacgtcacgttcgaacctatcgaggtggacgtccgaggacaaggaacgacgaggctagacttattagttgtacaagtcaagtagacagcgtagtgttcttagtcgggtgtcgggacggggacaggcgtcgtaccgtcgtggcacgccgaggctaccgccccgtgtctaccg

SEQ ID NO: 47564 - DNA, 847 bp, Homo sapiens
  misc_feature: GYAE6OF01BCUVG.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctggacggccgcctatgaggtgacacagccacacgtcggtgtcagtcgtccccgaggacaggaccggccaggactaccaccgtgcctcgtaggagatagtaacgttcgaccgtaaggtacttaagttttgttttacgttacggtaaccaggtacgaaggaaccgtcccgacggtccccgaccgggtcccccgttgggttcggtttacgggtagtaagttacggttaaaagttaaaacggaccgtaagggtaggacggtaccgggtacccgtacgggaacgggtacctacccgtggtaccgtacgttcgttaccgtcggtccgggcccgaccgacgtacctaacgggaacggtaacgttacggttacgtacggtaccgttacgaacctacggttaccgtagggtaccggaacgttacccggaagggtaccggaaagggtaaccggaacgggtaaccggtacgttaacgttacgtttaagtttacgtaccgttaacgtaaggtaccggtaagtaacgaccgacggtacgttacgtttaccgggttacggtttacggggtacgggggttacgggtcccgggggggtaaccgggtaacgaccgggttaccggtaaccgggtacccggttacccggttgggaaccccgtacggaccccggtacccggcccggtacccccggtttcccggcggttcccgtttacccgg

SEQ ID NO: 47565 - DNA, 753 bp, Homo sapiens
  misc_feature: GYAE6OF01CV7PM.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcgtaggagatagaattcgaccaaggctaattttgttattcggtaccagtcagaacgccacgcccaggcccctgtcgttggtgatgtaataacgacgagtgaggacggccctacgagggactccccgtagacggcgtaactttcgtcgtcggccgaccgagtccgtacgaacggaacaggttacgtacgtaccggtttacgaccgtacgtacgtaaggttacgggacggttaccgagggtacaaagggaacggaacggacgggtacgtacggtaaacgtttaactttaagtttacggtaacgaacggtacgtaaggtaacgaacgtaacgtaccgtagggttaccggtttaccgtttacgggttaccgggggttcggggtttaccggggaccgggggggtaaacccctaagggtacccggttaccgggtacccggttacccgggttaaccggtcccggtaaaccggtaccccggtaaacgggttccccggtacccggttaccccccggtcccggttaccgtttaaccccccgg

SEQ ID NO: 47566 - DNA, 731 bp, Homo sapiens
  misc_feature: GYAE6OF01CNF96.43.69.G03.1.454.CMB.1.raw
tcagtgtgagtagtcacgaccggtgctcgatttagtcgctgcgtaaaggagaaagggggtgtgggtccaggaggcagaactctgggtgtctcaccatggcctggatccctctacttcctccccctcctcactctctgcacaggcctcgtggacggcccgcctagtggaggtgaacacacgcctacaccgttcggtgtcaggtccgtcccccgaaggaccaggaccggccaggactccaccgtgctcgtggatatgaatgaccgaagcttaagtttttcgttattacggtaccagacgaagaacgccacggtcccacggtccccgttggtcggttggtagtagtagtaacgtaagacagtaggacggacgtcccgacgacggtacctccgtagacgacgtacttcgtacgcggacgaccgacggtacctacggaaggaactagtcgtaacgtacgttacgacttagtacgtaggtacggaccgtacgaaggaccgaaaggaaggtaacgtaggactacgtaacgttacgttacgtagttacgaaggtacgtaagtacggaacgacggtacgtacggtttaccggttacgttacgggttaccggggttcgggttaccggggacccgggggtaacgtaccgggtaccgtaccgggtacccgttaaccgggtcggtaaccgaccggtacccggtaaacgcccggttacccggccccgttccggtaccgttcccgg

SEQ ID NO: 47567 - DNA, 706 bp, Homo sapiens
  misc_feature: GYAE6OF01AZZZ5.43.69.G03.1.454.CMB.1.raw
  modified_base (113)..(113): a, c, t, g, unknown or other
  misc_feature (113)..(113): n is a, c, g, or t
  modified_base (266)..(266): a, c, t, g, unknown or other
  misc_feature (266)..(266): n is a, c, g, or t
tcagtgtgagtagtcacgaccggtgctcgatttagtcgctgcgtaaaggagaaaggggggtgtgggtccaggaggcagaactctgggtgtctcaccatggcctggatcccctntacttctcccccctcctcactctctgcacaggctctgaggccgcctatgaggtgacacagccacactcggtgtcagtcgtccccaggacagacggccaggatcacctgctctggagatgaattgccaaggctaattttggttattggtaccancagagccagcccaggcccctgtcgttggtgatgtaataaagacaggtgaggcggaccctcgagggtaactcccgtggacgtcgtacttctcgtcgggtcgacccaggcctacggaacggtaaccaggttacgtaccgtacggtttcgaacccgtacgtacgtacgggtacgggtacgttacccggaggaccaagggtaacggaacgggaggtaccgtaggttaaccttaagtttacgttacggttacgaaacggtcgtaaggtaacggaacctaggtaccgtaggttacgggtttaccgtttaagggttaccggggttaggttcccgggggacgggggtaaccctaagggtccgtaccggtacccggtaccggttacggcccgtaaggtaccccggtaagggccccgttacccggccccccgttcgggtccctacccggg

SEQ ID NO: 47568 - DNA, 914 bp, Homo sapiens
  misc_feature: GYAE6OF01DW2HE.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttcctccccctcctcactctctgcacaggctctgacggccgcctatgaggtgacacagccacactcggtgtcagtcgtcccaggacagacggccaggactcacctgctcgtggagatggaattcgaccaaggtctaattttgttattggtaccagcagaagccagccaggcccctgtcggttggtgagtagtaataaagacaggtgaggacggtccctacgagggactcccgagacgcgtattcgtacgttcggccgccgacgtcgttacgaaggaaccgtaggttacgtaccgtaacggtttacgaaccgtaacgttacggtaacggttcgggtaacgtacccggaacgggacccgaaagggaaacgggaacggacgggtaccgttacggtaaaccttttaaaggtttaacgtttacggttaacccgtaaaagggtaccgtaaacgggtttaaacggtaaccggaaacgggttaacccggttaaggggtttacccggggttttaacccgggttttaaaccggggtttccggggggggttttacccgggggttttacccggggggggtaaacccggggggggtaaacccggtaaaccgggggttacccgggtttaaacccggggttaacccccggggttttaccccgggtttaaacccgggggttaaccccgggtttaaacccccggggaaaccccccgggttaaaacccgggggttacccccggtttacccccccggggtttaacccccccccggggtttcccggggtttacccccgttttaaaaccccccccggggg

SEQ ID NO: 47569 - DNA, 766 bp, Homo sapiens
  misc_feature: GYAE6OF01BL5RC.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttcctccccctctcactctcgtgcacgaggctcgtggacggtcccgcttagtggtaggtcgaaccacacgccctaacgtacgttcgggttacgtaccgtaggtccgtccccgaagggtaccaggaccgggacaaggactccgactggctcgtagggaactagtagtaagttccgaacgtaaggtactttaagttttcgttagttacggtacacgtacgaacgaaccgtaccgacgtacccgacggaccccgttggtggttacggagtacgtagtaacgtaaagaccgtaggtagacgacgtccgtacggacggtactccgtagacgtacgtacgttcgcgttacgcgacgacgtactaggtaacggaacgttaagtacggtaccgtaacggttacgactgtacgtacggtacgtacgacgacgtagaaccggagtacgacggtcttaagtaacctagtttacgacgtaacgagtaacgtacgaaccgtagtaccgaggttacggtacgtttacggtacgggttacggttacgggtacggggtaccgggtaacgtaccgggtaccgttaccggtaccggttacggaacgggtacctaaccggacccggtaacggtcccgttaccccgggccgttaccgggttcccgttaccg

SEQ ID NO: 47570 - DNA, 766 bp, Homo sapiens
  misc_feature: GYAE6OF01C0LJ8.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtcgacacagccacactcggtgtcagtcgtcccccgaggacgagacggccaggactcacctgctcgtggagatagaattcgacgaaggtactagttttacgttattacggtaccagacgaacgaacgacctacgacccgaacggtccccttggtcggtttggtagtacgttagtaacgtaaaagaacgaggtagacggaacggtcccctaagacgggtactccccgtaggaaggtccgtactttcgtcggttacggacccgaccgtacgtcccgttaaacggaacgggtaaaccacggtttaacggtaccgtaaccgggtttaacggacctaacgttccgaaagggtcgggtaaccgtacgaacgggacgaaacggaacggaaacggcggtacgtaacggtaacctttagttacgtttacggtaacaaaggttcctaaggtaaaccacgacggtacggtaaggttccgggttacctttaggggtcccgggttagggttaccgggacggggtaaccgaagtcggtcgttaaccccgggtcgtaaccgggtacgaacccggacggtaaacccgtcgtaccccgtaccccgttggtccctaacccgg

SEQ ID NO: 47571 - DNA, 762 bp, Homo sapiens
  misc_feature: GYAE6OF01B3Q91.43.69.G03.1.454.CMB.1.raw
  modified_base (320)..(320): a, c, t, g, unknown or other
  misc_feature (320)..(320): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctcccccctcctcactctctgcacaggctctgaggccgcctatgaggtgacacagccacactcggtgtcagtcgtccccgaggacagacggccaggatccacctgctcgtggagatagaattcgaccaaggtactaagttttgtttagttggtaccagcaagaacgccaacgcccacggcccctggttcgttggtgatgtaanaagacgagtgagacggccctgacgggactcccgtgagtcgtattccgtgtcggcccgccagcctacggaacggtaacgtacgttacgtaccgtacgttacgaacctacgttacgaagggtcgggtacgtaccggaggtaaccggaaaggaacggtaacgggacggtaccgttaacggtaaaccttttaaaggtttactttacgggtaaccgtaaagaccggttaaaggtaccggtaacgtaggacccgttaagggtttacccgggtttccgtttacgggttaccgggggttcggggttacccggggggaaccggggggaccctaaacgggtcggttaacccggttacccccgggtttacggtaccggttaccggacggtaacccccggtaagggtacccccgtcccggttaccccccgggttcgggttacccgttaccccgg

SEQ ID NO: 47572 - DNA, 718 bp, Homo sapiens
  misc_feature: GYAE6OF01CJFSX.43.69.G03.1.454.CMB.1.raw
  modified_base (184)..(184): a, c, t, g, unknown or other
  misc_feature (184)..(184): n is a, c, g, or t
  modified_base (301)..(301): a, c, t, g, unknown or other
  misc_feature (301)..(301): n is a, c, g, or t
tcagtgtgagtagtcacgaccggtgctcgatttagtcgctgcgtaaaggagaaagggggggtgtggggtccaggaggcagaactctgggtgtctcaccatggcctggatccctctacttctccccctcctcactctctgcacaggctctgaggccgctatgaggtgacacagccacactcggtntcagtcgtcccaggacagacggccaggatcacctgctcgtggagatagaattcgacgaaggacttagttttgttagttcggtaccagcagaacgccacgccacggccctgtgttggnatgtaataagacgagtgagcgccctagacggtactccgtagacgacgtacgttctcgtacggccgaccgtagctacgaacggaactacggtaacgtcgtaaccgttgaaccctagtaccgaagggttggaaccgtaccggaggaacgtaaggaacggaacggaggtaccgtagtaaactttagtttaacggttacgtaaccgaaggtaccgtaaggtaacgaacacgggtacgtaacgggttccggtttaaccgtaggggtttccggggtacgggttcccgggggggtaacccgggtaacgtaacgggttaccggtaccgggtaacccgggttccggttaacggggtaccctaaccgggtaccggtaaacccgtcccgggtccccggttacccccggtcggttacccttaccccggg

SEQ ID NO: 47573 - DNA, 751 bp, Homo sapiens
  misc_feature: GYAE6OF01EFBL1.43.69.G03.1.454.CMB.1.raw
  modified_base (185)..(185): a, c, t, g, unknown or other
  misc_feature (185)..(185): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagcccacactcgggtntcagtcgtccccaggacaggacggccaggactcacctgctgtggatatgaattcgaccgaaggtctaaagtttttgtttagttcggtaccagtacaagaacgccacgcccaacggtcccctgttggttggtgagtagtaagtaaagacgaggtgaggacggccctagacgggtactcccgtgacggacgtacttcgtacgtcgggccgccgagtcctacggaacggaacgtaggtacgtaccgtacggttacgaacctacgtacgtaggtacggaacgtaccggaagggtaacgaaggaacggaaccggaggtaccgttacgtaagtttaacgtttagtcgtaacggtaacgtacgaagttaacggaaccgtaggtaccggtaaggttttaccgggttaaccgtttacgggttaccggggttacgggtttaccggggggacccgggggtaaaccaacggggttaccgttacgggtaaccccggttacggttacgggtaaccgacccgggtaacccgtaacgggtcccgtaccccgggttcccccgttaacgggtcccttaccccgg

SEQ ID NO: 47574 - DNA, 826 bp, Homo sapiens
  misc_feature: GYAE6OF01CHJLL.43.69.G03.1.454.CMB.1.raw
  modified_base (141)..(141): a, c, t, g, unknown or other
  misc_feature (141)..(141): n is a, c, g, or t
  modified_base (194)..(194): a, c, t, g, unknown or other
  misc_feature (194)..(194): n is a, c, g, or t
tcagtgtgagtagtcacgaccggtgctcgatttagtcgctgcgtaaaggagaaagggggtgtgggtccaggaggcagaactctgggtgtctcaccatggcctggatccctctacttctccccctcctcactctctgcacgnggctctggacggccgcctagtggaggtcgaccacgacgcccaactcgtcggtntcacggtccgtcccgaaggacacggaccggaccgaaggactaccaccgtgcctcggtagggaacgtagttacgtaagttccggaaccgtaaagggtactttaagttttttcgtttacgtttacggtaacccagacgtaacggaacgtacccgaacgcccggtaccggtcccccgttaggtttcggttcggtacgtagttaacgtaagtaaacgtacgtaggtacggacggtaccggccgtaccgggaacggtactccggaggtacgcgttacgttcgtcggtcgcgacccgagtacgaaccggaacgtaacgtacgttaccgtacggttaccgtacgaaccgttcgtacggtacggtacggtaacgtaccgacgggacggtaaacgacggtacggtacgtcgtaacggtttacttaacgttagttaccgtagtaacgtaagtaacgtacgaacggtcgtacggttaccggttacgtttaccgttcggggttaccgggttcggggttacccggggggaacggtaccggtaccggtaccggttccgggaccgtttaccgggtccgtacggaacccggttacccggtacggtaccccggttaccccgtccccggtttacggcccgtttaccccgg

SEQ ID NO: 47575 - DNA, 775 bp, Homo sapiens
  misc_feature: GYAE6OF01EXA6X.43.69.G03.1.454.CMB.1.raw
  modified_base (184)..(184): a, c, t, g, unknown or other
  misc_feature (184)..(184): n is a, c, g, or t
  modified_base (699)..(699): a, c, t, g, unknown or other
  misc_feature (699)..(699): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatggaggtgacacagccacactcggtntcagtcgtcccaggacaggacggcaggactcacctgctcgtaggagtatagtaacgttcgaccgtaaagggtctttaaagtttttggttttaacgttacgggttaaccaggaccgaacgaaacgcccgaacggaccccgtaaccgggtcccccgtttgggttaggtttcgggtagtaagttaaggttaaagttaaaacggacgtaagggtacgggaacggaccgggtaccctacgggaacgggttacctacccgtaggacggtctaacgtttccgtcggtacggcccgtaccgacgtaccgtacggaaacggtaaccgtaggttacgtaccgtacggttacgaacctagtacgtaggttacggtaccgtaccggacggaacgtaagggtaacggacggtacggacgttacggtaacttacgtttagttacgtaacgaacgcgtaacgagaacgagtacggtaggttcggttacgtttaacgggtcggggttacggtccgggggaccggggtaacncggtcgtacggtacccgtggtacggaccgaccgacccgggtaacggtccctacccggtcccggtcgtcccgtcccg

SEQ ID NO: 47576 - DNA, 825 bp, Homo sapiens
  misc_feature: GYAE6OF01BLDEQ.43.69.G03.1.454.CMB.1.raw
tcagtgtgagtagtcacgaccggtgctcgatttagtcgctgcgtaaaaggagaaaggggggtgtgggtccaggaggcagaactctgggtgtctcaccatggcctggatccctctacttcctccccctcctcactctctgcacaggctctggacggccgcctagtggaggtcgacacacgccacacgtcggtgtcgacggtccgtccccgaggaccgacggaccgggaccaggactccaccgtcgcgtcgtggaacgagtagtaagttcggaccgaaggtactaaagtttttgttttaacgttacggtaacccgtagacgaaacggaaccgaccgaacccgtcccggaacccggtccccgttgggttcgggtttaggtagtaacgtttaaggttaaaactaaaacgggacgtaacggtaacgggacggtacccgggtacccgttaaccgggtaccggggtaaccttcccggtaaggtaccggtacgttaccgtttcgtccggtcgggaccccgtaccgagtacccggttaacgaaggtaaccgtacgtacgtcgtaacgtacgaccgtaagtacggtagtacggtacgtacgtacggaacgaaaggacgggaacgtacgtacgtaagtacgtttagttagttacggtaacgaacgttcgaaggtaacaaccggtacgtaccggttaacggttaccggttacggttacgggttaccgggtttcgggccgggggttaaaccgcggtaccgtagggtccgttaccggacggttaccgaccgtaccgtaaccggtccggacccttggtcccccggttacgtcgttacccg

SEQ ID NO: 47577 - DNA, 509 bp, Homo sapiens
  misc_feature: GYAE6OF02HBQ85.43.69.G03.1.454.CMB.1.raw
  modified_base (317)..(317): a, c, t, g, unknown or other
  misc_feature (317)..(317): n is a, c, g, or t
tcagtgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggccccctgtgttggtgatgtataaagacagtgagaggccctnagggatccctgagcgattctctggcgccagctcaggaacagtagtcgacgttgaccatcagtggagtccaggcagaagacgaggctgactattattgtcaagcagtagacagcagtgtccttagtcggtgtcggcggggacagcgtgaccgtcgtaggtcgagcccgaggcctcggcccctcggtcctaccg

SEQ ID NO: 47578 - DNA, 516 bp, Homo sapiens
  misc_feature: GYAE6OF02I2M3F.43.69.G03.1.454.CMB.1.raw
  modified_base (412)..(412): a, c, t, g, unknown or other
  misc_feature (412)..(412): n is a, c, g, or t
  modified_base (452)..(452): a, c, t, g, unknown or other
  misc_feature (452)..(452): n is a, c, g, or t
tcagtgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctgagggatccctgagcgattctctggcgccagctcaggaacagtagtcacgttgacatcagtggagtccaggcagaagacgaggctgactattatgtanaagcagtagacagcagtgtaccttagtcgggtgttcgggnggggaccaggtcgtggacccgtcgtaggtcgtagcccgaaggctaccggcccctcggtctaccg

SEQ ID NO: 47579 - DNA, 513 bp, Homo sapiens
  misc_feature: GYAE6OF02IZXUM.43.69.G03.1.454.CMB.1.raw
tcagtgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagccccaggcccctgtgttggtgatgtataaagacagtgagaggccctcagggatccctgagcgattctctggcgccagctcaggaacagtatcacgttgaccatcagtggagtccaggcagaacgacgaggctagactattattgtacaagcagtagacagcagtgtccttagtcggtgtcggcggggacaaggcgtggaccgtccgtaggtcaggacccaaggcctcgcccccgtggtctaccg

SEQ ID NO: 47580 - DNA, 515 bp, Homo sapiens
  misc_feature: GYAE6OF02GMXQS.43.69.G03.1.454.CMB.1.raw
tcagtgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagccccaggccccctgtgttggtgatgtataaagacagtgagaggccctcaggggatccctgagcgattctctggcgccagctcaggaacagtagtcacgttgaccatcagtggagtccaggcagaagacgaggctgactattattgtacaagcagtagacagcagtgtccttagtcgggtgttcgggcggggacaaggcgtggaccgtcctaggtcacgccgaggcctcggccccgtcggtctaccg

SEQ ID NO: 47581 - DNA, 503 bp, Homo sapiens
  misc_feature: GYAE6OF02GIXKH.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtcccccaggacagacggccaggatcacctgctctggagatgaattgccaaggcaatttgttattggtaccagcagaagccagcccaggcccctgtgttggtgatgtataaagacagtgagaggccctcagggatccctgagcgattctcgtggcgccagctcaggaacagtagtcacgttgaccatcagtggagtccaggcagaagacgaggctgactattatgtacaagcagtagacagcagtgtcttatcggtgtcgggcggggacagcgtgaccgtcgtagtcagccgaggcctcgccccgtcggctaccg

SEQ ID NO: 47582 - DNA, 709 bp, Homo sapiens
  misc_feature: GYAE6OF02F7GMI.43.69.G03.1.454.CMB.1.raw
  modified_base (227)..(227): a, c, t, g, unknown or other
  misc_feature (227)..(227): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatccacctgctctgganatgaattgccaaggctaatttgtttattggtaccagcagaagccagcccaggcccctgtgttggtgatgtataaagacagtgagaggccctcgaggggactccctggagcgattctcgtggccgccagctacgaggaaactaggttacgtcgtaacggtttgaaccctagtccgaaggttcggaacggttcccgagggacctaaaggaaacggaccggaagggccgttaggaacgtttaagttttagttcgtacaacggtacgaagttaacggactaagggaccgtaaggtttccggttaccgttttaaggttccgggggtttacggtttacccggggggaccggggggttacccgaagggtcccggtttaacgggtaaccccgggtttcccggtaaagggttcccggtaaccggtacccccggtaaacggggtccccgtcccggtacccccccgggtttaccggtacccgttaacccccgg

SEQ ID NO: 47583 - DNA, 510 bp, Homo sapiens
  misc_feature: GYAE6OF02FZA3A.43.69.G03.1.454.CMB.1.raw
tcagtgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgttattggtaccagcagaagccagccccaggccccctgtgttggtgatgtaataaagacagtgagaggccctgagggatccctgacgcgacttctctggcgccacgctcgaggaacagtacgtcacgttcgaccatcagtggagtcgaggcagaagacgaggctagactattattgtacaagcagtagacagcagtgtcttagtcggtgtcgggcggggacagcgtgaccgtcgtagtcagccacggcctcgcccgtgctaccg

SEQ ID NO: 47584 - DNA, 499 bp, Homo sapiens
  misc_feature: GYAE6OF02G43ZU.43.69.G03.1.454.CMB.1.raw
  modified_base (414)..(414): a, c, t, g, unknown or other
  misc_feature (414)..(414): n is a, c, g, or t
tcagtgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggccccctgtgttggtgatgtataaagacagtgagaggccctcagggatccctgagcgattctctggcgccagctcaggaacagtagtcacgttgaccatcagtggagtccaggcaggaagacgaggctgactattatgtnaagcagtagacagcagtgtcttagtcggtgtcggcggggacagcgtgaccgtcaggtcagccaggctcggcccctcggtctaccg

SEQ ID NO: 47585 - DNA, 514 bp, Homo sapiens
  misc_feature: GYAE6OF02FLL1W.43.69.G03.1.454.CMB.1.raw
  modified_base (226)..(226): a, c, t, g, unknown or other
  misc_feature (226)..(226): n is a, c, g, or t
  modified_base (358)..(358): a, c, t, g, unknown or other
  misc_feature (358)..(358): n is a, c, g, or t
  modified_base (427)..(427): a, c, t, g, unknown or other
  misc_feature (427)..(427): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctgganatgaattgccaaggctaattttgttattggtaccagcagaagccagcccaggcccctgtgttggtgatgtataaagacagtgagaggccctcagggatccctgagcgattctctggcgccagctcaggaacngtagtcacgttgaccatcagtggagtccgaggcagaagacgaggctggactattattgtcaagcagtanacgagcagtgtacttagtcggtgttcggcggggacagcgtggaccgtcgtagtcgacgacccgaggtccgtgcccccgtcgctaccg

SEQ ID NO: 47586 - DNA, 625 bp, Homo sapiens
  misc_feature: GYAE6OF02HSFON.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttctccccctctcactctctgcacaggctctgaggccgcctatgaggtgacacagccacactcggtgtcagtcgtccccaggacagacggcaggatcacctgctctggagatgaattgaccaaggctaattttgtttattggtaccagcagaagccacgcccaggcccctggtgttggtgatagtaataaagacagtgagacggccctgagggactccgtgacgcgtatctcgtggcgccagcacgaggaacagtacgtctacggttagacctaagtcaggtaggacgtaccgacggtcgaaggaaacggacggaaggctacggaacttattagttcgtacgaaagacgtaaggtaacgacgagacgtaggttcggttaccttaacgggttcgggttacggttaccgggggtacgggggaccaaggtccgttaacggacccggttacggtacggtaccacggtacccgtaacgggaccttcccggacccccgttcggtacccttacccgg

SEQ ID NO: 47587 - DNA, 634 bp, Homo sapiens
  misc_feature: GYAE6OF02G3VMF.43.69.G03.1.454.CMB.1.raw
  modified_base (227)..(227): a, c, t, g, unknown or other
  misc_feature (227)..(227): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctgganatgaattgaccaaggctaattttgtttattggtaccagcagaagccagccccaggcccctgtgttggtgatgtataaagacaggtgagacggccctagagggactccgtgacgcgtacttccgtcgtcggccgtaccgacgtcctacggaacggaacgtaggttaacgtccgtaacggtttaccgaacctacgtacgacggtacgggaacgttaccgaagggtacgaacggaacggaacggacggcgtagaacttagttagttcgtacgaagcgtaagtaacgacgagacgtaggtacgttaccgttagggtcgggttagggtccggggaccggggtacaggtacgtcggtacccgttcgtacggccgaccggaccgacggtccgtacccggcccgtcggctaccgg

SEQ ID NO: 47588 - DNA, 729 bp, Homo sapiens
  misc_feature: GYAE6OF02JZYXB.43.69.G03.1.454.CMB.1.raw
  modified_base (184)..(184): a, c, t, g, unknown or other
  misc_feature (184)..(184): n is a, c, g, or t
  modified_base (341)..(341): a, c, t, g, unknown or other
  misc_feature (341)..(341): n is a, c, g, or t
tcagtgtgagtagtcacgaccggtgctcgatttagtcgctgcgtaaaggagaaagggggggtgtgggtccaggaggcagaactctgggtgtctcaccatggcctggatccctctacttctcccctcctcactctctgcacaggctctgaggccgcctatgaggtgacacagccacactcgggtntcagtgtccccaggacagacggccaggatccacctgctacgtggagatgaattgccaaggctaagtttgttattggtaccagacagagccagcccacggcccttgtgttggtgatggtataaaggacaggtgagacggccctacggaggacttccgngacgctattctcgtggccgctagcctacgaaggtaacgtacgtacggtacctacggttacgacctacgtacgacggtacggtacggtcccggaacggacgtaaacggaaacggtaacgggaacgggtcgtagtaaaccgttacgtttaacgtttaggtaacgtaacgtaccggttaaggtaacgtacgtacggtacgtaacggttacgggttacgttttaaccggtacgggttacggggttaccgggggtaacccggggggttaccgtaaccgggtccggttaaccgggttacccggttaccggttaaccgggtacccgtaaccgggtcccggtaaaccggtcccggtacccggttacccccgggttacccgttcccggttaaccccg

SEQ ID NO: 47589 - DNA, 597 bp, Homo sapiens
  misc_feature: GYAE6OF02GGXDD.43.69.G03.1.454.CMB.1.raw
  modified_base (174)..(174): a, c, t, g, unknown or other
  misc_feature (174)..(174): n is a, c, g, or t
  modified_base (182)..(182): a, c, t, g, unknown or other
  misc_feature (182)..(182): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
tcagtgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccanactcggtntcagtcgtccccaggacagacggccaggatcacctgctctggagatgaattgaccgaaggctaattttgttattcggtaccagcagaagccagcccaggccctgtgttggtnatgtanaaagcagtgaagaggccctgagggtactcccgtagagacgtattctcgtggccncgaagctacgaggaaccngtagtcaaggttcacatacgagtcggacgtcaggacgaagaagacgaggctagactacttagttagtactaagacgagagtacgacgacgtaagttcggttaccgtagttcggttcggtacggggtaccggggtacgaacggtcgtaaccggtaaccgttcggtaacggttccgtaccggacccggtacggtacccgtccgtacccccggtccgtaccgtacccg

SEQ ID NO: 47590 - DNA, 801 bp, Homo sapiens
  misc_feature: GYAE6OF02JI9JR.43.69.G03.1.454.CMB.1.raw
  modified_base (170)..(170): a, c, t, g, unknown or other
  misc_feature (170)..(170): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacngccacactcggtgtcagtgtccccaggacagaccggccaggactcgacctgctcgtggagatgaattgccgaaggtactaattttcgtttaagttcggtaccagtccaaggaaacgcccacggccccgacgggtcccccttagggttcgtttagggtcgaagtttacggtaattaaaaaggacctaaggttgaacggaacggtccccttaggaaggggaccttccccgtaggacggtacgtactttcccgtttagccggggtaccgtaccccgaaggtcccgttaacggaacggggtaaaaccctaggggtttaaacgttcccgtaaaccgggttttccgaaacccgtttaagtaccgtaacggtacgggtaagtaccccggtaaggaccgtaaaggaaacggaacggaacgggtacctaggtaacctttaacgtttaagttaccgtactaaaccggctaaaggtaacgtacgaacggaccgttacggtcggttaacccgtttgggttaccgggttagggttaccggggaccgggggttaaccacgggttacccgtacggtaccggttacggtaaccggtacgaaccgacccggttagggaccccgttcgacccccgtggtaccctaccgg

SEQ ID NO: 47591 - DNA, 799 bp, Homo sapiens
  misc_feature: GYAE6OF02FZ6KB.43.69.G03.1.454.CMB.1.raw
  modified_base (62)..(62): a, c, t, g, unknown or other
  misc_feature (62)..(62): n is a, c, g, or t
  modified_base (157)..(157): a, c, t, g, unknown or other
  misc_feature (157)..(157): n is a, c, g, or t
  modified_base (168)..(168): a, c, t, g, unknown or other
  misc_feature (168)..(168): n is a, c, g, or t
  modified_base (241)..(241): a, c, t, g, unknown or other
  misc_feature (241)..(241): n is a, c, g, or t
  modified_base (315)..(315): a, c, t, g, unknown or other
  misc_feature (315)..(315): n is a, c, g, or t
tcagtgtgagtagtcacgaccggtgctcgatttagtcgctgcgtaaaggagaaaggggggtntgggtccaggaggcagaactctgggtgtctcaccatggcctggatccctgtacttctcccccctctcactcctctgcacaggctctggaggcccnctatggaggtnacacgacgccacaccgttcggtgtcaggttcgaccccgaggacaggaccggccaggatccgactgctgagganatgaatcgacaagcttaagtttgttatcgtacagcagacgccgacgccgacgcctggtgtggtgtagtagtaanaagacgagtaggacggaccgtccgtacggacggtacctccgtaggaccgtacgttactttccggtccggtacggaccgtacccgaaccggtaccgtaacggaaacggtaaacgttacgggttaaccgttacccggttacggtaacccgtaacctacggtttacgacgggtttacggacggtaaccgacgggtaaacggacggaaacgggtacgggtccggtacgttacggttaacctttaaggtttaacgttaccggacgtaacgtaacggttacgaactaaccggaggtttaccgtaacgggtttcggtttaccggttaacgggttcggggtttaccggggtacggggggaacccggggttacaaccgggttccggttacgggtaaccccgtttccggggtacccgtaccggttaaccccggaccggtttaccgggtccccgtaccccgggtccccgggtttaccggcccctttaaccccggg

SEQ ID NO: 47592 - DNA, 631 bp, Homo sapiens
  misc_feature: GYAE6OF02IHHG2.43.69.G03.1.454.CMB.1.raw
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
tcagtgtgagtagtcacgaccggtgctcgatttagtcgctgcgtaaaaggagaaaggggggtgtgggtccaggaggcagaactctgggtgtctcaccatggcctggatccctctacttctcccccctcctcactctctgcacaggctctgaggccgcctatgaggtgacacagccacactcggtgtcagtcgtccccaggacagacgccaggatcactgctctgganatgtaattgaccaaaggctaattttgttaattggtaccagcaagagccagccaggcccctgtgttggngatagtaataaagacagtgagnggccctgaagggctaccngacgtcgattcgtctaggcgcagctagacggaacagtacgtaccgtacgtttacgacctatacgagggtacgaacgtccgaagggtcaaacggaaggacggaggtcgtaacggtattaagttacttaggaactaaggaccgaaagtacggaaaccgagacgtaggttacggttacccttaaggcggggttttcggttaccggggggacgggggtaaccaggtaccgttacggtaacccggtcgtaacgggtacgaacgcccgaaggtccgtaccgtacccccggtcgtactacccg

SEQ ID NO: 47593 - DNA, 727 bp, Homo sapiens
  misc_feature: GYAE6OF02GOLLK.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgttatggtaccagcagaagccagcccaggtcccctggtggttggtgatgtaataaagacagtgaggacggccctgagggtactcccgtggacgtacgtatttccgtcgtcgggccgaccgagccgtacgaacggtaaacgtagttaacgtccgtacggtttacgaacctagtacgacggttagggaacgttccgaacgggtaccgaagggtaaacggaacgggtacgggtaccgttacggtaaacgtttaagttttaagttacggtaacgtaacggacgtaacgttaacggaactacggtaccgtaaggttcgggtttacccttaagggttccgggtttacggggttaccgggggaccggggggtacctaacgggtccggttaccggtaaccccgggttaccggttacgggtaccgtacccgggtacccggtaacgggttcccgtacccgggtcccccgttacggtacccttaccccggg

SEQ ID NO: 47594 - DNA, 582 bp, Homo sapiens
  misc_feature: GYAE6OF02G1CFD.43.69.G03.1.454.CMB.1.raw
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgtttattggtaccagcagaagccagcccaggcccctgtgttggtgatgtaataaagacagtgagaggccctgagggactcccgtgacgcgattcctctcgggcgaccgagctcgaagggaacagttaacgtcacggttgaccctagtcgaggtgggagtccgaggcaaggaagacggaggcgtgacgttattagttagtactaagctaagtagaacgagctaggttcggttccttaggtcgggtggttcggggacgggggaccaggtcgtcggaccgttccgtacgggtacgacggtacccgaggcccgtccggtccccgttccggtcttaccg

SEQ ID NO: 47595 - DNA, 706 bp, Homo sapiens
  misc_feature: GYAE6OF02FWKOS.43.69.G03.1.454.CMB.1.raw
  modified_base (155)..(155): a, c, t, g, unknown or other
  misc_feature (155)..(155): n is a, c, g, or t
  modified_base (183)..(183): a, c, t, g, unknown or other
  misc_feature (183)..(183): n is a, c, g, or t
tcagtgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggcccnctatgaggtgacacagccacactcggtntcagtcgtccccaggacaggaccggccaggatccaccgtgcctctagggatatgtaattcgaccaaggactaattttgtttagttcggtaccagacgagaacgcctacgccccacggtccccctggttcggttaggtgtaagttaggtaaagtaaaacgtacgaaggttggaagtaccgggaccctacggaacggggtacctcccgtacgggacggccgttaacgtttccgtcgttacgggccgtcccgaacgtcgtacgaacggtaaacgaggtacgtaccgtacggtttaccacgtactcggtaaggtggaacgtccgaaggtccaaggaaacgacggaggcctagtaactagtttatgaactagactaagtagacgacgacgtagggttcgttacgtttacggtacggggttggtacggggaacgggacgtaacggcgttccggtaaccggtccgttaaggaccgtaccggaccggtacggtccgttaccccggtaccccgttccggtaccttaacccgg

SEQ ID NO: 47596 - DNA, 941 bp, Homo sapiens
  misc_feature: GYAE6OF02F2P37.43.69.G03.1.454.CMB.1.raw
tcagtgtgagtagtcacgaccggtgctcgatttagtcgctgcgtaaaggagaaaggggggtgtgggtccaggaggcagaactctgggtgtctacaccatggcctggatccctctacttcctccccctctcactctctgcacaggctctggacggccgtcctagtggaggtcgacacaggcccacacgttcggtgtacgagttccgtaccccgaggaccacggaccgccgaaggtactccaccgtggtccgtagcgggaatagtaacggtagttccggaaccgaagggtactttaaagtttttcggtttaagtttacggtaccgtagacgaaagtaacggacccaccggacccgtaccgggtccccttgggttcggtttaggtcggtaacgttaacggttaaagtaaaacgtaacggtaggttaacggaacggtacccggtcccgttaccgggaacgggttaaccgttcccggtaaggcgggtaccgttacgttccgtaccgggttcggacccgtaccgtacgtacccggtaacgggaaccggtaaacgttacggttaaaccggttaccgttaaaccggttaacgtacccgtaacggtttaccgtaacggggtaacccggtacggtttaaccgggaaccgggtacgtaaacggggaaaccggtaaccgggtaacgtacccgggtttaagtaaaccgtttaacggttttacttaacgggaccgtaaacggtagtaacggttaaacctaccgggaagttaccggtacgtttagggtttcccgttaaaggttccggggttacgggttacccgggggtaacgggaccccgttaggaccccgggtttaaaccgtaccggttacggtacccggtaacgtaaccccggaacccgggttaaccgcccggtttaccccccggtaccccgggttaccgtcccgttaccccgg

SEQ ID NO: 47597 - DNA, 164 bp, Homo sapiens
  misc_feature: GYAE6OF01B2AMR.3.87.H10.1.454.CMB.1.raw
  modified_base (160)..(164): a, c, t, g, unknown or other
  misc_feature (160)..(164): n is a, c, g, or t
tcagagacgcactccacgaccggtgctcgatttagcagtactgcgttgggtttgggctgaccaaggtcaccgtcctaggtcagcccaaggccaaccccactgtcactctgttcccgccctcctcgagtgcgtctctgagcgggctggcaaggcgcatagnnnnn

SEQ ID NO: 47598 - DNA, 193 bp, Homo sapiens
  misc_feature: GYAE6OF01DCW1K.3.87.H10.1.454.CMB.1.raw
  modified_base (155)..(155): a, c, t, g, unknown or other
  misc_feature (155)..(155): n is a, c, g, or t
  modified_base (160)..(193): a, c, t, g, unknown or other
  misc_feature (160)..(193): n is a, c, g, or t
tcagagacgcactccacgaccggtgctcgatttagcagtactgcgttgggtttgggctgaccaaggtcaccgtcctaggtcagcccaaggccaaccccatgtcactctgttccccaccctctcgagtgcgttctctgaggcgggctggcaaggcnatagnnnnnnnnnnnnnnnnnnnnnnnnnnnnnnnnnn

SEQ ID NO: 47599 - DNA, 171 bp, Homo sapiens
  misc_feature: GYAE6OF02HJG6E.3.87.H10.1.454.CMB.1.raw
  modified_base (158)..(171): a, c, t, g, unknown or other
  misc_feature (158)..(171): n is a, c, g, or t
tcagagacgcactccacgaccggtgctcgatttagcagtactgcgttgggtttgggctgaccaaggtcaccgtctaggtcagcccaaggccaaccccactgtcactctgttcccgcctcctcgagtgcgtctctgagcgggctggcaaggcgcatagnnnnnnnnnnnnnn

SEQ ID NO: 47600 - DNA, 514 bp, Homo sapiens
  misc_feature: GYAE6OF01DXR4V.10.68.G02.1.454.CMB.1.raw
  modified_base (324)..(324): a, c, t, g, unknown or other
  misc_feature (324)..(324): n is a, c, g, or t
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacagcaaaagccaggccaggcccctgtcttgtgatatatgaggacaccaagcgaaccctccggaaatttcngagagattctccggctccagctcgagggacagtggcctcttgactatcagtgggcccagggggtcgagtgaggctgactactactgtttctcgactgacttcactaggtaaacgttggtcttgttcggcggagggaccaagctgaccgtcctgcgtcacgcccaaggtcctcgtcccctcgtcactcccg

SEQ ID NO: 47601 - DNA, 573 bp, Homo sapiens
  misc_feature: GYAE6OF01DI0JR.10.68.G02.1.454.CMB.1.raw
tcagcatagtagtgcacgaccggtgctcgatttagtcgatagtgaagggaaagggggtgtgggctcaggaggcagagctctgggaatctcaccatggcctggacccctctcctgcctccccctcctcactttctgcacagtctctgaggcctcgtatgaactgacacagccaccctcggtgtcagtgtccccaggacagactgccaggatcagctgctctggagatgcattgccaaacaaaatatgcttatggtacgagacaaaagccaggccaggcccctgtcttgttgatatatgaggacaccaagccgaccctccggaatttctgagagtattctcccggctccagcctcgagggacaggtcggcccttccttagactatcgaggtcggggcccgagggggtcgagtggaggctgactactacgtgtttctcgactgtacttcacgttaggttaacgttggcgttggttccgggacgggacgggaaccaaggccgtggacccggttccgtggccgttccgacgccccgaagggtcccgtaccgccccccgttcgggtccctccgttcccg

SEQ ID NO: 47602 - DNA, 536 bp, Homo sapiens
  misc_feature: GYAE6OF01EOPK0.10.68.G02.1.454.CMB.1.raw
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (525)..(525): a, c, t, g, unknown or other
  misc_feature (525)..(525): n is a, c, g, or t
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaaacaaaatatgcttattggtacgagcaaaagccaggccaggcccctgtcttgttgatatatgaggacaccaagcgaccctcggaatttcngagagattcnccggctccagcgtcggggacagtcggcctccttgactatcagtcggggcccgaggggtcgagtgaggctgactactacttgtttctcgtactgacttcaactaggttaaacgttggtcgttgttcggcggacgggaccgaagcgtgaccgtccgtcgcgtcgacgcccgaaggcctcgccccctcggtccnccgtcgtcccg

SEQ ID NO: 47603 - DNA, 643 bp, Homo sapiens
  misc_feature: GYAE6OF01DHPWB.10.68.G02.1.454.CMB.1.raw
  modified_base (307)..(307): a, c, t, g, unknown or other
  misc_feature (307)..(307): n is a, c, g, or t
tcagcatagtagtgcacgaccggtgctcgatttagtcgatagtgaagggaaagggggtgtgggctcaggaggcagagctctgggaatctcaccatggcctgggctctgctgctcctcaccctcctcactcaggacacagggtcctgggccctgtctgccctgactcagcctgcctccgtgtctgggtctcctggacagtcggtcaccatcctcctgcactggaccccagcactgatgttggcaattataaccttgtctcctgtatcaacaacgcccagaccaaacgcccccacactcttagatttangaagtcaagtaacgccggccctgacggtacgtccctgtacttcggttctctcgtccctaccgaagtccgtggaccaaccgccggtccctcccgtgacccgttctccgtcgggtcctccgaggctaggaggtagtggaggtctagtactttaccgtacgtgcgacgccgactaattaccttcgaacccggtaccccgaacgggttaggggttcgggtttcgggaccggggtaccgggtaaccgttaacggggtccgtacccgggttcccggttggggtacccacgggtaccccgtaacgggtcccttcccggtccccccgttggttcccgtaacccg

SEQ ID NO: 47604 - DNA, 866 bp, Homo sapiens
  misc_feature: GYAE6OF01EYIA8.10.68.G02.1.454.CMB.1.raw
  modified_base (263)..(263): a, c, t, g, unknown or other
  misc_feature (263)..(263): n is a, c, g, or t
tcagcatagtagtgcacgaccggtgctcgatttagtcgatagtgaagggaaagggggtgtgggctcaggaggcagagctctgggaatctcaccatggcctggacccctctcctgcctccccctcctcactttctgcacagtctctgaggcctcgtatgaactgacacacgccaccctcggtgtcagtcgtcccaggacagactgccgaggatcgagtctcgctcgtagggatagtgctagttacgaaccctaaaataaaattntgtacttaggtttacggaacgtagaacaaaacggcccgacggacccgaccggtccccgttaggttccgtttaggttacgtaagttataacggtagggaacggaaccaaccgtaaccggtcccgtaaccccgttacccggttaaatttccggaggaacgtacgtaccgtttccgtcccgggtacctccgacgtccgacgtacgggactcggtcggtcccttacgttacgtaccgttagtaccggtacggggtccgggggaacccggtaggggggtacctaggtacgggacggttaccgtaacggtaacctttaaccggtttaccgttttcggtttacccggtacgttaccccggttaagttaaccccggtttactaaccggggttttaacggggtttaaacccgggtttacggtccggttttacggggggttacccggaaccggggggttaacccgggaacggttaacccgggtaccgtaacccggggtttaccccggttccggtaccggggttaccccgtcggaaacccccggtttacccggaaacgggttccccccgtcccgttaccccccggtcgttaacccctcccggttttacccccgg

SEQ ID NO: 47605 - DNA, 602 bp, Homo sapiens
  misc_feature: GYAE6OF01AI4CH.10.68.G02.1.454.CMB.1.raw
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgaccaaaacaaaatatgtctttagttcggtaacgagacaaaagccgaggccacggcccctgtctttgtgatatagtgaggacacgagccgaccctcgatttcagagagtacttcgtccggctccgagcctacgagggacaggtcggcccttccgttagactactcgacggtcggggcccggagggggtcgagtggacggtctacgtaccttacttacgttgtttaccgtcgtactcgtacttacgtacgttacggttaacggttggtacgttggttaccgggacggacggtaccgaggtccgtacgacccgtccgtcggccgtcgaccgacccgaacggtccgtacccgtccccgtcgtcccgtcgttcccg

SEQ ID NO: 47606 - DNA, 842 bp, Homo sapiens
  misc_feature: GYAE6OF01DBIYM.10.68.G02.1.454.CMB.1.raw
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgaccaaacaaaatatgtacttatggtacgagacaaaagccaggccaggcccctgtggttgtcgtctataatgataaccgaccggcctcgagggtactcccgtgacgtcgtatttccgtcgtcggccttaccgtaaagtttccggggacctaaaccgacccgggtacccctaaccccgtctaacgtcctaacgtacccgtaacccgtaacgggggtaccggtaacggggacccggggggtaacgttcgggaacccggggtaaccccggtaaccgtttaacccgttaaccggtttacgggttaacccggttaagggggtttacgggttaacgggggtttaacctttttacccgtaaaccgttttaaccgtagggttaaccgtttacccgtaaaggtttcggggggtttccgggggggttttaaccggtttacccggggggtaccgggggtaaaacccggggtaccccggtaaacgggttacccgtaccggggtaaaccccgggtttacccgttaaacgggttacccgaaccggaacccccggtaaacgggttcccggttacccccggttacccccccggtttacccggttacccgttaccccggtttcccccgg

SEQ ID NO: 47607 - DNA, 703 bp, Homo sapiens
  misc_feature: GYAE6OF01AT28P.10.68.G02.1.454.CMB.1.raw
tcagcatagtagtgcacgaccggtgctcgatttagtcgatagtgaagggaaagggggtgtgggctcaggaggcagagctctgggaatctcaccatggcctggacccctctcctgcctccccctctcactttctgcacagtctctgaggcctcgtatgaactgacacagccacctcggtgtcagtcgtcccaggacagtactgccaggatcgagtctgccgtcgtaggactatcgctagttacgaccaaaactaaaattcgtagtacttttaagttcgggtaacgacgaacgtaaaacgccgacggcccgacggtccccttggtccgtttggtacgtaacttaatagtaggaacggaacctaaccgaacgtccgaaccccgttcgtaaatttcgacgagtacgtacttccggtccgacttaccaggtcctacggaacggggtactcgggtccgtaccgttcgttacaacgtacgtcggtacggggttcggggaacccggtcgggggttacgtacggtcggtaggtaccgttacgtaaccgtttcggtacgtttcggtttacgtacgttacggtcgttaccgttcgtaaccggttaggttaaccgggtcggtacgttcgggtaccggacggtacggacctaggtccgtaccggtccgtcgtcgccgcgacccgctacggtcctcccgtaccgtcgcctcgtcccg

SEQ ID NO: 47608 - DNA, 1026 bp, Homo sapiens
  misc_feature: GYAE6OF01BEJQP.10.68.G02.1.454.CMB.1.raw
tcagcatagtagtgcacgaccggtgctcgatttagtcgatagtgaagggaaagggggtgtgggctcaggaggcagagctctgggaatctcaccatggcctggacccctctcctgcctccccctcctctactttctgcacagtctctgacgcctcgtatgaactgacacacgccaccctggtgtcagtcgtcccaggacagactcgaccaggtactcgagctgctcgtaggagactgactacgttacgaacccaaaaacgtaaaattacgtacgttaactttaggttacggtaaacgaacgtaaaccgaaaaacggccgaaacgggaacccgtaaacccgggtacccccttggtttaccgttttaggttaagtaacgtttaagtaggtaacggaaccggaaaccaaacccggaaacgtacccccgtaacccccgttaacgggttaaactttaccgtaaggtaacgtaacgttacgtttacccggtacccggtacccgtaccgtaaccggtaccggttaaccggaacgggggtaaacccgttaacggggtcccggttaaccccgtttaccggttacggttaaacccgttaaccgttaccgggtaacccggggttaccggggggtaaccccggggtaaccggggggttaacggtaacgggtacggggtaaccggtacccgttaaccgggtttaaacccgttttaaacccggttaacccgtttttacggtttttaccccgtaacccggtttacccgttaacggtttaaccccgttttaaaccgtttaaccgggtttaaaccggggttttaaaaccgggtttccggggtttaacccggtttaccgggggttacccggggaaaaccggggtaacccggggtaaccctaacgggttaacccggttacccgggttaacccggtacccgttaccgggtacccggtaacccggtacccggaacccggtaacccgggttccccgttaccccggttacccccccgtacgggttaccccgttaccccggttaccccggg

SEQ ID NO: 47609 - DNA, 515 bp, Homo sapiens
  misc_feature: GYAE6OF02GRQHE.10.68.G02.1.454.CMB.1.raw
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctcggctccagctcagggacagtggcctccttgactatcagtggggcccagggggtcgagtggaggctgactactacttgtttctcgactgactttcacttggtaaacgttggcttgttcggcggagggaccaagctgaccgtcgtgcgtcacgcccgaaggctcgcccctcggtccactccg

SEQ ID NO: 47610 - DNA, 525 bp, Homo sapiens
  misc_feature: GYAE6OF02GLQHJ.10.68.G02.1.454.CMB.1.raw
  modified_base (517)..(517): a, c, t, g, unknown or other
  misc_feature (517)..(517): n is a, c, g, or t
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaaacaaaaatatgcttattggtacgagcaaaagccaggccaggcccctgtcttgtgatatatgagacaccaagcgacctccggaatttctgagagattctcggctccagctcgagggacagtggcctccttgactatcaggtcggggcccgagggggtcgagtggaggctgactactactgtttctcgtactgacttcactggtaaacgttggcttgttcggcggagggaccgaagcgtagaccgtcgtgcgtccacgtccaaggtctccgccccgtcggtccncgttcccg

SEQ ID NO: 47611 - DNA, 577 bp, Homo sapiens
  misc_feature: GYAE6OF02G2K5J.10.68.G02.1.454.CMB.1.raw
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (569)..(569): a, c, t, g, unknown or other
  misc_feature (569)..(569): n is a, c, g, or t
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgcctctggagatgcattgaccaaaacaaaaatatgtacttattgggtaacgagacaaaagccaggccacggcccctgtcttgttgatatatgagacacaagccgacctcggaattcngaganattcnccggctcagctcgaggcagtcggccttccgtgtactatcagggtcgggcccggagggggtcgagtggaggtcgtgacttactacttcgtttctcgtactcgtacttcgtaacgtaggttaacgttggtcgttaggttccgggacgggaacgggacctaaggccgtcggtacccggtccgtcggtaccgtccgaacgcccgaacggcctccggcccccggttcggtccncgttcccg

SEQ ID NO: 47612 - DNA, 524 bp, Homo sapiens
  misc_feature: GYAE6OF02IK545.10.68.G02.1.454.CMB.1.raw
  modified_base (425)..(425): a, c, t, g, unknown or other
  misc_feature (425)..(425): n is a, c, g, or t
  modified_base (519)..(519): a, c, t, g, unknown or other
  misc_feature (519)..(519): n is a, c, g, or t
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacacgccaccctcggtgtcagtgtccccaggacagactgccaggatcagctgctctggagatgcattgaccaaacaaaatatgcttattggtacgagacaaaagccaggccaggcccctgtcttgttgatatatgagacacaagccgacctcggaattctgagagattctccggctcagctacgaggacagtcggcctcttgactatcgaggtcgggcccgaggggtcgagtggacggctagactacttacttcgtttccncgtactgtacttcacgttacggtaaacgttgcgttgtcgggcggtacgggacagctcgaccgtctgcgtcacgccgaggctccgcccgtgtccnctccg

SEQ ID NO: 47613 - DNA, 551 bp, Homo sapiens
  misc_feature: GYAE6OF02G4OW1.10.68.G02.1.454.CMB.1.raw
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgaccaaacaaaatatgcttattggtacgagacaaaagccaggccacggccctgtcttgtgatatatgaggacacaagcgacctcgaattcngaganattcnccggctcagctcgaggacaggtcggcctcttgactatcaggtcggggcccgagggggtcagtggaggtctgtacttactacgttgtttctcgtactcgtacttcacgttacggtaaacgttggtacgttggttcgggcggtaacggacgaaggcgtacggaccgtccgtggaccgtcgacgacccgaggtccgtccgcccccgtcggtcctaccgttccg

SEQ ID NO: 47614 - DNA, 769 bp, Homo sapiens
  misc_feature: GYAE6OF02I73D3.10.68.G02.1.454.CMB.1.raw
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtcgtccccaggacagactgccaggatcagctgctcgtggagatcgctattcgaccaaaacaaaattatacgtctttaagttaggtaacgagaacaaaaacgcccgaaggcccgaccggaccccttgttcgttggtttgattatagtcgtaagaccaaccgacgaccgtacccgtcggtaatttcgtacgagacgtacgttccgtccggtcctaccagtccttaccggaacgggtaccgtaggttccggtaccctttaccgtttacgacgtttaccgtaccgtacggggttccggggacccgggtacggggggtcgttaggtacgggtacggtccgtacgtaccgtttacgtaccgtttcgtttccgtacgtaccgttacgttaccgtttacgtaccggtttacgggtaaacggtttcggtaccgtttcggggttacccgggtacgggtaaccgggtaacccgtaacggtccggttaccggtaccccgttccggttaccgtccgggtacccgtaaccgggtacccgtaaccgggtcccgttccccggtacccccggttcccggttacccgtcccgtttacccccgg

SEQ ID NO: 47615 - DNA, 591 bp, Homo sapiens
  misc_feature: GYAE6OF02GRV1H.10.68.G02.1.454.CMB.1.raw
  modified_base (246)..(246): a, c, t, g, unknown or other
  misc_feature (246)..(246): n is a, c, g, or t
  modified_base (301)..(301): a, c, t, g, unknown or other
  misc_feature (301)..(301): n is a, c, g, or t
  modified_base (324)..(324): a, c, t, g, unknown or other
  misc_feature (324)..(324): n is a, c, g, or t
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctcgtggagatgcattcgaccaaacaaaatntagctttagttggtacgagacaaaagccaggccaggcccctgtcttgtgatatangagacacaagcgacctcgattcngagagtactctccggctccgagctcgacgggacaggtcggccttccgttagactatacgacggtcggggcccgagggggtcgagtggaggcgtagacttactacgttcgtttctcgtactacgacttctacgttacggttaaacgttggtacgttcggttcgggcggacgggaccaggtaccgtcggtacccggtcgtacggtccgtaccgacggacccgaacgggtccgtacccggtcccccgtacggttcccgtaccttccccgg

SEQ ID NO: 47616 - DNA, 556 bp, Homo sapiens
  misc_feature: GYAE6OF02GD9R1.10.68.G02.1.454.CMB.1.raw
  modified_base (328)..(328): a, c, t, g, unknown or other
  misc_feature (328)..(328): n is a, c, g, or t
  modified_base (441)..(441): a, c, t, g, unknown or other
  misc_feature (441)..(441): n is a, c, g, or t
  modified_base (549)..(549): a, c, t, g, unknown or other
  misc_feature (549)..(549): n is a, c, g, or t
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgaccaaacaaaatatgcttattggtacgagacaaaagccaggccacggcccctgtcttgttgatatatgaggacaccaagcgaccctcggtaatttcngagagtattcgtccggctcagctcgaggactaggtcggtccctcctttgaccttatcgagggtcggggccccgtaggggggtcagtggacggctgaccttactacttgtttcncgtacttcgacttctacgtaggttaacgttggtcttgggttcgggcgggtaagggaccaggcgtagacccgtcgtgccgtcacgcctaggcctccgccccgtgtcccncgttccg

SEQ ID NO: 47617 - DNA, 559 bp, Homo sapiens
  misc_feature: GYAE6OF02HRY4J.10.68.G02.1.454.CMB.1.raw
  modified_base (330)..(330): a, c, t, g, unknown or other
  misc_feature (330)..(330): n is a, c, g, or t
tcagcatagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgaccaaacaaaaatatgctttaagttggtacgagacaaaaagccaaggccacggcccctgtcttgttgatatatgagacacaagcgaccctcgaatttcngagagattctccggctcagctcgaggacagtggcctctgactatcaggtcggggcccgagggggtcgagtggaggtctagaccttacttacgttcgtttctcgactcgtacttcaacgttggtaaacgttggcttggttcggcggtacgggaccgaagtccgtcggacccgtcgtcggtcggtcacggcccgaacggccgtaccgcccccgtcggttccaccgttcccg

SEQ ID NO: 47618 - DNA, 688 bp, Homo sapiens
  misc_feature: GYAE6OF02I12DW.10.68.G02.1.454.CMB.1.raw
  modified_base (186)..(186): a, c, t, g, unknown or other
  misc_feature (186)..(186): n is a, c, g, or t
  modified_base (223)..(223): a, c, t, g, unknown or other
  misc_feature (223)..(223): n is a, c, g, or t
  modified_base (638)..(638): a, c, t, g, unknown or other
  misc_feature (638)..(638): n is a, c, g, or t
  modified_base (679)..(679): a, c, t, g, unknown or other
  misc_feature (679)..(679): n is a, c, g, or t
tcagcatagtagtgcacgaccggtgctcgatttagtcgatagtgaagggaaagggggtgtgggctcaggaggcagagctctgggaatctcaccatggcctggacccctctcctcgcctccccctcctcactttctgcacagtctctgaggcctcgtatgaactgacacacgtcccaccctcgggtntcacgttcgtccccaggaccagacctcgaccgaggtntaccgaggtcttgccgttaccgtagggacgtaatcgtacctagtttacgaacctaaaactaaaaacttatacgttctttaaggttacggtaacggaacgaactaaaacgcccgacggacccaccggtcccgttgttcgttgttagtatatacgtggaacgaccgaaccgaacgaccgtacccgtacgttacttcgtagacgtagtctaccgtcgcctcgacgctacggaggacacggtccggtcccttacgtacacgttcgcggtacgggtaccgggggcccggttaggggtcgaggtacggaccgtgtacggtacttacgttcgttcgtctacgctagtcctaacgtaggttacggttacgtggtactcgggtacggacggacgaccggacgtcgtccggtaccgtccgggtcncggaccaccggtaccgtcgccggtccaccccggtcttaccnccgttcccg

SEQ ID NO: 47619 - DNA, 873 bp, Homo sapiens
  misc_feature: GYAE6OF02IJ64P.10.68.G02.1.454.CMB.1.raw
  modified_base (240)..(240): a, c, t, g, unknown or other
  misc_feature (240)..(240): n is a, c, g, or t
tcagcatagtagtgcacgaccggtgctcgatttagtcgatagtgaagggaaagggggtgtgggctcaggaggcagagctctgggaatctcaccagtggcctcggaccccctctcctgcctccccctcctctactttctgcacatctcgtgaggcctacgtatgaactgaacacgacgccctacccgtcgggtctccacggttccgtaccccaaggacacggaactcggaccgaaggtacncgagtcctgtaccgttcggtggtaaacgtcttagacgtaacttcggaaaccaaaactaaaaattacgtcgttaacgttttaagttacggtaaacgaacgaaccgtaaaaacgcccggaacggtacccgtaacggtcccctttagttacccgttttagttaccgtaaatttaacggtaacgtacggtaaaccggtaaccaacccggtaaacggtaccccgttaacccggtaaacggttaaacgtttccgaggtaaagtacttaccgttaccgtccccggacgtcgaacggtcgtaaacggtacggaaaccgttggttacggtcccgttacttacggtaacttaccgtcggtacggggtccggggtaccggagggggtactaaagccgtaggtccctaaggttaaccttaccgtttaacgttacggttaccttacgggtaccttaagttccgttaaggtaccggttaaacggtttaacgggtcggttaacgttaccgggttagggaccggtaaccggggaacctaggaccgttaccgtaacccggtttcgaaccggttcggtaacccgacctacccgggaccggttaccccggtaaccgtcccccgggtttaatacccggttaacctttccccgg

SEQ ID NO: 47620 - DNA, 510 bp, Homo sapiens
  misc_feature: GYAE6OF01AKFWO.45.11.A11.1.454.CMB.1.raw
tcagacgcgatcgacacgaccggtgctcgatttagctacgactgcagggggggagaggagcccagcactagaagtcggcggtgtttccattcggtgatcagcactgaacacagaggactcaccatggagtctgggctgagctgggttttcctcgttgctcttttgagagctgtccagggtcaggtgcaactggtggaggcggggggaggcgtggtccagcctggggggtccctgagactctcctgtgaagcctctggattcagcttcagtacccatggcatgcactggtccgccaggctccaggcaaggggctggagtgggcggcagttatatcatatgatggaagtcacaaattctatggagactcgcgaagggccgcttcaccatctccagacgacaattccaagaacacactgtatctgcaagtgaacaacctgagagcggaggacacggctgtatattacgtgtgacgaaagagtagttggggtttggacgaggtagcgtggtaag

SEQ ID NO: 47621 - DNA, 831 bp, Homo sapiens
  misc_feature: GYAE6OF01DNPQO.45.11.A11.1.454.CMB.1.raw
tcagacgcgatcgacacgaccggtgctcgatttagctacgactgcgaagggaaagggggaggaactgctcagttaggacccagacggaaccatggaagccccagcgcagccttctcttcctcctgctactctggctcccagaaaccattggagaaatactgatgacgcagttccagccacctgtctgtcgtcgtaccgaaggggaaacacgcccaccctctccgtggccgtgggccagtcagtagtgttacgctaacctcttacgcctaggtaccagacaacgaaccgtggccacggcctacccgagtaccttcctactattttacgttcggttccttacgtacccgtcgggtacccgtcgtcgggtaaccttcccgagtccccgtagggttccaacggtcgtacccggtaggttcggggttacgtaggggaacctagggtacgttccgtaccgttacgtaccgtaacccgtagtacccaggccctaacggtcccgtacgtaccgtacggtacgttaacggtaacggtttacgttttacgttacgtttaacggtttttacgttttaccggttacgtttacgtaacgtaccgttaacggttaacttaaccgtaacgtttaaccgttacggttaccgtttacgtttaccggttacgggttttaccggaccgggttaacggggtaacccgtaagggtaaccggttaacggtaaaaccgtaaccggtaaaaccggttaacggtcgggttaacgggtaccgttacggacccgttaacccgttacgttaccgtttaccgttaccctttaccgttaacccgttcccgtttacccccgg

SEQ ID NO: 47622 - DNA, 702 bp, Homo sapiens
  misc_feature: GYAE6OF01D2EMS.45.11.A11.1.454.CMB.1.raw
  modified_base (316)..(316): a, c, t, g, unknown or other
  misc_feature (316)..(316): n is a, c, g, or t
  modified_base (526)..(526): a, c, t, g, unknown or other
  misc_feature (526)..(526): n is a, c, g, or t
tcagacgcgatcgacacgaccggtgctcgatttagctacgactgcagggggggagaggagcccagcactagaagtcggcggtgtttccattcggtgatcagcactgaacacagaggactcaccatggagtctgggctgagcttgggtttcctcgttgtcttcttttgtagagctgtccgtagggtcgaggtgacaacgtgggtgggaggggcggggggagggcgtcggtccgacgccgggtcgggggtcccgtgagtaccgtccgtccgtgtgaacgaccgtcgtggtattccagtccttcgacgtacccagtgtnactcgcgacgtcggcccgcgacggccgtccgagggacggacgggcggtgggaggtcgggacgtactagttatctacgtatagtagaggtgaacgtactaactaattcgtatacggacgaccgtccggacggaccgggtccgtcctacacccgtatccgtacgaaaggaactaacgtaaccttaaccgaaacaactacgactttagttacnccgtagaccgtaaagtaccgaaacaaccggtaggaagtaaccgggacggaacccggagtaaccggtcgttaacgttaaagttacgtttacggtcggtaggtaaaacgtaagggtaaggtttcggggttacggggtttagaccggttaggtttaacgtggggttaaggttttaaccg

SEQ ID NO: 47623 - DNA, 841 bp, Homo sapiens
  misc_feature: GYAE6OF01BSH8W.45.11.A11.1.454.CMB.1.raw
  modified_base (207)..(207): a, c, t, g, unknown or other
  misc_feature (207)..(207): n is a, c, g, or t
tcagacgcgatcgacacgaccggtgctcgatttagctacgactgcaaagggaaagggggaggaactgctcagttaggacccaggacggaaccatggaagccccagcgcagcttctcttcctcctgctactctggcctccaagaaacattggaagaaatactgatgacgcagtttctagcccacctgtctgtgtctccgaggggaaancgcctacctctccgtgcgtcgggaccaggtcaggagttcgtaagccaacctacgttacggccgttaggtaccaggacctaacggaaacctgggaccacgggtccctacccgaacgtaccttccttactagttttacgttcggtttaccttaccgtacccggaggggtccctaggtacggttacctcccgaggtcccgtaggttcgacggtcgaccgtaggttacggggttctacggggactagggtacgtttaccacttcctaccgtaactacttccgaacggtccacggttccgtacgaccgttaggttaccgttaaggtaacggttttacgttttcggtacgtttttaagtttttacgtttccgtttacgttacgtacggttcccgtacggttcccccgtttacccggaacccggtaccccgttcccggttacccgtttacccggggttaccccgggggttttacccggggggaacccgggggggtaaccgggttacgggggttacgggaggttaacgggtacgggtaacggggtaaaccgttaacgggtcggggttaacggcccggttaggacccttaccgttacgtccttttacggtcctttacccgtaccttccccgttccggtacccg

SEQ ID NO: 47624 - DNA, 788 bp, Homo sapiens
  misc_feature: GYAE6OF01CZT5D.45.11.A11.1.454.CMB.1.raw
  modified_base (752)..(752): a, c, t, g, unknown or other
  misc_feature (752)..(752): n is a, c, g, or t
tcagacgcgatcgacacgaccggtgctcgatttagctacgactgcaaaggggaaagggggaggaactgctcagttaggacccagacggaaccatggaagccccagcgcagcttctcttcctcctgctactctggcctccagaaaccattggaagaaatactgatgacgctacgttccacgccctaccctgtcgtggtcgtcctaccggaaggggaaagcgccccaccctctccgtgccgtcgggaccagtcgaagtagtggtaacacaaccgtacttacgccgtacggaaccaagactaacggaaaccgtcggaacacggcctaccgaacgtccttactacttactttcgttacggtttacctaccgtaaccggccgggtcctacggtacggttaccacccgtacgtacccggtaggtacgtaggtaccggtaccggtaggggttccgggggtcggtaacggggaactaacggggttacttacccgtacttcccgtaacctaaccgtactacccgtaggtaccgaccgttaccgacggtacgtaacgttcgttaaagggttaacgtttagttttacttaacgttttaacgttttctttagtaccgtaacacggttactaacgttacctaactaaggttaaccgtggttacttaacggttacggtttaccggtacgggtaacggacgggttaactacggtaaccgtaaagaaacgtaacgaaaggtcgtcggtacgctacggacctaacgttnttaccttacgtaccttaccgttccgtcccgttcccg

SEQ ID NO: 47625 - DNA, 823 bp, Homo sapiens
  misc_feature: GYAE6OF01BSECN.45.11.A11.1.454.CMB.1.raw
tcagacgcgatcgacacgaccggtgctcgatttagctacgactgcgaggggggagaggagcccagcactagaagtcggcggtgtttccattcggtgatcagcactgaacacaggaggactcaccagtggagtcgtggctgagcgttcggttttcctcggttcgtcttcgttttaggacgtacgtcgttcggtaccgtaggggttcgaaggttcgaccgtaacggtggggtggggacggggtacggggggagtcgggttcggtaccgcgggtccggtcgggggtacccctggacgtacctccgttccgtgtacgacgtcctaggtaggtacttcgacgtccttacgaacgtaccctagttccggatacgttcgaccgtacggtccggtacccgacgtaccggcccgtcggaaggtccggaagggtcgtagggtacggtcggacgggtacttaacgtactgtaacgtattacgtaacggtagtacggtaaactacctaaagtttaacttcggtaggaaccgttaacgaccgtccggacggtaccggttaccgccgtttaaccacctagtacccgaaccgttagaaactaccgttaaacgtacccgaaaccgtaactacgaccgttttgtaaccgtcgaattaacccgaagttacccgaaaacccgttaggtaggaacgggtaaccggaccgggtaagtaccgacggtacttaacggtttaaactacggtttaccgggtataaacgggaaacgtttaggtaaacccgggttgttttaaccggggacgtaattacccgggttacgttaggttaccggtttaaacggg

SEQ ID NO: 47626 - DNA, 810 bp, Homo sapiens
  misc_feature: GYAE6OF01B2KLI.45.11.A11.1.454.CMB.1.raw
  modified_base (468)..(468): a, c, t, g, unknown or other
  misc_feature (468)..(468): n is a, c, g, or t
tcagacgcgatcgacacgaccggtgctcgatttagctacgactgcaaagggaaagggggaggaactgctcagttaggacccagacggaaccatggaagccccagcgcagcttctcttcctcctgctactctcggcctacccgaagaaaacctagttggaaagtaaattacgtgaactggaaccgctacggtttacccagtcccctacccgttgtccttgtcgtcctaaccggaaggggtaaacgtccgaccctaccccttctcccgtggacccgttcggggccctaaaggtccgaaggtacgttacggttaacggaaccctaaaacccgtacgttaccggtacccgttacgggaaccaagtaccgaaaacgtaaccggtcgacccggaaggtccctaaccccgagtacccttccgaactacaccgatcggaactcgaactccgtaaccgaaccggtccggttacccgngtacccgtaccgaagttacgtcgggttccggaggcggtaagggtcggttaacgacgggaactacggtacttacgacctccgtaccgtaacccgtgaaccgactcggccggtacgtcgtacgtacgagtttcgttacgttcgtcgtttaacgtttacgtttcgtcgttacacgtaccggtccgtccggtcccgacccgtccgtccgtccgtaccggtaccgggtccggggacggggtacgggacgggtacggaggtacggtaacggacgtaccgggtaacggtggtggacctccgtaccgtccgaacgttcgttaccttcgttaccgtccgttccccgtaccg

SEQ ID NO: 47627 - DNA, 756 bp, Homo sapiens
  misc_feature: GYAE6OF01BRJEU.45.11.A11.1.454.CMB.1.raw
tcagacgcgatcgacacgaccggtgctcgatttagctacgactgcagggggggagaggagcccagcactagaagtcggcggtgtttccattcggtgatcagcactgaacacagaggactcaccatggagtctgggctgagcgttgggttttcctcgttgtcttcttttgagtagctgtccgagggtcaggtgacaacgtgggtgggaggggcggggggaggtcggtcggtccgaggtcccggtcggggggtcccctggacgtacctcctccgtgtacggaacgtccttcgtggtacttcgacgtccttaccaccgtacccagtcgctagtcgccgtacgtcggtcccgcgacggctccggacggcggagggtcgtgggacggtcgggcggtactagttacgtatcgtagtacgtaggagtaggtaactactaacgttaaattcgtaggtaggtacgtacccggtaccggacgggtaaccgggtcccgtacttaccacccgttactaccgtaccgaaggtaactaaccgtaaacttaacccgaaacgtacctaaaccgttaaccgttagtacgtacctaacggacgtaaacgtaaccgtaaccgtaaacggtagggaacggtacggaccgggaacggtaccggacgttattacgttacttacgttacgtacggtaggtaaaccggttaaggtacgggtttagggttaggggttaccgtaacggtaggttaaccggttgggttaggttttaaaccggg

SEQ ID NO: 47628 - DNA, 650 bp, Homo sapiens
  misc_feature: GYAE6OF02JXTQ5.45.11.A11.1.454.CMB.1.raw
  modified_base (349)..(349): a, c, t, g, unknown or other
  misc_feature (349)..(349): n is a, c, g, or t
  modified_base (397)..(397): a, c, t, g, unknown or other
  misc_feature (397)..(397): n is a, c, g, or t
tcagacgcgatcgacacgaccggtgctcgatttagctacgactgcagggggggaggaggaggcccagcactagaagtcggcggtgtttccattcggtgatcagcactgaacacagaggactcaccatggagtctgggctgagctgggttttcctcgttgctcttttgagtagctgtccagggtcaggtgcaacgtggtggaggcggggggaggcgtggtccgagccgtggggggtccctggagactctccgtgtgaaggcctctggattcagtctcgataccagtcgcatgacacgtgggtccgccgaggcctccgaggtccgaaggggctagggaggtcggggccggngtacggttatacgttgaattcgtggaatcgggaagtcaataaacgttnaagtggaacacgtcccggaggtaacgggccgtacgtacgacctaagtccctaccgaagtacgactaacttaccaaagactaacgaccttaggtaactccttaggaccttaaaggtacgaaacctaacccgttagggaacgacggacgggtaacggaaccgtaaccggggtcttagtacgttactttaaccgtgggtagtacgaaaggtactagggtttacgggttggtacgtaggacgttcgtagggtttaac

SEQ ID NO: 47629 - DNA, 701 bp, Homo sapiens
  misc_feature: GYAE6OF02FUY7C.45.11.A11.1.454.CMB.1.raw
  modified_base (118)..(118): a, c, t, g, unknown or other
  misc_feature (118)..(118): n is a, c, g, or t
  modified_base (123)..(123): a, c, t, g, unknown or other
  misc_feature (123)..(123): n is a, c, g, or t
  modified_base (177)..(177): a, c, t, g, unknown or other
  misc_feature (177)..(177): n is a, c, g, or t
  modified_base (248)..(248): a, c, t, g, unknown or other
  misc_feature (248)..(248): n is a, c, g, or t
  modified_base (326)..(326): a, c, t, g, unknown or other
  misc_feature (326)..(326): n is a, c, g, or t
  modified_base (434)..(434): a, c, t, g, unknown or other
  misc_feature (434)..(434): n is a, c, g, or t
  modified_base (533)..(533): a, c, t, g, unknown or other
  misc_feature (533)..(533): n is a, c, g, or t
  modified_base (657)..(657): a, c, t, g, unknown or other
  misc_feature (657)..(657): n is a, c, g, or t
  modified_base (679)..(679): a, c, t, g, unknown or other
  misc_feature (679)..(679): n is a, c, g, or t
tcagacgcgatcgacacgaccggtgctcgatttagctacgactgcagggaagggggaggaacgtgctcagttaggacccagacggaaccatggaagcccagcgcagctctcttctctnctacnctggctcccagaacatgagaatactgatgacgcagttccagtccacctgtcctntgtctccgaaggggtaaacgcgccaccgtccttcctgccgtcgggaccctagtccaaggacgttcgttaancgaacctacgttcgaccctggtaccaggccagaaaccctggcccgtaggccttacccagacctccgtacctattttancgggtttcttacctaaccacggggtcctaccttgggaaccttccgacgacccgttaggttccaacgttcggcagggttcggtcctagggggacccaaggacgtttacncccgttctccgaaccctaagttcccagaccgagccctaggggtactacgtcgaatacggtttactttttcgctttaacggtttactcgttgtttaccgngaacgttaacgtccgtaccgtccgtacccggacgtcccgacgttacccgttccggttcgggggtaacccgggaccggggttgaacggagttaccgaaggcgtaaacgcgtacggtcgacgtccnccggaagttctacgttaccgtntacggtcctttacccgtacccg

SEQ ID NO: 47630 - DNA, 547 bp, Homo sapiens
  misc_feature: GYAE6OF01BNMS8.23.75.G09.1.454.CMB.1.raw
  modified_base (220)..(220): a, c, t, g, unknown or other
  misc_feature (220)..(220): n is a, c, g, or t
  modified_base (409)..(409): a, c, t, g, unknown or other
  misc_feature (409)..(409): n is a, c, g, or t
tcagacgcgagtatcacgaccggtgctcgatttagtatagacatcagggggcagaagtctctctcagtcaggacacagcatggacatgagggtccctgctcagctccgtgggactcctgctgctctggctcccagataccagatgtgacatccagatgacccagtctccatcctccctgtctgcatctgtaggagacagagtcaccatcacttgccgggnagtcgagggcataagcaattatttagcctggtatcagcagaaaccagggaaagttcctaagctcctgactctactgctcgcatccactttgcgatcgagggtcccatctcggttcagcggcagtggatcgtgggacagagttcactctcacactcagcagccttacgagcccttgaacgtagtcgttanacgtaatttattactgttaactaaaagttactaactaggtccgtaccccgtacgggtaccgtttacgggacccgtacgggggaacccgtacggggtaacggtaaacgtacgaaaacggtaacgttcggtagggtaccg

SEQ ID NO: 47631 - DNA, 577 bp, Homo sapiens
  misc_feature: GYAE6OF01DIQ52.23.75.G09.1.454.CMB.1.raw
  modified_base (410)..(410): a, c, t, g, unknown or other
  misc_feature (410)..(410): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatccctccctgtctgcatctgtaggagacagatcaccatcacttggccgggcagtcgagggcataagcaattattagcctggtatcagcagaaaccgaggaaagttcctaagctacctgatctctgctgcactctactttgcgtatcgacgggtcccagttcgtcggttcaggcggcagtggatcgtagggactgtatttcacttctacacatcagcacgtccttcacgtccgtagaacgtnttagttacgtacttaattttacttaacttacgttaacgtaaagttaactaaacgtacggtccgtcccccgttacgggtaccggtttaccgggacccggtaacgggggaacccgtaagggggtaacggtaaaacgtaaccgaaaccggaaacgttgggtcggtacccg

SEQ ID NO: 47632 - DNA, 686 bp, Homo sapiens
  misc_feature: GYAE6OF01C0K6K.23.75.G09.1.454.CMB.1.raw
  modified_base (225)..(225): a, c, t, g, unknown or other
  misc_feature (225)..(225): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatccctccctgtctgcatctgtaggagacagagtccaccatcctacgtcggccgggngtaggtacgagggcaagtaacgactaaatttagtttaacgccgttaggtactacgagaccgaaacgaaaaccggaaggggtaaacgtttaccgtaaacgtccttaccgtagtacttcttacgtcgctcggacctacttacctacgtttgacgtacgtcggtaccgggtccctagtccgtcggttacacggcggcgtaggtggacttcgggtacgggactacggttactttaccgtaccttctaccaacctaactccgacgacgtaccgttcctacgacgtccgtaaggaacgttagttcggttactaacttttaattttaacgttacgttacgtaaacgttaaagtaactaaaccgttacgtcccggtacccgtaccgggtaaccggttcccgggaacgggaccggggaaccgggtagggtaaacgtaaacgtaacgaaacggttaacgtgggtcgtaccg

SEQ ID NO: 47633 - DNA, 550 bp, Homo sapiens
  misc_feature: GYAE6OF01CICP5.23.75.G09.1.454.CMB.1.raw
  modified_base (220)..(220): a, c, t, g, unknown or other
  misc_feature (220)..(220): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttggccgggnagtcagggcataagcaattattagcctggtatcagcaagaaaccagggaaagttcctaaagctcctgactctctgctgcactcctactttgacgtatcgacgggtcccagtccgtcggttcagcggcaggtggatcgtgggacagtactttcacttctacacatcagctacgtccttcacgtcctaggaaagtcttgttacgacttaaatttatttaacgtagttaactaaagttataaactgtacccgtcccgtacgggtacggttccggaccggtacggggaccgaggggttacggaaacgtacgaaacggtactagggtcggtaccg

SEQ ID NO: 47634 - DNA, 690 bp, Homo sapiens
  misc_feature: GYAE6OF01BMEV8.23.75.G09.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (462)..(462): a, c, t, g, unknown or other
  misc_feature (462)..(462): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatcacttggccgggnagtcgagggcataagcaattattagcctggtatcagcaacgaaacgagggtaaacgttcctaaagctacctgactctctagctgcatcctactttcgacgtatcggacggggtcccagttccgtcggttacacggcggcaaggtggactcgtacgggactaggttactttaccgacttccgtacaacctataccgacgtccgtaacgtccctttaccgaacggtcccgttaggaaaccggtnttacgggtttacctaactttaaacgtttttacgtttaacgtttaacggttaaacctaaaaaggtttaacgtaaaaccgttcgggttaacccggtaccccccggtttacgggtaacccgggtttaccgggaacccgggtaccgggggtaaaccccggtaacgggggttaaacgggtaaaaccgtaccggtaaaaaccggttaacggtaacgggttccgggtaaacccgg

SEQ ID NO: 47635 - DNA, 536 bp, Homo sapiens
  misc_feature: GYAE6OF01BYPSZ.23.75.G09.1.454.CMB.1.raw
  modified_base (438)..(438): a, c, t, g, unknown or other
  misc_feature (438)..(438): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcagtcagggcataagcaattatttagcctggtatcagcagaaaccagggaaaagttcctaagctcctgatactctgcttgcatccactttgcgatcaggggtcccatcctcggttcagcggctagtgagtctgggacaggactttcgactctcaccatcagcagcccttcagcctagaagatgttacgactaattttacttaacttgtaactaaaagttntaaacagttcgaccccgttcgggtaccgttcgggccgtaacggggacccgaacggggtaacggtaaacgtacgaaaacgtaacttggtacggtaccgg

SEQ ID NO: 47636 - DNA, 585 bp, Homo sapiens
  misc_feature: GYAE6OF01AQM4T.23.75.G09.1.454.CMB.1.raw
  modified_base (219)..(219): a, c, t, g, unknown or other
  misc_feature (219)..(219): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggnagtcagggcataagcaattattagcctggtatcagcagaaaccagggaaagttcctaagctcctgatctctgctgcatccactttgcgatcgacgggtccatctcggttcagcggcagtggatcgtggacaggtatttcactcgtcactatacagccaggtccttacgacgtcctagaagtagtgttacgacttaaattttacgttaacgttagttaacgtaaaagttaactaaacgtacggttaccggtacccccgttacgggtaaccgggtttcccgggtacccggaacgggggttaacccggaaggggttaacgggtaaaacgtacccggtaaaaacggtaaccgttgggtacgggtacccgg

SEQ ID NO: 47637 - DNA, 536 bp, Homo sapiens
  misc_feature: GYAE6OF01EBJEI.23.75.G09.1.454.CMB.1.raw
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (448)..(448): a, c, t, g, unknown or other
  misc_feature (448)..(448): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttggccgggcgagtcagggcataagcaattattagcctggtatcagcaagaaaccagggaagttcctaagctcctgatctctgctgcactcctactttgcgatcgacgggtcccagttcgtcggttcagcggcaggtgattcgagggacagtactttcacttcncaccatcagcncgtcctcacgctagagtnttgttancttaatttattacgttagtaactaaaagttactaaacncggttacgccccgttacgggtaccgttcggacccggacggggtaccgtagggtaacggaaactacgaaaaccgtacgtggtggtaccg

SEQ ID NO: 47638 - DNA, 561 bp, Homo sapiens
  misc_feature: GYAE6OF01CUQEW.23.75.G09.1.454.CMB.1.raw
  modified_base (220)..(220): a, c, t, g, unknown or other
  misc_feature (220)..(220): n is a, c, g, or t
  modified_base (255)..(255): a, c, t, g, unknown or other
  misc_feature (255)..(255): n is a, c, g, or t
  modified_base (554)..(554): a, c, t, g, unknown or other
  misc_feature (554)..(554): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttggccgggnacgtcagggacataagctaattattagcctggtancagacaacgaaaaccgaggtaaagttcctaagctcctgtactctctgctgctactctactttggcgtactcggacggggtaccctagtccgttcggttcaacggcggcgtagtggagtcgtagggactagtacttcactctacgaccatcagctagccttgacgctagaagtagtcgtatactaatttacttaacacgtaacaaaggttactaacgtacgtaccgtacccgtacggtacggttccggaccgtacggggacccgtaagggtaacggtaaacgtacgaaaaccgtagtagnggtaccg

SEQ ID NO: 47639 - DNA, 707 bp, Homo sapiens
  misc_feature: GYAE6OF01BGJ3Z.23.75.G09.1.454.CMB.1.raw
  modified_base (194)..(194): a, c, t, g, unknown or other
  misc_feature (194)..(194): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagacgtcaccatcacgttggccgggcgagtcgagggcaagtaagactaatttagttacgccgttaggtactcgagacaacggaaaccgaaggggtaaacttaccgtaacggcctccgtagtactcgtcgtgtctagacctactccctacgtttcggacgtacgtcggtaccgggtaccctagttccgtccggttacgacggccggtacgtaggtcggaacttcggtacgggactagtacgtttccacttctaccaactacgtacacgtcctaacgtcccgttacgaccgtacgttaggaaacgttagttacggttacgtaacctttaaattttaaccgttaacgttaacgttaaaccgtaaaagttaacctaaaccggttacgttccccggtaacccgttccgggtaaccggttaccgggaacccggggtaacggggaaccggtaaacggggttaacggtaaaaaccgttaaccggaaaaaccggtaaccggttgggtaccggttacccgg

SEQ ID NO: 47640 - DNA, 622 bp, Homo sapiens
  misc_feature: GYAE6OF01CS3XT.23.75.G09.1.454.CMB.1.raw
  modified_base (219)..(219): a, c, t, g, unknown or other
  misc_feature (219)..(219): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggngagtcagggcataagcaattatttagcctggtatcagcaagaaaccgaagggtaaacgttacctaagctcctagatctctgctgcactcctactttgcgtactcgtacggggtccctacgttcgtccggtttcgacggtcgggccgtaaggttcgggagttcggtaggggtaacgtaggtaacttttaccgaacttcccttaccaacctacgtaccagtacctacgtccctttcgaacggttccctagtaacggtattacgttacgtaacttaattttattaacgttagtaactaaagttaactaaacgtacggtcgtaccccgtacgggtaccggttccgggaccggaaggggaccgtaaggggtacgtaaacgtaacgaaacggtaacgtggtcggtaccg

SEQ ID NO: 47641 - DNA, 636 bp, Homo sapiens
  misc_feature: GYAE6OF01CH8EK.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagacgtcaccatcacgttggccgggcgagtcgagggcataagactaatttatttagcctggtactcagcaagaaaccgaggaaagttcctaagctcgtagtactctctgctgctactcctactttcgcgtagtccgtacggggtccctagttccgtcggttacgacggcggacgaggtgggtacttcggtagggaactaggtactttacctaccttctaccgaacctagtaccgacgtcctaacgtcccttacgacgtcctagaagttgttggttacgtactttaaagttttacttaacgttagtaaactaaagttaactaaccgtacggtacccgttacccggtaccgggtaccggtttaccgggaccggtaacgggggtaaccggtaacggggttaacggtaaacggtaacgtaaaacggtaccgttgggtcggtacg

SEQ ID NO: 47642 - DNA, 718 bp, Homo sapiens
  misc_feature: GYAE6OF01CFT38.23.75.G09.1.454.CMB.1.raw
  modified_base (226)..(226): a, c, t, g, unknown or other
  misc_feature (226)..(226): n is a, c, g, or t
tcagacgcgagtatcacgaccggtgctcgatttagtatagacatcaggggggcagaagtctctctcagtcaggacacagcatggacatgagggtccctgctcagctccgtgggactcctgctgctctggctcccagataccagatgtgacatccagatcgacccagtctccactcctccctgtctgcatctgtaggagacagagtcaccatcacgttcggccgggngagtcgagggcaagtaacgactaaatttagttacgccgttaggtatcaagacgaaacggaaaccggagggttaaaacgttccgaacgtccttccgtatacgttcctacgtcgtactgacctacttccttacgtttacgacctaacgttcggaaccgggttccctagttccggttcggttacgacgggccggtacgtagggttcggacgttccgggtacgggaactagtttacgtttacccacttaccgtaccaacctagtacacggtcctacgtcccttacgacggtccgtaggtaacgttagtttcgttaacgttaactttaaacgttttacttaaccgtaacgttaaacttaaacgttaacttaaaccgtccggtacccgttacccccgggttaacggtccggttacccgggaacggtccgggggaaaccggttaggggtaaaccgggtaaactaaccgggtaaacgttacggttagggtcgggtaaccg

SEQ ID NO: 47643 - DNA, 683 bp, Homo sapiens
  misc_feature: GYAE6OF01CNA39.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgaccagtctccatcctccctgtctgcatctgtaggagacagagtcacatcacgttcggccgggcgagtcgagggcaataacgctaattatttacgccttggtactcgagacaaggaaaccgagggtaaacgttcctaagtcctacctgactctcgtcgctcgactacgtactacgtttgacgtactacggacgggttcccagttccgtccggttacgacggtcggactacggtcggaattccgggaagggtaaccagtttaacgtttaccacgtcctaccgaactataccgaaggtcctaacggtacccctttacgacgttacccgtaggtaaacgtatttacgggttactaaccgtttaaattttttaccgttaacgttaaagttaaactaaaacggttaactaaccgtaacgggtcccgtaccccggttaccgggtaaaccggttccgggaacccggtaggggaacccggttaagggtaaacggtaaccgtaaaccgaaaccgggtaactggggttaacgtccgg

SEQ ID NO: 47644 - DNA, 648 bp, Homo sapiens
  misc_feature: GYAE6OF01CLEWB.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtccaccatcacgttcggccgggcgagtcgagggacaagtaagactaatttagtttacgcctaggttactcagacaacggaaaaccgaagggtaaaacgttcctaaagcctaccgtgactctctgtctcgctactctacgtttcgcgtagtcgacggggtaccctagttccgttcgttacgacgcggcgtaggtgggatcgtacgggactagtactttcaccgttcctacaccatccgagcctacgtccctacaccgtaccgtaggaacgtagttcgttaacgtacttaaacttttacgttaacgtttacgttaaacgtaaagttaactaaaccgtacggttaccggtacccccgttacggggtacccgttccggggaacccggtagggggaacccgtaaggggttacggaaaacgttaccgaaaacggtaaccgtgggtcggtaccgg

SEQ ID NO: 47645 - DNA, 642 bp, Homo sapiens
  misc_feature: GYAE6OF01BNTMS.23.75.G09.1.454.CMB.1.raw
  modified_base (193)..(193): a, c, t, g, unknown or other
  misc_feature (193)..(193): n is a, c, g, or t
  modified_base (475)..(475): a, c, t, g, unknown or other
  misc_feature (475)..(475): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctcctgtctgcatctgtagganacagagtacaccatcacttggccgggcgagtcgagggcaagtaagactaattattacgccgtggtatcgagtacgaacgaaaccgagggtaaacttaccgtaacgtcctacctagtactctactcgctacgactacttcctaacgtttcgacgtacgtccggtacgggtaccctacgtccgttacggttcacggcggtacgtaggtacggattcgtagggactacgtactttcgaactctaccacacttacgacgctacgtccttacgacgcgtagaacgtnttcgttactactaattttacgtaccgtagttaaaccgtaaagttacctaacgtacggttccgtaaccccggtgggtaacccggttaccgggacggtaaaccgggggtacgttaagggtaaccgggtaaaactaacccgaaaacggtacggttacgggtcggtaaccg

SEQ ID NO: 47646 - DNA, 370 bp, Homo sapiens
  misc_feature: GYAE6OF01DP6P3.23.75.G09.1.454.CMB.1.raw
  modified_base (136)..(136): a, c, t, g, unknown or other
  misc_feature (136)..(136): n is a, c, g, or t
  modified_base (139)..(139): a, c, t, g, unknown or other
  misc_feature (139)..(139): n is a, c, g, or t
  modified_base (141)..(141): a, c, t, g, unknown or other
  misc_feature (141)..(141): n is a, c, g, or t
  modified_base (143)..(143): a, c, t, g, unknown or other
  misc_feature (143)..(143): n is a, c, g, or t
  modified_base (181)..(181): a, c, t, g, unknown or other
  misc_feature (181)..(181): n is a, c, g, or t
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (332)..(332): a, c, t, g, unknown or other
  misc_feature (332)..(332): n is a, c, g, or t
  modified_base (334)..(370): a, c, t, g, unknown or other
  misc_feature (334)..(370): n is a, c, g, or t
tcagacgcgagtatcacgaccggtgctcgatttagtatagacatcagggtcaccctgaccagggacacgtccatcaccacagcctacatgggagctggaggggcggtcgaggactacgcgacgactacggcttatntgngngngaggaggtacattcagtcccgtccctcccttgactcgngggcagggaacctggtccacgtctcctcggacctcacgaaggccntccgtctccccgngccncctcncgaancgcacctgagggcangcgtcnggcngctggacagctactccatacctcgcttcgngacggcgggcnggacagctanagngnnnnnnnnnnnnnnnnnnnnnnnnnnnnnnnnnnnnn

SEQ ID NO: 47647 - DNA, 694 bp, Homo sapiens
  misc_feature: GYAE6OF01AGM61.23.75.G09.1.454.CMB.1.raw
tcagacgcgagtatcacgaccggtgctcgatttagtatagacatcagggggcagaagtctctctcagtcaggacacagcatggacatgagggtccctgctcagctccgtgggactcctgctgctctggcctcccagactaccagtatgtgacatccgagatcgaccctagtcctccactccctcctgtctgctagtcgtggtacgggacaccactacgtaccacctactctaccggttcggaccggactaacgtacaagtaactaagttacaaaccttaaactttaatttaaaggttcggtactaccggaaccgtaacgggaaccccggaaaccccgggtaaccctcccccttacgaacccttccgtagtaccttactagtccgtcgtaccgtccgttaaccttaacgttaacggaaccggttccggtaccctagttccgtaacggttcgagggtcggtacgtagcgtacgggacgtacgtacgtcgttaccaccgtctacacgtatacgtcggactcgtcgacgtacctacggtactaggtactttctaactacttaactacgtctacgtaacctcttaccgtttacccttacccgagtaccggtacggaccgaacgggtacggtaaccacggttaacgacctacgtaacgacgttacggcgaccgtactaccgaaccttcttctcggttacc

SEQ ID NO: 47648 - DNA, 721 bp, Homo sapiens
  misc_feature: GYAE6OF01EQY9F.23.75.G09.1.454.CMB.1.raw
  modified_base (206)..(206): a, c, t, g, unknown or other
  misc_feature (206)..(206): n is a, c, g, or t
tcagacgcgagtatcacgaccggtgctcgatttagtatagacatcagggggcagaagtctctctcagtcaggacacagcatggacatgagggtccctgctcagctccgtggactcctgctgctctggctcccagactaccagatgtgacatccagatcgaccctagtcctccactccctccctgtcctgctatcgtagtaggaganagactaccaccgatctacgttcggaccgggctacggtacgacggtacaagtaagactaatttattacgctaggtactcgagaacgaacgaacgtaagggtaacttaccgaactcgtacctgtactcttacgtcgactcgtaccacttacccgtatttacggacgtacgtaccgggtaaccgggttacctcgttaccggttaccgggttacacgggtaccggtagtaacgggttaggttaacggttaccggtacgggtaacttaacggttactttaccgtaccgtttactaccccgactaacggttaccaacgggtctaaccggtaccctttacgacgttacaacggtaagtcgttaagttactaacgtttaatttaccgttacttaaacgtaacgttaaacgtaacggtactaccggttacccggtaccgttaccggtacgggtacccggacggaaacgggtaccggttaaagggaaacgtaaaccgtaacgaaccggttacgtagggccgtagg

SEQ ID NO: 47649 - DNA, 794 bp, Homo sapiens
  misc_feature: GYAE6OF01A9DYC.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggcctcccagactaccagatgtgacactccagatcgaccctagtcctcctactccctccctgtctcgacactcgtgtaggagacagactcaccatcacgttcggccgggcgagtcgaggactaagtaacgacttaattagtttacgccgttaggtactacgacgacgaaacggaaaccggtaagggttaaacgttacctaacgtccgttactagtacttacctcgacgtctcgacctacctcctagttcgactacggtacggtcccggtacctacgtttccggtcggtccgagggtccgtaggtacgtggtacgtgtacggacgtacgttacgtacctaccttcctacctaccgtactaccgactacccggtacctccgtaccgtaccgacggttaataaccgggtagttttacggttacgttaaccgttttaaccgtttaacgtttaacggttaaacgttaaaccgtttaaaacgggttaaccgttaacccgttaccgggtaccccgttttaacccccgggttaaaccgggtttccccggggttaaacccgggggaccccggggttaaacgggggtaaacccccgggtttaaacgggggtaaaccgtaaaaacccggttaaccggtaaaacccggggtttcggttacccgggtaaaccgggttcccgg

SEQ ID NO: 47650 - DNA, 740 bp, Homo sapiens
  misc_feature: GYAE6OF01DHO97.23.75.G09.1.454.CMB.1.raw
  modified_base (546)..(546): a, c, t, g, unknown or other
  misc_feature (546)..(546): n is a, c, g, or t
tcagacgcgagtatcacgaccggtgctcgatttagtatagacatcagggggcagaagtctctctcagtcaggacacagcatggacatgagggtccctgctcagctccgtgggactcctgctgctctggctcccagactaccagatgtgacatccgagatcgaccagtcctccatccctcctgtctcgcatcgtaggaggaacacgagtacgtccaacctacgtcctaccgttcgggcccggggataccggaggaacggactaaagtaacgcttaaagttttacgtttacgtaccgttaggttaacacgaacgtacgaaacggtaaaaccggtaacgggttaaaccgttccgttaagccgttacccgttagtaactccgttagtccgacgttcgacctaacgttcctacggtttcgaacgtacgttacccggggtaaccggttcccactttccgggtaccggttacgaccgggtacgggtaccgtaagggtccgtagtaccgggttacggaaccgttcgttaaccttccgaacttcaccgtaactanacgactcgtaccgtcctgacgtacgtagttaacgtgtttacctagttaactttaacgtttagtaccttaagtaaacgttaatacgtaaacggtccgtacccgttacggacccgggtaccgtaccggggtacggaacgggtacccggtagggtaaacctaaccggttaaacacgggttaactgggtccggtaacg

SEQ ID NO: 47651 - DNA, 768 bp, Homo sapiens
  misc_feature: GYAE6OF01APGLL.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggcttcccagataccagtaatgtgacatccaagatcgaccctagtctccatcctcctagtctgtcatcctggtaacggaggaccaggtacgtcacctaactctaccgttgcccggggctaacggttccgaaggggacctaattaaacggctaaaatttacgtttaacggccttgggtaactccgaaggtaccgaaacggaaaaccgtagggggtaaaacctttacccgtaaaagggtcctttacccgtaggtaacttcccgttacgttacggtccgtttacggaccgttaacttaccccgttaaacggtttttcgacccggttaaacgttcccgggaaccgggggttaccctaacgtttccggttccggtttaaccgggaacgtccgggtacctagggttacgggtacttacggttacggggaactaacggtacttttccgaacttcctaaccgacctagtacgtaacgacgtacgaccctttagaccgtaccctaggaacgtacgttgtacgtactaagtttacttacttagtaacctaaagtacacgtacgtaccggtacccgtcgggtaccgttacggccggtaagggtacccggtaaggaacggtaaacgtacccgtaaagtacgtcgggtagtaccgg

SEQ ID NO: 47652 - DNA, 667 bp, Homo sapiens
  misc_feature: GYAE6OF01CU7TJ.23.75.G09.1.454.CMB.1.raw
  modified_base (204)..(204): a, c, t, g, unknown or other
  misc_feature (204)..(204): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
tcagacgcgagtatcacgaccggtgctcgatttagtatagacatcagggggcagaagtctctctcagtcaggacacagcatggacatgagggtccctgctcagctccgtgggactcctgctgctcgtggcctcccagactaccagtatgtgacactccagatcgacccagtcctccactccctcctgtctgcatctagaggacnagtagtccaccatacgacgtcggacggcgcgtacgacggcaataacgataacttagttacgtcgttaggtactacgacgtacgaaagaaaccggtaggtaacttaccgtaacgtcctaccgtgtactcgtactgtaccgtacacctccttacgtcgttcgaccgtacgtcggaccggtaccncgtcggtccggtacnggacgtgtagnggtacgtcggtaacggtactagttacttaccaaccgttccctaaccgtaaccgttaactacggttaccgtaaccgttcccgttacgtaaccggttacgtaagtacggttaagttccgttaagttactttaacgtttacgtacgttagtaaagtaacgtcgtaaccgtaccgtcccgtacccgggtcgtaaccggtaccgggagacgggtacgacggttaacgacgtaacggtaacgtggtacgtgtccgtaaccg

SEQ ID NO: 47653 - DNA, 744 bp, Homo sapiens
  misc_feature: GYAE6OF01B8G2R.23.75.G09.1.454.CMB.1.raw
  modified_base (148)..(148): a, c, t, g, unknown or other
  misc_feature (148)..(148): n is a, c, g, or t
  modified_base (203)..(203): a, c, t, g, unknown or other
  misc_feature (203)..(203): n is a, c, g, or t
tcagacgcgagtatcacgaccggtgctcgatttagtatagacatcagggggcagaagtctctctcagtcaggacacagcatggacatgagggtccctgctcagctccgtgggactcctgctgctctggcctcccagataccagatgtnacatccagatcgacccagtcctcactccctcctgtcctgctagtctaggtagganacagactccactatctacgtcggcggcgacgtcgaggactaagtaacgtactaattacgttagtccggttaaggttactacgaaggtaccgaaaacggtaaaacccggtaaggggttaaacgttacccgtaaagtcccgttacgtacgtaacttcctacgtcgacgttcgaaccgtacttaccgttaccgtttggacgtaaccgttaccgggacccggggttaccctacgtttcccgggttacggttaccggtaccgggacggtaagttcggggtaacggtacgttacgggttacgggtaacttacggttaacctttacctaccctttaccgtaccctaacgtacggtacgtaacgtcccgtaacccgttcccggtaactaccgtaaccgtaggtaaccgttgttacggttaacttacgttaacgttttaactacgttaacgtaaacgtaagttactaacggtacgtcccgtaccggtaccggtcgtacggacgggtacggacggtaggtaacgtaacgacggaaagtcgtcggtgtaccg

SEQ ID NO: 47654 - DNA, 833 bp, Homo sapiens
  misc_feature: GYAE6OF01A3PJV.23.75.G09.1.454.CMB.1.raw
  modified_base (151)..(151): a, c, t, g, unknown or other
  misc_feature (151)..(151): n is a, c, g, or t
  modified_base (242)..(242): a, c, t, g, unknown or other
  misc_feature (242)..(242): n is a, c, g, or t
  modified_base (314)..(314): a, c, t, g, unknown or other
  misc_feature (314)..(314): n is a, c, g, or t
tcagacgcgagtatcacgaccggtgctcgatttagtatagacatcagggggcagaagtctctctcagtcaggacacagcatggacagtgagggtccctgctcagctccgtgggactcctgctgctcgtgcctaccagactaccagatggtnactactcgagtactcgacccagtcctcctaccgtccctcccttgtcgtacgactactcgttaggaacggagtaacaggtacctaccacctntccgtcgtcgggcgggctacggcgaggacctaaagtagtacttaagttacggttacgtaccgttaggttacncgtaacgtaaccggaaacggttaaaccgggtaaaaagggtttaaccgtttacccgaaccggttccgttaaccgtgtttaaccccgttgttacggtccggtaaacctttcccgaccttaaccggtttccgttaacgttcggtaccgttaaccggtccggggtacccgttactcggttccggtttaccggccggtacgggtcggtacgtagggggttacctaacgggttcggtaaggtaccgttaaaccgtttccttacccgtaccgttaccccgttacctaaacctccgttaacgccgtaacccttgggtacccctttacgacgttaccggtaaaggttccgttaagtttcgtactttaaacgttttaagtttacccgtaagttaaacgaaatttacgaaaccggttaccttcgggtaccccgttaccgggcccgtttaacgggacccgggttacggtaaaccgggtacgtaacgggtaaactaaccgtaacccgggtaagtccgttacggtaggtcccg

SEQ ID NO: 47655 - DNA, 502 bp, Homo sapiens
  misc_feature: GYAE6OF02HN1HG.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcataagcaattatttagcctggtatcagcagaaaccagggaaagttcctaagctctgatctctgctgcatcctactttgcgatcaggggtcccatctcggttcagcgcagtggatcgtgggactagatttcactctcgaccatcagcagtccttcacgcctagaagtatgttgactaatttattacttgtacaaaagtataacagtcgccctcggtacgttcggaccgacgggaccgagggtacggaacgtacgaaacggaacgtggtagtacg

SEQ ID NO: 47656 - DNA, 499 bp, Homo sapiens
  misc_feature: GYAE6OF02IVS5Z.23.75.G09.1.454.CMB.1.raw
  modified_base (218)..(218): a, c, t, g, unknown or other
  misc_feature (218)..(218): n is a, c, g, or t
  modified_base (424)..(424): a, c, t, g, unknown or other
  misc_feature (424)..(424): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctcctgtctgcatctgtaggagacagagtcaccatcacttgccgggngagtcagggcataagcaattatttagcctggtatcagcagaaaccagggaaagttcctaagctcctgatctctgctgcatccactttgcatcaggggtccatctcgttcagcggcagtgatctgggacagatttcactctcaccatcagcagccttcagccctgaagatgttgctaatttattactagtactaaaagttaactaanacgtgcccctacgggtacgttcggaccgtacgggaccgagggtaggaactacgaacggtaactcggtaggtaccg

SEQ ID NO: 47657 - DNA, 488 bp, Homo sapiens
  misc_feature: GYAE6OF02HYTK4.23.75.G09.1.454.CMB.1.raw
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcataagcaattattagcctggtatcagcagaaaccaggaaagttcctaagctcctgatctctgctgcatccactttgcgatcagggtcccatcgtcggttcagcgcgagtggatcgtgggacnggtatttcactctcaccatcagcagccttcacnctgaagatgttgactaatttatactagtacaaaagtaatatagtcgccctaggacgttcgacgacgggacacggtaggaactacgaaacggtaactgtaggtac

SEQ ID NO: 47658 - DNA, 512 bp, Homo sapiens
  misc_feature: GYAE6OF02HT1UV.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcataagcaattattagcctggtatcagcagaaaccagggaaagttcctaagctcctgatctctgctgcatccactttgcgatcgacggggtcccatctcggttcagcggcaggtggatcgtgggacagtatttcactctcaccatcagcacgccttcagcctagaagtatgttgactaatttacttactagttaacaaaatataacagtcgtccctacggtacgttccggaccgaggggtaccgagggtacggaaacgtaccgaaacgaacgtcgtaggtaccg

SEQ ID NO: 47659 - DNA, 593 bp, Homo sapiens
  misc_feature: GYAE6OF02HH75C.23.75.G09.1.454.CMB.1.raw
  modified_base (219)..(219): a, c, t, g, unknown or other
  misc_feature (219)..(219): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggngagtcagggcataagcaattatttagcctggtatcagcagaaaccagggaagttcctaagctcctgatctctgctgcactcctactttgccgtatcgacgggggtcccacgtcttcgggttcaggcggcaggtggagtcgtgggacagtactttcactctcaccatcacgcacgtccttcacgccgtagaagtacgttgttacgtacgttaattttaactttacgttagttaacgtaaaaagttaactaaacgtacggtaccgtaccccgttaccgggtaaccggtttacccgggaccggtaaaccggggaccggtaacggggttacggaaacgtaaccggtaaaaccggtaacggttacggttcggtaaccgg

SEQ ID NO: 47660 - DNA, 591 bp, Homo sapiens
  misc_feature: GYAE6OF02IAEF4.23.75.G09.1.454.CMB.1.raw
  modified_base (393)..(393): a, c, t, g, unknown or other
  misc_feature (393)..(393): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttggccgggcgagtcgagggcataagcaatttattagcctggtatcagcaagaaaccgagggtaaacgttcctaagctcctgactctctgctgcatccactttgcgtatcgacgggtcccagttcgtcggttcacgcggcagtggtatcgtagggactagtactttcactctacaccatcganctacgtccttcgacgcctagaacgtattgttacgtacttaagttttacttacgttagtaaactaaaacgttaacgtaacgtacgttaccgtaccccgttacgggtaaccggttaccgggacccgggtaacggggtaacccgtaaggggttaacggtaaacgttaaccgaaaaccgggtacgttagggtggttacccgg

SEQ ID NO: 47661 - DNA, 380 bp, Homo sapiens
  misc_feature: GYAE6OF02G06A4.23.75.G09.1.454.CMB.1.raw
  modified_base (356)..(380): a, c, t, g, unknown or other
  misc_feature (356)..(380): n is a, c, g, or t
tcagacgcgagtatcacgaccggtgctcgatttagtatagacatcagggtcaccctgaccagggacacgtccatcaccacagcctacatggagctgaggggcgtgaggatacgtgacgacaacggccgtttattattgtgcgagaggagggtacattcagccgtccccgtccccctttgactactggggccagggaaccctggtcaccgtctcctcggcctccaccaagggcccatcggtcttccccctggcaccctcctccaagacgcacctctgggggcacagcggccctgggctgcctggtcaaggactacttccatacctcgcgtctgagcggctgggcaaggcgcagtagnnnnnnnnnnnnnnnnnnnnnnnnn

SEQ ID NO: 47662 - DNA, 736 bp, Homo sapiens
  misc_feature: GYAE6OF02GZV6E.23.75.G09.1.454.CMB.1.raw
  modified_base (150)..(150): a, c, t, g, unknown or other
  misc_feature (150)..(150): n is a, c, g, or t
  modified_base (724)..(724): a, c, t, g, unknown or other
  misc_feature (724)..(724): n is a, c, g, or t
tcagacgcgagtatcacgaccggtgctcgatttagtatagacatcaggggcgagaagtctctctcagtcaggacacagcatggacatgagggtccctgctcagctcctgggactcctgctgctctggctcccagactaccagatgtgacntccagatcgaccctagtctccatccctcccttgtctgaaccattcgtgttaggagtacaggataccaaccatccacgtttcggcccggggacgaagtccggacgggacaattaacggactaaatttaacgttttaacgccgttaggttaactaccgacgtacaaacgaaaaccgtaaggggtaaaaccttcccgttaaaaggcccttacctaaggaacttcccttacgtgacccgtttgaccaagttacccctaagtttggaacccgaggttacgtacccgggggttaccccatttccccggtacgggtttcaaacgggtccggtacgttaaccggtgggtaacgtccgggtacggtaccgagttacgtttccgtacctcgttaaccacctaagtccacggtactacgtaccgttctaacgccctttaaggaaccgatttcgggttaactacgtttaaactttacgttaaccttaggaaaaccttaaagttaaagactaacgtcggtaccccgttacgtaacggaccgttcggaaccggggccttagggaacgttacgaacgaacggtaacccngggttacacggg

SEQ ID NO: 47663 - DNA, 545 bp, Homo sapiens
  misc_feature: GYAE6OF02H94VB.23.75.G09.1.454.CMB.1.raw
  modified_base (395)..(395): a, c, t, g, unknown or other
  misc_feature (395)..(395): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcataagcaattatttagcctggtatcagcagaaaccagggaaagttcctaagctcctgatctctgctgcatccactttgcgatcaggggtcccatctcggttcagcgcagtgatcgtgggacagatttcacttctcacatcagctacgccttcgagtccgtagaagntgttcgtactaattttatttactagttaacgaaaagttaacttaacgagtacgtaccccgttacggggtaccgtttccgggcccgtaacggggaaccgtacgggtaacgggtaaacgtacgtaaaccggtaacggttacggtggtaccgg

SEQ ID NO: 47664 - DNA, 541 bp, Homo sapiens
  misc_feature: GYAE6OF02G2H8B.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccggtgagtcagggcataagcaattatttagcctggtatcagcaagaaaccagggaaagttcctaagctcctgatctctgctgcatcctactttgcgatcgacgggtccatctcggttcagcgcagtgatcgtggacagtattcactctcacatcagcagccttcacgcctagatagttgttacgactaattttattactagttaactaaaagttaactaacgtacgtccgtaccccgttcgggtaccggttaccgggacccggtaacgggggaccgtaggggttaacggtaaacgtaaccgaaaccggaacgttggtacggtaccgg

SEQ ID NO: 47665 - DNA, 598 bp, Homo sapiens
  misc_feature: GYAE6OF02IL37J.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttggccgggcgagtcgaggggcaataagctaatttatttagcctggtatcagcagaaacgaggtaaagttcctaagctcctgatctctgctgctatcctactttgcgtatcgacggggttcccattctcggttcagcggactggtggactcgtgggacagtatttcactctcactatcagcacgtccttacgacgtcctaggaacgttattcggttataacttaagttttacttaacgttacgttaaacgtaaaagttactaaaccgtacggttccgtaccccgttacgggtaaccggtttcccgggaaccggtaacggggtacccgtaagggggttacggtaaacgttaaccggaaaaccggttaacgttcgggttacgtaacccgg

SEQ ID NO: 47666 - DNA, 546 bp, Homo sapiens
  misc_feature: GYAE6OF02HWVFH.23.75.G09.1.454.CMB.1.raw
  modified_base (388)..(388): a, c, t, g, unknown or other
  misc_feature (388)..(388): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagatcacatcacttgccggcgagtcagggcataaagcaattattagcctggtatcagcaagaaaccagggaaagttcctaagctcctgatctctgctgcactcctactttgcgatcgaggggtcccagtctcggttcagcggcagtggactcgtgggacagtatttcactctcactatcagctagtccttcngctagaagtattggtatactaattttatacttgttaactaaaagtacttaaacacgttaccgccccgtacgggtaccgtttaccgggcccggaacggggtaacccggtagggttaacgggaaacgttaccgaaaaccggaacgttagggtcggtaccg

SEQ ID NO: 47667 - DNA, 581 bp, Homo sapiens
  misc_feature: GYAE6OF02F91F1.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttcggccgggcgagtcgagggcataagacaatttatttagcctggtactcagacaagaaaccgaaggggtaaagttacctaagctcctagtactctctgctgcactcctactttgcgtatcgacggggtccagtctcggttcaggccggacgtaggtcggtacgtcgtagggactagtatttccgacttcctacacactcacgctacgccttcacgtcctagagtagtgttagtacttaatttacttacgttataaacgtaaaagttaactaacgtacgtacgtcccgtacgggtacccggttccggaccggtaacgggaccgtaacgggtacggtaaacgtaccgaaacggtacggtaggtacggtaccg

SEQ ID NO: 47668 - DNA, 793 bp, Homo sapiens
  misc_feature: GYAE6OF02JP963.23.75.G09.1.454.CMB.1.raw
  modified_base (393)..(393): a, c, t, g, unknown or other
  misc_feature (393)..(393): n is a, c, g, or t
  modified_base (653)..(653): a, c, t, g, unknown or other
  misc_feature (653)..(653): n is a, c, g, or t
tcagacgcgagtatcacgaccggtgctcgatttagtatagacatcaggggcgagaagtctctctcagtcaggacacagcatggacatgagggtccctggcctcagctccgtgggactcctgctcgctctggcctcccagactaccagatgtgacatccagatacgacccctagtcctaccatccccgtccttacgtcctagcacttcgtaggtaggagaccaggtagtcccaaccatcccttacgttccgggacccgggggctaacggtacggaccgggtacgacgtaacgacgtaaacgtttagtttaacgcgttacggtacttcgaacgtactaacggaaaaccggaagggtaaacgttaccgaaacggtcttaccgtagaacttccggtntacgcctcggtacaccgttaccgtactttcggaccgttacgttacgaccggggtccccttagtacccgtccggttacgaccggcggtacacgggttgggacttcgggtacgggacgttacgtacgtttaccgtaccttaccgtacttaacccaacgttcaaccgggtttaccaccggttaccgttaccaccggtacccgttacgtaaacggttgtttaaaccgttccggtaactttaaacgttttacgttaaccgtttanaaaaccgttaaattaaccgaacttaccggttacggttccccggacggtttaaccggtacggttaacccgggacggggttaaccggtaacgggttaaccgaacggtaaccgtaaaccggttaacggtccggtaaggttccg

SEQ ID NO: 47669 - DNA, 779 bp, Homo sapiens
  misc_feature: GYAE6OF02G16A4.23.75.G09.1.454.CMB.1.raw
  modified_base (146)..(146): a, c, t, g, unknown or other
  misc_feature (146)..(146): n is a, c, g, or t
  modified_base (226)..(226): a, c, t, g, unknown or other
  misc_feature (226)..(226): n is a, c, g, or t
  modified_base (398)..(398): a, c, t, g, unknown or other
  misc_feature (398)..(398): n is a, c, g, or t
tcagacgcgagtatcacgaccggtgctcgatttagtatagacatcaggggcagaagtctctctcagtcaggacacagcatgacatgagggtccctgctcagctccgtgggactcctgctgctctggcctcccagactaccagagtntggacatccagatcgacccagtcctacactccctcccgtgtctagctaatctaggtaagacgacaggtacgtccaaaccnttaccacgttcgggacccggggcgtaagccggtagggccgaataacggactaatttagttaccgtccgtaggtactacgacgagaacggtaaaccgtaacgggtaaacgttacccgttaagaccgttaccgtactacgtacctcgtcgcgtctacgaacttcctacgtttanaccgtacgtaccgtacggggtccctagttcccgtcggttcgaacggtcggtcgtacggtgggtaccgtcggtacgggaccgtaggtacttacccgacgttacctcccgtacgacctaggtactacgttaccgacctttacgaaccggtaccgttacggaactacggtttacgttaacgtccgtttaaactttttacgaacttttacggaaaccgtttaaaagtaaaccctttaaacgtaaccggttcccggtaacccggtttacccggtaaccgggtaacccgggtttaccggtaacccggggtaacccgggtaaccgggttaccggaaaaccggggttaacctaaacggggtaaccctttaacggggacgttaacccggg

SEQ ID NO: 47670 - DNA, 675 bp, Homo sapiens
  misc_feature: GYAE6OF02FWXQ6.23.75.G09.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtcctaccatccctccctgtctgcatctggtagganacagagtccaccatccacgtcgccgggngagtcgagggcaataagcaattattagctggtatcagacagaaaccgagggaacttccaagctctgntctntgctcgcactacctagttcgacgtatccggacgggtccctagttccgtcggttcacggtcggaccgtaggttacggacgttcggtagggtaactaggttaactttcccgaacttccgttacctaaccctgtaccctacggtaccgtaaccgttcccgttacgaccggacccgttaaggtaaacgttcgttacggttacgtaacgtttaaagtttttacttaaccgttagttaaaacgttaaaacgttaacgttaaacgtaccggttaccgcccgttacccggggttacggttacccgggtaaccggtacggggtaaccggtacgggtaaacggtaacgttaacccggaaaaccggttcggtacgggtcggttaacccg

SEQ ID NO: 47671 - DNA, 556 bp, Homo sapiens
  misc_feature: GYAE6OF02GDNNE.23.75.G09.1.454.CMB.1.raw
  modified_base (390)..(390): a, c, t, g, unknown or other
  misc_feature (390)..(390): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaaccatccacttggcccgggcagtcgagggcataagctaatttatttagcctggtatcagacaagaaaacgagggtaaattacctaagtctcctgtactctctgctgcactcctacgtttcgcgatcgacgggtccatcgtcgttagcgcgcgaggtcgagtcgtaggactagtcttcactctacacnctcgatcacgtcctcgacgtcctagaagtatcgttagtacttaacgtttattacgttaagtaaactaaaagttactaacgtcgtaccgtcccgtacgggtaccggttccggaccggaacggggtaccgaagggtaacggtaacaacggaacgtacgttgacgtacg

SEQ ID NO: 47672 - DNA, 403 bp, Homo sapiens
  misc_feature: GYAE6OF02IJ56O.23.75.G09.1.454.CMB.1.raw
  modified_base (365)..(365): a, c, t, g, unknown or other
  misc_feature (365)..(365): n is a, c, g, or t
  modified_base (382)..(403): a, c, t, g, unknown or other
  misc_feature (382)..(403): n is a, c, g, or t
tcagacgcgagtatcacgaccggtgctcgatttagtatagacatcagggtcaccctgaccagggacacgtccatcaccacagcctacatggagctggaggggcgtgaggatcgtgacgacacggccgtttattattgtgcgagaggagggtacattcagcccgtcccccggtccccctttgactacgtgggccacgggaccctggtcaccgtctcctcggcctcaccgaacgggcccatcggtccttcccccgtggcctacccctcctaccaagacgcctacctcggtcgggggcacgacggccggccctggggccttgccgttggacaacggctacttccatcgtcgcgtcgtgacggcggtcngggacaggcgcaagcgnnnnnnnnnnnnnnnnnnnnnn

SEQ ID NO: 47673 - DNA, 616 bp, Homo sapiens
  misc_feature: GYAE6OF02IM2V1.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatcctccctgtctgcatctgtagagacagagtcacatcacttggccggcgagtcagggcataagctaattattacgtcctaggtactcagtacagaaccgaggtaaacgttccgtaagctccgtgactctctgctgactatcctacgtttcgcgtactcgtacggggtccctagttcgtcggttcgagtccggacgaggtcggacgttacggtgggtacgtacgtacttacgtactctactacctataccgagtcctacgtccttacgacgtaccgtagaacgtagtacgttagtacgttaatttacgttacgttacgttaactaaagtaactaacgggggtactaccgtacccggtaccggtaaccggttaccggtaccgggtaacgggtaaccggtaacgggtacggtaaacgtaaccgtaaacggtaacgttacggtagtaccgg

SEQ ID NO: 47674 - DNA, 688 bp, Homo sapiens
  misc_feature: GYAE6OF02GKASQ.23.75.G09.1.454.CMB.1.raw
  modified_base (200)..(200): a, c, t, g, unknown or other
  misc_feature (200)..(200): n is a, c, g, or t
  modified_base (680)..(680): a, c, t, g, unknown or other
  misc_feature (680)..(680): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggcctcccagataccagatgtgacatccagatgacccagtctccactcctccctgtctgactactctagtagganactagagtccacatccagttcggccgggctagtcgacgggacaagtaagactaagtttatttacggccgtaggtactacacgacaacggaaaaccggtaagggtaaacggttacctaacggtccttaccgtaggtacttctcgtcggtctgctacgttcctactttcggctacgtacggtaccgggtccctacgttccgtcgtaccgacgggtcgcggtaggtcgtactcgggagtaacggtacttacttaccgtaccttcctactaaccctagttaccgacgacttaccgtcccgttaccgacgtcgtaaaccggtagttagtcttacgtaagttttaactttagttaaccttaacgttaaacgttaaaactaacgtaacgtaccgtcccggttacccgtacgggtaaccggtccgggtaaccggtacgggttaccggtagggtaactaaccggtaaaccgaacggtacggttaccggntaacccgg

SEQ ID NO: 47675 - DNA, 611 bp, Homo sapiens
  misc_feature: GYAE6OF02GIIRP.23.75.G09.1.454.CMB.1.raw
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
  modified_base (276)..(276): a, c, t, g, unknown or other
  misc_feature (276)..(276): n is a, c, g, or t
  modified_base (373)..(373): a, c, t, g, unknown or other
  misc_feature (373)..(373): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggcctcccagataccagatgtgacatccagatgaccccagtctacccatccctccctgtctgcatctagtagganacagagtcaaccatcacgttggccgggagagtcgagggacanaaagactaaattattttagcctaggtatacaganaacgaaacgaagggaaattaccgtaagcctcctgtatctctagctgacactcctactttgacgatcgacggggtaccattcgtcgttacgaggcggngtaggtaggtagtcggtacggaactagtatttaccgtactacctaccacctataccgagtaccacgtccttcgacgctagaacgtatgtactattaatttagttaactagtaacctaaaagttactaaactgttacccgacccgttacggtaacgggttccggaaccggttaaccggggacggtaacgggttaagggaaacgtaacggtaaacccggtaagtaccggtaaggtaccgg

SEQ ID NO: 47676 - DNA, 740 bp, Homo sapiens
  misc_feature: GYAE6OF02GQ2WE.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatgacccagtctccatccctccctgtctgcatctgtaggacacagacgtccaccatcacttcggccggtcgagtcgagggacataagctaaatttatttacgccttaggtactcgagacaacggtaaaccgaaggggtaaactttccgaaacgtccttaccgtagtacttccgtctagtcctgactacttccgtacgtttcgacgtactaccggtaccgggttacccacgttccgtccggttacacgggtccgtacgtagggtcggtaacgttccggtaggggtaactacggtttacttttaccgaacccgttaccttacccacccgtaacgtaccgaacgtaccgttaccggttccccttaacgaccgtccgttaagtaaagttacgtttaggttaacgtttaactttaaagtttttaccgttacgtttaaagttaaaacctaaacgttaaactaaccgttaccgggttacccgttaccccgggttacggttaaccgggttacccgggaccgggtaaccggggtaacgtaacggggttaacggtaaacctaaccgggtaacccgtaggtaccgggttacgtaccg

SEQ ID NO: 47677 - DNA, 739 bp, Homo sapiens
  misc_feature: GYAE6OF02HT9TL.23.75.G09.1.454.CMB.1.raw
  modified_base (528)..(528): a, c, t, g, unknown or other
  misc_feature (528)..(528): n is a, c, g, or t
tcagacgcgagtatcacgaccggtgctcgatttagtatagacatcagggggcagaagtctctctcagtcaggacacagcatggacatgagggtcccctgctcagcctccgtgggacctccgtgtctgctcgtcggtcctcccagactaccgagtatgtacgactactaccgagactccgacctacgtcctacctacctcccgtcccttgtctgctactcgtaggtaggacgtacgagtctacaaccgtactcgtacggtccgggacgggtcgacgtacgacggactaagtaacgaattaatttacgtacgccgttagtacctagacgtaacgaacggtaaacgaaggtaaccgtacgtacgtctactcgtactcgtactcgtactacgtactactcccttagtaccgtacgtcgtaccggtaccggtacctcggttccggtcggtacgaccggtcggtacggtacggtacgtcggtacgttacggtaccttacgttacttcgtacctaccgtacaacgtaccgtaacncgtaccgaccgttacgtacgtacgtacgtagtacgtacgttaactacgttaattaacggttactaacgttaacgtaaactacgtaacgttacgtccggttacccgtacggttaccgggtacccggttaaccgggtacgggtaacggtaaccgggttaaacgggacggtaaacggttaacgggaacccggttagggtaccggtacggtaccg

SEQ ID NO: 47678 - DNA, 702 bp, Homo sapiens
  misc_feature: GYAE6OF02GY352.23.75.G09.1.454.CMB.1.raw
  modified_base (224)..(224): a, c, t, g, unknown or other
  misc_feature (224)..(224): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggcctcccagataccagatgtgacatccagatcgacccagtctccatccctccctgtctgcatctgtagagacagagtcaccatcacgttcggccgggngtacgtcgagggaccaataacgactaaatttagtttacgcgttaggtactacgacgacgtaaacggaaaccggaaggggttaaaactttaccccgtaaaacggtcccttaaccgtacgtaactttcccgtcgttacgtaccgtcgtaccctaccttcccgtacgtttccggaccgttaacgtccgggtaccggggttaccctacgtttcccgttacggttaccgcggttaccggacgtacgggtcgtacgtacggtcggaactaacgttactttccgaccttcgtaccaactacgtacacgacgtaccgttccttacgacgttaccgtagtacgttagttcgtacgttactttaagttttaccttagtattaaacgtaaacttacgaacgttacgtacccgaccggtaccggtcggtacggaccggaagggtaaccgtagggtaacacggtaaccgtaaaccgtcgtacgtcggtacg

SEQ ID NO: 47679 - DNA, 730 bp, Homo sapiens
  misc_feature: GYAE6OF02I4UZB.23.75.G09.1.454.CMB.1.raw
tcagacgcgagtatcacgaccggtgctcgatttagtatagacatcagggggcagaagtctctctcagtcaggacacagcatggacatgagggtccctgctcagctcctgggactcctgctgctctggctcccagataccagatgtgacatccagatcgacccagtctccatccctcctgtctcgcattctggtaggacgacgagactaccaccgatcctacgttcgggccgggacgagtacgtacggggacctaagtaagactaatttacgtttacgtccgtaggttataccgtagacctaaacggaaaccgaaggggtaaacgttaccgtaagtaccttccgtaggacttacgtcgtacgcgtcgactaccgtacctacgtttcgacgtacgtacgacgggtccctagttccgtccggttacgacggtccggacgttacggtacgggtacgtcggtacgggaactacggttacttacctcgttacctccgtaacctacgtccgaacctcgacgtacccttccgaacgtccgtaagaaacggttactaacgggtttacgtactttaagtttaacgtttacgtaaccgtttaaagttaaattaaaccgtaacttaccggtaccgtccccggttaacgggtacccgggttaaccggtacccgggacgggttaccggtagggttaaaccggtaacggtaaaccggtaaacggacggttaggtcgggtaacccg

SEQ ID NO: 47680 - DNA, 774 bp, Homo sapiens
  misc_feature: GYAE6OF02G65ID.23.75.G09.1.454.CMB.1.raw
  modified_base (654)..(654): a, c, t, g, unknown or other
  misc_feature (654)..(654): n is a, c, g, or t
tcagacgcgagtatcacgaccggtgctcgatttagtatagacatcagggggcagaagtctctctcagtcaggacacagcatggacatgagggtccctgctcagctcctgggactcctgctgctctggcctcccagactaccagatgtgacatccagatcgaccctagtctccactcctccctgtctgactatctggtaggacactaggacgtccaaccattccgacgtttcgggacccggggtcgtaacggttccggaacggggtacctaaagtaaccggtacttaaacgttttaacgtttacggccctttaagggtaacttacgaggaaaccgtaaacggtaaaaacccggaacggttaaaacgttacccgtaaagtccgtaccgtagtaactcgttcctacgtccgttacgtccgtaacgttcccttacggtttcgaccgtaacgtcgggtaacccgggttacctaagttccggttaccgttcgaacgggcggtacgtacggtcgtacttcgggtacggaacgttaggttaccgttttaccgaaacttccggtacctaaacccgtactaccggtaacctacgtccggttccttaccgcgttacggtacgtaatcgtttacgtagttaacttaagttttactaacggtttaanaacgtttaaacggtaacttaaccgtacgtacccgtcccggttaccggtaccggtccggtaccggacgggtaacggtaaggtacaacgtaaaccggtaacgtacgttgggttccgtaacgg

SEQ ID NO: 47681 - DNA, 535 bp, Homo sapiens
  misc_feature: GYAE6OF01CMCOV.40.47.E03.1.454.CMB.1.raw
  modified_base (363)..(363): a, c, t, g, unknown or other
  misc_feature (363)..(363): n is a, c, g, or t
  modified_base (428)..(428): a, c, t, g, unknown or other
  misc_feature (428)..(428): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcaggcacagggtcctgggcccagtctgccctgactcagcctccctccgcgtccggtctcctggacagtcagtcgccatctctgcactgaaccataatgacgttggtgtacaactatgtctctgtaccaacaatacccaggacaaacgccccccaaatcctgtatttatgaggtcagtaacgccggcctcgagggtccctgactcgcttctctgctacagtctgtcaacncgtcctcctgtacctctcgtcggctccgaggctagaggatgagtcttgttactacgtgcagctanatgtgcgaggcagactaagttagtttggtacggttcgggaccggggtacaagcgtacgtacccgtcgtacggcacgacccgaggtcctccgccccctggtcctaccg

SEQ ID NO: 47682 - DNA, 791 bp, Homo sapiens
  misc_feature: GYAE6OF01DUALT.40.47.E03.1.454.CMB.1.raw
  modified_base (322)..(322): a, c, t, g, unknown or other
  misc_feature (322)..(322): n is a, c, g, or t
  modified_base (544)..(544): a, c, t, g, unknown or other
  misc_feature (544)..(544): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtcgccatctcctgcactggaaccaataatgacgttggtagttacaactatcgtctcctaggtaccaaacaactaccgaggaccaaaccgacccctaaactcctagtactttagngacggtcaaggtaacgccggtccctagacgggtccctgtaactccgtcttctcgtcggtctcctaacgtctagtaccaacgaccggtccctcccgtacgtaccgttcgtaccgtcgggtacctaccggaacggtcgttacgggtaacgggtaacttcgggtaaccgggttcttttacggttttaaaccgtaaccgttcgggtacctaacgttcccgtttaanaacgttacggtccggtaaccggtacggtaccgtaaacggttaacctttaaaggttttaacgggttttccgggggttaaccgggggttaacccggggggggaacccggggtaaaccctaacggggttacccggttaacccgggttacccgggtttaacccggttacggggaacccgtaaccccgggtacccgggtaaccggtccccgttacccccgggttaccccggtttccggtaccccgttacccg

SEQ ID NO: 47683 - DNA, 550 bp, Homo sapiens
  misc_feature: GYAE6OF01C8W43.40.47.E03.1.454.CMB.1.raw
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
  modified_base (449)..(449): a, c, t, g, unknown or other
  misc_feature (449)..(449): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcgccatcctcctgcactggaaccaataatgacgttggtgtacaactatgtctctgtaccaacaactacccaggacaaacgcccccaaatcctagatttatgagtcagtaagccgcctcgagggtccctgactcgcttcnctggctcagtctgtcaacncggtcctcccgtgtacccgtctcgtcggtcctccgaggtctggaggtactggacggtcttgtttacctacgtgcagtctcattngcaggcagactaattaagtttggtggttcgggacggggtaccagtcgtcgtaccgttcgtacggacacgaccgtaacgcctaccggcccctggtcctaccg

SEQ ID NO: 47684 - DNA, 813 bp, Homo sapiens
  misc_feature: GYAE6OF01B4SIX.40.47.E03.1.454.CMB.1.raw
  modified_base (310)..(310): a, c, t, g, unknown or other
  misc_feature (310)..(310): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcaggcacagggtcctggggcccaggtctggccctgactcagcctccctccgcgtccgggtctcctggacagtcagtcgccatcctcctgcactggaaccaataatgacgttggtgtacactatgtctctgtaccaacaactaccaggacaacgacccccaaactcctgtactttangaggtcaggtaacgccgccctgacgggtcctgactcgtcttctcgtcggcctaccgtaagtcgtacgtaccaaaccgcccggtccccttcccgtacgtacccgttctcggttcgggtccttaccggaacggtcgtagggaacggtagttacgggacgggtttaccgttttacgttttaacccgttaccggtacggtacccgtaacgggttcccttaacgttaacgtttaacggttccgggaacccgtacgggggaccctaaacgggtaaccttttaaaagggtttaaacgggtttttcgggggttaccgggggttaacccggggggggtacccggggggaaaacccttaacggggttacccggttaacccgggttaaccccgggttaccgggttaaccggggttaccccgaaacccgggttaacccccgggaaacccgggttccccggtttaaccccccgggtcccccccgggtttcccggggttcccctttaaccccccggg

SEQ ID NO: 47685 - DNA, 648 bp, Homo sapiens
  misc_feature: GYAE6OF01BT7DA.40.47.E03.1.454.CMB.1.raw
  modified_base (321)..(321): a, c, t, g, unknown or other
  misc_feature (321)..(321): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtgttacaactatgtctcctggtaaccaacaactacccgaggaccaaaaccgccccccaaaactcctagtaattttanggaggtcaaggtaacgccggccctcgacggggtccctgactcgtcttctctgctccgaagtctcgtacaacgaccggtccttcccgtgtacccgtcgtcgtcgggtcctccgaggtcctaggaggtagtcggtacggtcttacgtttaacctacgtcgacgacgtctactagtacgtcgacgtaggacgtaagtaacgttaaatttaacggtttgggtcggttacgggggaccgggggaacctaacgggtccgtacggtacccggttcggtacggtaccgacggtaccccgtaacggtcctacccgtccccgtcggtccctaacccg

SEQ ID NO: 47686 - DNA, 579 bp, Homo sapiens
  misc_feature: GYAE6OF01BS1QJ.40.47.E03.1.454.CMB.1.raw
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcgccatctcctgcactggaaccaatatgacgttggtagttacaactatgtctcctggtaccaacaatacccaggacaaacgaccccccaaactcctagtatttagtggaggttacaaggtaacggccggtccctcgacggggttccctagactccgtcttctcgtcggcctccaagtctgtaccaacgaccgccctccgtgacccgttctcgtcggcctccgaggtctggaggagtggagtcttacgtttacacgtgcagtctanatangacaggacagtacttaagttagtttgggtggtccggggacgggaccaggcgtcggaccgtcgtacggcaccgccgaagccctaccgccccgtgtccgtccg

SEQ ID NO: 47687 - DNA, 813 bp, Homo sapiens
  misc_feature: GYAE6OF01CC9UH.40.47.E03.1.454.CMB.1.raw
  modified_base (132)..(132): a, c, t, g, unknown or other
  misc_feature (132)..(132): n is a, c, g, or t
  modified_base (433)..(433): a, c, t, g, unknown or other
  misc_feature (433)..(433): n is a, c, g, or t
  modified_base (483)..(483): a, c, t, g, unknown or other
  misc_feature (483)..(483): n is a, c, g, or t
tcagtctagcgactcacgaccggtgctcgatttagactcgcgcacagagaggaagggggctggggtctcaggaggcagcgctctcaggacgtcaaccaccatggcctgggctctgctcctcctcaccctccncactcgagggcacgacgggtccgtcgggcccagtcctcgaccctgactcgacgccctccctccgcgtccgggtcctaccgtgacagtcacgtcgccatcctcctggccaacgtacggaaacctaaattaacgtcgggtaacgggttttacgggttacggttaaacctaaaacgttacgttcgttccgttaccggttacggaaaaccctaaacgtaaaccgtaacccgaggaacccaaaccgtaccccctaaaactccgtaagttatttaagcggtacggttacaacggtacgcccggtacnccggtacggggtcctagctcggtcttactcgcgtacctacgtacggttcncgtaccaaccggtacccgtccgtacccgtcgtaccgttcctcgtcgggtacctccgaacggcgtagggacgtacgtacgggtacgttccgttagttttaccgaccgttcggactcgtacttactaagttacgtaccgacgaggtaaccgttaacgaaccgttaaggtttttaacgggttcggggtttacccggggtacgggggtcccgggtaaacccggtacgggaccgtttaccgggtaccggttaaccgttaccgggtaccgtaacccggtacccgggaacggttccccggtccccggtaacccgttcccggtcccgtttaaccccgg

SEQ ID NO: 47688 - DNA, 653 bp, Homo sapiens
  misc_feature: GYAE6OF01AUMCW.40.47.E03.1.454.CMB.1.raw
  modified_base (255)..(255): a, c, t, g, unknown or other
  misc_feature (255)..(255): n is a, c, g, or t
  modified_base (310)..(310): a, c, t, g, unknown or other
  misc_feature (310)..(310): n is a, c, g, or t
  modified_base (439)..(439): a, c, t, g, unknown or other
  misc_feature (439)..(439): n is a, c, g, or t
tcagtctagcgactcacgaccggtgctcgatttagactcgcgcacagagagaagggggctggggtctcaggaggcagcgctctcaggacgtcaccacatggcctgggctctgctcctcctcaccctcctcactcagggcacagggtcctgggcccagtctgccctgactcagccctccctccgcgtccgggtctcctggacagtcagtccgccatctcctgcactggaaccaatatgacgttggtgttacaactntgtctctgtaccaacaactacccgagacaaacgacccccaaactcctgtacttangaggtcaagtaacgccggtccctcggacgggtcctggactcgtcttcgtctcggcctaccgaagttctacgtaccaacgtacccggcccttcccgtcggacccgttcgttccggtcgggtccctaccgngggtcgtacgggaggtagtacgggacggttccgtttacgtttaaccttacgcggtacctacggtcttactaagtacgtcgggaactacgggacctagtaaccttaaagtttacggtttcgggtcgggtaccgggggaacgggtaccgagtccggtacggacccgttcgtacggtccaccgggactacggccctccggccccgttgcccttcccg

SEQ ID NO: 47689 - DNA, 727 bp, Homo sapiens
  misc_feature: GYAE6OF01A8RQO.40.47.E03.1.454.CMB.1.raw
  modified_base (274)..(274): a, c, t, g, unknown or other
  misc_feature (274)..(274): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcgccatctcctgcactggaaccaataatgacgttggtagttacaactatgtctcctgtaccaanactacccagaccaaacgacccccaaactcctagtactttagtagaggtacaagtaacgccggccctcgacggggtccctagactccgtcttctcgtgtcctactaacgtctacgtaccaaccgaccggtacccttcccgtacggtacccgttccgttcggtcgggtaccctaccggagggtcgtacggtaaggtatgggtacgttccgtttcgtttaacctcgttcgtacacgtctactagttacgtacggaccgtacgggcgtaacgtaacgttaaagtttaacggttttcgggggtaccgggtttacccggggggaccgggggtaaaccctaaggggtacccgttaccgggtaaccccggtttccggtaacgggtacccggtaacccgtacccgggtaacgggtcccccgttaccccgggtcccccggttacccggttcccgttaccccgg

SEQ ID NO: 47690 - DNA, 904 bp, Homo sapiens
  misc_feature: GYAE6OF01DQ1YR.40.47.E03.1.454.CMB.1.raw
  modified_base (212)..(212): a, c, t, g, unknown or other
  misc_feature (212)..(212): n is a, c, g, or t
tcagtctagcgactcacgaccggtgctcgatttagactcgcgcacagagaggaagggggctggggtctcaggaggcagcgctctcaggacgtcaccaccatggcctgggctctgctcctcctcaccctcctcactcgagggcacgacgggtcctgggcccagtcctcgccctgactcacgccctcccgtccgcgtccgggtctccgtggacngtcacgtcgccatcctcgtcgctacgtacggaaaccaattaacgtaggtacggtttaggtacggttaacctaaacgttacgttcgtccttccgtacggtaaaccaactaaacctaacccgaggtaccaaaccgaccccctaaactcctagtacttatggacgtcaaggtaacgcccgtacccgtcggacgggttccctagtacgttccgtcgttccgtcgtacggtaccgtacctaacggttcgtacgtaaccgaaaccgtcccggtaccccttccggtaccggttacccgttccgttacggttccgggtccctaccggtaccggggtacgtaacggggtaacggtacggttacgggtacgggtttaccgtttaaccggttttaccggttaaccgttcgggtacgtaccgttacccgttagttacgttaaccggtccggtaacgtaccgggacccgttaaacgaaaccggtttaaagtttaacgggttttacgggtaccggggggtttaccgggggtaaccggggggtaaacccgttaacccggtaaccgggtttcccgggttaacccgggttacccgggttaaaccgggttaccccgggtaaaccgggtacccccggggtaaacggttcccccggggttaacccccggtttacccccccgggttcggttaacccccggttttaacccccgg

SEQ ID NO: 47691 - DNA, 777 bp, Homo sapiens
  misc_feature: GYAE6OF01DVGXY.40.47.E03.1.454.CMB.1.raw
  modified_base (328)..(328): a, c, t, g, unknown or other
  misc_feature (328)..(328): n is a, c, g, or t
  modified_base (405)..(405): a, c, t, g, unknown or other
  misc_feature (405)..(405): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacgagggtcctgggcccagtctgccctgactcacgcctccctccgcgtccgggtctccgtggacagtcagtcgccatcctctgcactacggaaccaataatgtacgttggtacgttacaactatcgtctccgtggtaaccaacaactacccgaggaccaaccgacccccaaactcctacgtatttagngtaggtacgaagtacggccggtcccgtacggacgggtcctgctcgtcttctcgtcgctaccgagtctcgaccgaacnccggtccctccgtacgtacccgtcgttccgtcggtccctaccgaggtcgtaggacggtagtacgggtacggtccgtttagtttacctacgtcgacgtacgtacttacgtaagttagtcgacgtaacggtacgtaacggttaaccgttaaaaggttttaacgggtttttcggggttaccgggggtttaacccggggggaacccgggggggtaaacccgttaacgggtaccccggttaaccgggtaacccccgggttacccgggtttaaccgggtaaaccccgtaaccccggggaaacccccggttaacggggttccccgttaaccccccgggtttaccccccccggggttacggttccccgttaacccccggg

SEQ ID NO: 47692 - DNA, 795 bp, Homo sapiens
  misc_feature: GYAE6OF01BE2XD.40.47.E03.1.454.CMB.1.raw
  modified_base (206)..(206): a, c, t, g, unknown or other
  misc_feature (206)..(206): n is a, c, g, or t
tcagtctagcgactcacgaccggtgctcgatttagactcgcgcacagagagaagggggctggggtctcaggaggcagcgctctcaggacgtcaccacatggcctgggctctgctcctcctcaccctcctcactcgagggcacgagggtcctgggcccagtctgccctgactcacgccctccctccgcgtccgggtctccgtggacngtcagtcgccatcctcctgcacgtaggaacctaataagtggtacggttggtacggttaaccaacttacgtcgtcctccgtaggtaacccaaactaactacccgaaggaccaaaaccgtacccccctaaaacttccgtacgttacttttaagtacggtaacggttaccgtaaggtaaccggcccggtacccgttacggtaaccggggttcccctaggtaaccgttccgtacctttccgtaccgtacgggtaccttacccgtaaacgttcgttacggtaaccaaaccggtacccggtaccccttacccggtaccggtacccgttccgtaccggttacggtccctaccggtacgggtacgtacgggtacggtagtacggtacggttaccgttacgttttaacctacgtcgtaccgtacggtacttactaagtacgtcgtacgtacggtactacgtaacttaagttaacggtttgggttaccgggtcggggtaccggggtaaccacggtaccgtacgggtacccgtacggttacggaccgtacccggtacccgtaacggtcccgttacccgtccccggtacgtcctaccccgg

SEQ ID NO: 47693 - DNA, 738 bp, Homo sapiens
  misc_feature: GYAE6OF01B9O4C.40.47.E03.1.454.CMB.1.raw
  modified_base (204)..(204): a, c, t, g, unknown or other
  misc_feature (204)..(204): n is a, c, g, or t
  modified_base (610)..(610): a, c, t, g, unknown or other
  misc_feature (610)..(610): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctccaccctcctcactcgagggcacgagggtcctgggcccagtctacgcctgactcacgccctccctccgccggtccggtctcgnggacagtcagtcgccacttcctccgtgccacgtacggaaacctaataagtcggtacgggtttggttacggttaactaacttagttcgttacctccgtacggtaaaccaacaacctaaccgaacggaccaaaacccgaccccctaacttccgttagttaattttacgacggtaacggtacgtaaggtaaccggcccgggtacccctacgggtacccgggttcccgtagtacctcgttaccgttctcggtacggtacctaccgtaagttcctacgtaccaaccgtacccggtccctaccgtacggtaccctcgtcgtcggcctccggacggtcgtacggaagtcgtacggacgttacgtttacgttaaccgtacgtcgtacgctcgtactagtacgcgacgaacggtntaacgagttaagttacggttgggtacgggtacggggtccgggaacttaccggacggtaccggttccgttaccggacggtaccgtaccggtaccgacggcccttacccggcccgtaccggtcctacccg

SEQ ID NO: 47694 - DNA, 652 bp, Homo sapiens
  misc_feature: GYAE6OF01B45EF.40.47.E03.1.454.CMB.1.raw
  modified_base (304)..(304): a, c, t, g, unknown or other
  misc_feature (304)..(304): n is a, c, g, or t
  modified_base (445)..(445): a, c, t, g, unknown or other
  misc_feature (445)..(445): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcgccatctcctgcactgaaccaataatgacgttggtgtacaactatgtctcctgtaccaacaactaccagacaaacgcccccaaactcctgatttangagtcagtaacgccggacctcgtacgggtccctagactcgtccttcgtcgtcggcctccgaagttcctcgtaccaacgaccggtcccttcccgtcgtacccgttcgtccgtcgggtacctccgaggctcggaaggagtcgnggtacgtttcgtttaaccgtacgtgaccgtagtacttcaattcgacgacgacggacgtacgaattaagtttaaggtttcgggtcgggttaccggggtaccggggtaccgtaagtcggttaccggtacccggttccggttacggtccgaaccgggtaccccgtaacgggtccctaccccgggttcccccgtaccggtccttaccccgg

SEQ ID NO: 47695 - DNA, 712 bp, Homo sapiens
  misc_feature: GYAE6OF01DAIC0.40.47.E03.1.454.CMB.1.raw
  modified_base (254)..(254): a, c, t, g, unknown or other
  misc_feature (254)..(254): n is a, c, g, or t
tcagtctagcgactcacgaccggtgctcgatttagactcgcgcacagagaagaagggggctggggtctcaggaggcagcgctctcaggacgtcaccaccatggcctgggctctgctcctcctcaccctcctcactcaggcacaggtcctgggcccagtctgccctgactcacgcctccctccgcgtccgggtcctcctggacacgtcacgtcgccatcctcctgcactacgaacaatatcgacgttggtgtaanaactagtcgtctctacggtaacccaacaactacccgaaggtacaaaccgccccctaaacgttcctagtatttacgtaggacggtacgtagtaacgccggtcccttcgaaccggggttcccaggtacttcgtcctttctacgtcggtacctaccgtaacgttcgttacgaaccgaacccgtccgggtccctcccgttccggtaccgttcttcgggcgtacctaccgacgtcgaggtacggtatcggtacgtcgtttacgttactacgtcgcgtactccgtactattacgcgtccggacgtacgtaacgtaacgttagtttaacggttcgggttaccggggttaccggggaccggggtaccgtacggtcccggtaacgtaccggttacccggttacggacccgacgtaccccggtaacggtcccgttaccccggtcccccggttcgttacccttacccgg

SEQ ID NO: 47696 - DNA, 597 bp, Homo sapiens
  misc_feature: GYAE6OF01CSC10.40.47.E03.1.454.CMB.1.raw
  modified_base (245)..(245): a, c, t, g, unknown or other
  misc_feature (245)..(245): n is a, c, g, or t
  modified_base (311)..(311): a, c, t, g, unknown or other
  misc_feature (311)..(311): n is a, c, g, or t
  modified_base (457)..(457): a, c, t, g, unknown or other
  misc_feature (457)..(457): n is a, c, g, or t
tcagtctagcgactcacgaccggtgctcgatttagactcgcgcacagagagaagggggctggggtctcaggaggcagcgctctcaggacgtcaccacatggcctgggctctgctcctcctcaccctcctcactcagggcacagggtcctgggcccagtctgccctgactcagcctccctccgcgtccgggtctcctggacagtcagtcgccatctcctgcactggaaccaataatgacgtttggnggtttacaactatgtctcctggtaccaacaatacccaggcaaacgccccaaaactcctagatttangaggtcagtaacgcggccctacacggggtcccctgacgttcgcctttactcgtaggctaccaaagtctcggtacaacacggccttaccctgaccgtctctgggtctccaggctgaggatcggagcttagtttacgtatcgcagtcnctatagttcgacgaggtaccgagtaccaaagttaactttgggtcgtttcgggggccggggaaccgtaacgcgttacgaccggttacccgttggtaccgagtacccgaaacggtctaccgccccccgtgggtaccttaccg

SEQ ID NO: 47697 - DNA, 803 bp, Homo sapiens
  misc_feature: GYAE6OF01DARUH.40.47.E03.1.454.CMB.1.raw
  modified_base (235)..(235): a, c, t, g, unknown or other
  misc_feature (235)..(235): n is a, c, g, or t
  modified_base (353)..(353): a, c, t, g, unknown or other
  misc_feature (353)..(353): n is a, c, g, or t
tcagtctagcgactcacgaccggtgctcgatttagactcgcgcacagagagaagggggctggggtctcgaggaggcagcgctctcaggacgtcaccaccatggcctgggctctgctcctcctcaccctcctcactcgagggcacgacgggtccgtgggcccctagtctcgccctgactcacgccctcccgtccggtccggttcccgggttcctccgtgggacaggtacacggtcnccctattcctcctgacacgtacgaacctaatagtggtacggttggtcgtaactaactatcgtcctcgtacgtaaccaacaactaccagtaccaaccgacccctaatcctagtattagngacgtagtagacgtccggcctacggtacggtccgtcgactcgtcttcgtcgtcgtaccgtacctacgttctaccgtaccgtaaccgcccggttaccctccggtacctaccggtccgttcgggtcggtcccggtaccgtagggtcgtagggtaggtacggtacgggtaacggtccgtttagttaaccgtccgtaccgtacgtaccgtgttaaccgtacttaagggtccgacggtaaccgtacgggtaacttaacggtttaaggtttaaccgggttttgggggttaaccgggggttacccggggggtaaccggggtacccgttaaccggggtaaccggttcccgggttacccgggttaacgggttaccccggtaagttaaccccgggaccccgtttaaccccgggcccgtttcccccccggaacccggtcccggttacccgtttccccccgg

SEQ ID NO: 47698 - DNA, 777 bp, Homo sapiens
  misc_feature: GYAE6OF01A1HGP.40.47.E03.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
tcagtctagcgactcacgaccggtgctcgatttagactcgcgcacagagagaagggggctggggtctcaggaggcagcgctctcaggacgtcaccacatggcctgggctctgctcctcctcaccctcctcactcagggcacagggtcctgggcccagtctgccctgactcagcctccctccgcgtccggtctcctggacngtcagtcgccatcctctgcactgaaccaataangacgtttggngttacactatgtctctgtaccaanaactaccgagactaaaccgacccccaaactcctagatttacngacgtcgtagtaacgccgacctcgacggggtcctgtacgtccgtccttctacgtcgtaccgtaccgttaacgtccttacgaccgtaaaccgtacccgggtccccttacccgttaccggaccctttaccggttccgttacggggtaccctaccgggaacgtaccggtacggtaacggttaagtcgggtaccgggttacctttacggtttttaaccgttaacggtccgttaaccggtccgttaacgtaaccgtaacttaacggttacgtaccgacggggtaaccaacggggttaacctttaaaacggttagggtttttaccgggttcgggtaccccgggggggttaaccgggggtaaaccctaaacggggtccgttacccgggtaacccgttacccggttacggttaccgaacccggtacccggtaaaccggtccgtacccccgggaccccgttggtcccccgtaaccgg

SEQ ID NO: 47699 - DNA, 697 bp, Homo sapiens
  misc_feature: GYAE6OF01B39SH.40.47.E03.1.454.CMB.1.raw
  modified_base (516)..(516): a, c, t, g, unknown or other
  misc_feature (516)..(516): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctcgggcccagtctgccctgactcagccctccctccgcgtccgggtcctccgtggacagtcacgtccgccatcctcctgccacgtacgaaccaatatggtacgttggtagttacaactatctctcctgtaaccaacaactaccgagaccaaccgaccccctaactctatattgtgacggtcaagtacgccgcctcgacgggtcctgactcgtcttctcgtcgtctaccgtacgtctacgtacaaccgacccggtcccttcccgtacgtacccgtccgttacggtcgggtccctacggtacggtccgtaggtacggacgttcggacgttcgtttacgttactcgtcgtcgctactactagttcgtacgngtacggcgtaacgtaacttaacgttttacggtttcggggaccgggttccgggggaaaccgggtaccgttaacggtccggttaccgtaacccggggttacgttaaccgggtccgtaaccccggtaacccggtccggtacccccgttacccgggtaccccgtttccggtacccgtttaccccg

SEQ ID NO: 47700 - DNA, 751 bp, Homo sapiens
  misc_feature: GYAE6OF01BPCOE.40.47.E03.1.454.CMB.1.raw
  modified_base (121)..(121): a, c, t, g, unknown or other
  misc_feature (121)..(121): n is a, c, g, or t
tcagtctagcgactcacgaccggtgctcgatttagactcgcgcacagagagaagggggctggggtctcaggaggcagcgctctcaggacgtcaccaccatggcctgggctctgctcctccnccaccctcctcactcgaggcacgagggtcctgggcccagtctcgccctgactcgacgccctccctccggtccgtccgggtcctccgtggacagtccgagtccgccatcctcctgccacgtacggaaacctaattaatcggtacggtttggttacgttaaacctaacgttacgttcgttccttaccgttaccggtaaaccctaaaccgtaaaccgtaacccgaaccggaacccgaaaccccgaacccccctaaaccgttccgttaacgttacgtttacgtacggtaacggtacgtaacggtaaccggcccggtcccgtaccgggtaccgggttaccgtcgtacgtccgttccgttcgtcgtcgtactaccgtacgtcgtacgtaccgaccgtccgtcccgtccgtacgtccgtcgtcgtcgtccgtccgcgtcgtaggacgtacgtcggtacgttcgttacgttacgtcgtcgacgtcgtctcgtacgtcgcgacgacggtacgtacgtagttagttacggttcgggtacggggtaccgggaccgggtaccgtacggtccgtccggtaccggtacggtccggaccgtaccggaccggtaccggtcccgtcccggtcccgtccgtcgtcccg

SEQ ID NO: 47701 - DNA, 534 bp, Homo sapiens
  misc_feature: GYAE6OF02ITVOU.40.47.E03.1.454.CMB.1.raw
  modified_base (432)..(432): a, c, t, g, unknown or other
  misc_feature (432)..(432): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaataccccaggcaaagcccccaaaactccctgatttatggaggtcagtaagcggccctcaggggtccctgatcgcttctctgctccaagtctgtcaacacggccctccctgacccgtctctgggcctccaggctgaggatgaggctgtttactactgcngctcatatgcaggcagcaaatttaagtttggttagttcgggcgggggaccaggcgtgaccgtcgtaggtcgagacccaggcctcgcccccgtggtctacccg

SEQ ID NO: 47702 - DNA, 529 bp, Homo sapiens
  misc_feature: GYAE6OF02FM3A4.40.47.E03.1.454.CMB.1.raw
  modified_base (310)..(310): a, c, t, g, unknown or other
  misc_feature (310)..(310): n is a, c, g, or t
  modified_base (351)..(351): a, c, t, g, unknown or other
  misc_feature (351)..(351): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaataccccaggcaaagcccccaaaatccctgatttangaggtcagtaagcggccctcaggggtccctggatcgcttcnctggctccaagtctgtcaacacggcctccctgacccgtctctgggctccgaggctggaggatggggctgttactacgtgctagctcatatgcaggcagcaattaatttggtgttcgggcggggaccaggctggaccgtcgtaggtcagcccaaggctcgcccccgtggtccacgtccg

SEQ ID NO: 47703 - DNA, 583 bp, Homo sapiens
  misc_feature: GYAE6OF02H3SF4.40.47.E03.1.454.CMB.1.raw
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcgccatctcctgcactggaaccaataatgacgttggtggttaacaactatgtctcctggtaccaacaactacccaggacaaaacgacccccaaaactcccttagtaattttacgtggacggtacaaggtaacggccggccctacgacggggttccctgactcgctttcctctcggctaccaagttctgtacaacgccgcctccctgaccgtctcgtggcctccgaggtctgaggatggaggtcttgtttaacacgtgcagtctacaatatgacaggcagactaattaagtttggtggttcgggacggggacaagcgtacgtacccgttcgtaaggtcacggacccgtaaggcctccggcccccgtggtacctaccg

SEQ ID NO: 47704 - DNA, 608 bp, Homo sapiens
  misc_feature: GYAE6OF02G7Q31.40.47.E03.1.454.CMB.1.raw
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccagacaaacgcccccaaactcctagtatttatgaggtcagtaagcggccctcgacgggtccctgactcgcttctcgtggctcaagtctgtacaacgacgccctccgtcgaccgtctcgtgggcctccgaggtctggaggtatggaggtcttagtttactacgtgcacgtctactattagtcggacaggcaagacttaaagtttagtttgggtaggttccggggacgggggacctaaggtaccgtcgggtacccgttcggttaacgggtccgaccggtaccccgtaagggtcccgtaccccgggtccccccgttcgggttaccctacccg

SEQ ID NO: 47705 - DNA, 574 bp, Homo sapiens
  misc_feature: GYAE6OF02HQMED.40.47.E03.1.454.CMB.1.raw
  modified_base (311)..(311): a, c, t, g, unknown or other
  misc_feature (311)..(311): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctctggtaccaacaatacccaggacaaacgacccccaaactcctgtatttangaggtcagtaagcggccctcgagggtccctgatccgcttctctcggcctccaagttctagtccaacgaccggccctcccgtgacccgtctctgggcctccgaggtctggaggtatggaggtcttagtttacttacgtgacagctacatatgcgaggcagactaaattagtttggtcggttacgggacgggggacaaggtccgtacggtcccgtacgtaggtaccgacgaccccgaggtcctccggtcccctccggtctacccg

SEQ ID NO: 47706 - DNA, 677 bp, Homo sapiens
  misc_feature: GYAE6OF02H9RNI.40.47.E03.1.454.CMB.1.raw
  modified_base (320)..(320): a, c, t, g, unknown or other
  misc_feature (320)..(320): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctagacagtcagtcgccatctcctgcactggaaccaataatgacgttggtgttacaactatgtctcctaggtaccaacaactacccgaggaccaaaacgccccccaaaatccctagtattttagngaggtacagtaacgccggccctcgacgggtccctggactcgtcttctctggcctccaagttctgtacaacgaccgtcctcccgtgacccgtctcgtcgggcctaccgaggtcctaggacggtagtcggaacggtcctttacggtttaacctacgtggtacctacggtcctactaacgtacgttcggaccgtagggtaccaacggtacttaaagtttaaggtttcgggttaccgggttaccgggggaccgggggtaacccaacggtccgttacggtaacccggttaccgttacgggtacctaaccggtacccgaacgggtcccttaccccggacccccgttccgggtaccttacccgg

SEQ ID NO: 47707 - DNA, 528 bp, Homo sapiens
  misc_feature: GYAE6OF02FLDR9.40.47.E03.1.454.CMB.1.raw
  modified_base (351)..(351): a, c, t, g, unknown or other
  misc_feature (351)..(351): n is a, c, g, or t
  modified_base (441)..(441): a, c, t, g, unknown or other
  misc_feature (441)..(441): n is a, c, g, or t
  modified_base (473)..(473): a, c, t, g, unknown or other
  misc_feature (473)..(473): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtgttacaactatgtctcctggtaccaacaatacccaggcaaacgcccccaaaactcctagatttatgaggtcagtaagcggccctgacggggtccctgatcgcttcnctggctcagtctgtcaacacgcctccctgacccgtctcgtcgggctccgaggcctgaggatgaggtctggttttaactactcgacagctnatatgcaggcagcaaattattggtgttcgggnggggacaggcgtcgaccgtccgtaggtcagccgaggcctcgccccctcggctacg

SEQ ID NO: 47708 - DNA, 603 bp, Homo sapiens
  misc_feature: GYAE6OF02ITHH9.40.47.E03.1.454.CMB.1.raw
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaactacccaggcaaagccccaaactcctgatttatgagtcagtaagcgcctcgagggtccctgatcgcttctctggctccaagtctgtcaacacgccctccctgaccgtctcgtgggcctccgaggctgaggatggaggtcttgtttactacgtcgcagctcattatcgactaggcaggtacctaaagtttaacgtttcgggttgggtttccgggggaccgggggggtacctaacggtccgttacggtacccggttaccggtaacgggttcccgaacggtaccccgaagggtcccttacccggtccccccgttacgggtccttaacccgg

SEQ ID NO: 47709 - DNA, 663 bp, Homo sapiens
  misc_feature: GYAE6OF02HAWBF.40.47.E03.1.454.CMB.1.raw
  modified_base (360)..(360): a, c, t, g, unknown or other
  misc_feature (360)..(360): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcgccatctcctgcactggaaccaataatgacgttggtgttacaactatgtctctggtaccaacaatacccaggcaaacgcccccaaaactccctagtactttatgaggtacagtaacgccggccctcgacgggtcccctgactcgtcttctcnggtctaccagtctcgtacaacacggccctccctgaccgtctcgtcgggtcctccgaggtcctaggaggtacgtagggacggtcctttacggttttaacctaacgttcgaccgtacggtccttactagttactcggactacggacaggtaacctaaagtttaaagttttcggttacgggttccggggtaccgggggacctaacgggccggttaacggtacccgttaccggtaacggttaccgaaccggtaccccggtaacggtccgttacccggaccccccggttaccgggtcccttaacccgg

SEQ ID NO: 47710 - DNA, 690 bp, Homo sapiens
  misc_feature: GYAE6OF02JVRFS.40.47.E03.1.454.CMB.1.raw
  modified_base (243)..(243): a, c, t, g, unknown or other
  misc_feature (243)..(243): n is a, c, g, or t
  modified_base (304)..(304): a, c, t, g, unknown or other
  misc_feature (304)..(304): n is a, c, g, or t
  modified_base (379)..(379): a, c, t, g, unknown or other
  misc_feature (379)..(379): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcaggcacagggtcctgggcccagtctgccctgactcagcctccctccgcgtccggtctcctggacagtcagtcgccatctcctgcactggaaccaataatgacgttggngttacactatgtctcctggtaccaacatacccaggcaaagcccccaaatcctagatttacngacggtcaggtaacgcggccctgacgggtccctgatcgtcttctctggctccaagtctgtcaacacggcctcccngacctctcgtcgggcctccgacggtcctaggacggtacgttacggacgggtcctttacggtttaccgtaacctttggacccgtaggtcccttacgtaacgttaacgttcggtaccgtaacgggcctaacggtaactaaactttaaacgggttttacggttcggggtttaccggggaccgggggggtaaccctaaggggttacccgtacgggtaaacccggttccggttaaccgggtacctaacccgggtaccccgtaaacggggcccgtttacccgggtacccccccggttcgggtaccccgttaacccgg

SEQ ID NO: 47711 - DNA, 650 bp, Homo sapiens
  misc_feature: GYAE6OF02IH19J.40.47.E03.1.454.CMB.1.raw
  modified_base (204)..(204): a, c, t, g, unknown or other
  misc_feature (204)..(204): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcacctcctcactcaggcacagggtcctcgggcccagtctcgccctgactcacgccctcctccgcgtccgggtctccgtggacngtcacgtcgccatctcctgcactggaaccaataatgacgttgtgttacaactatcgtctctgtacaactaatacccaggacaaacgacccccaaactcctagactttagagagtacaagtaacgccggtcctgacgggttccngtacnctctctactcgctaccgtaagtctgtaccacgaccgtccctccctaggtaccgtctcgtcgggcctcgagcgtaggaggtagtcggtaagtcgtttacgtttacgttacgtcgacgtacggcctttacaacgtttaacgcggtacgacggttacgaacgttacgttaaagttaacggtttttggacgggtttaccggggaccgggggtaacaacgggttccgtacggtaccggtaccgtaacggtcgtaaccggcccgtaaggcccttacccgggtaccccttcgggtaccttacccg

SEQ ID NO: 47712 - DNA, 657 bp, Homo sapiens
  misc_feature: GYAE6OF02I5NI3.40.47.E03.1.454.CMB.1.raw
  modified_base (277)..(277): a, c, t, g, unknown or other
  misc_feature (277)..(277): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggaccagtcagtcgccatctcctgcactaggaaccaataatgacgttggtggttacaactatgtctcctggtaacccaanaactacccaggacaaaacgacccccaaaactcctagtactttagtcggaaggtcaagtaacgccggaccctcgacgggtccctagactcgacttctcgtggtctaccgtaaagtctacggtcaaacgacggtccctacccgtgtacccgtctcgtcgggacctccgaggtctaggaaggtctagggacggtcttagtttaacctagtgacgtagcgttacaacgttctagtacgacggactaagtactaaagtttaacgtttcgggtacggttacggggaaccgggggacctaacggtccgtaacggttacccggtaccggttaaggtccgaacggtacccgaacggtccgtacccggccccggttacggaccttacccg

SEQ ID NO: 47713 - DNA, 633 bp, Homo sapiens
  misc_feature: GYAE6OF02FSTJJ.40.47.E03.1.454.CMB.1.raw
  modified_base (307)..(307): a, c, t, g, unknown or other
  misc_feature (307)..(307): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaatatgacgttggtggttacaactatgtctcctgtaccaacaatacccaggacaaacgcccccaaatcctgatttangaggtcaagtaagccggccctcgacggggtccctgactcgcttctcgtgctccaagtctcgtacaacgacggtccctcccgtgacccgtctcgtcgggtcctccgagggtctggaggatggacggtcttcgtttaactacgtgcgagtcctactattagtgacgtacggcaacggtactaaagtttaacgttttgggttgggtttaccgggggaccggggggtaaccaaggtccggttacggtacccggttaccggtacgggtaccgtaaccggtaccccggaacgggtcccgttacccggccccccgttaccgggtcctacccgg

SEQ ID NO: 47714 - DNA, 657 bp, Homo sapiens
  misc_feature: GYAE6OF02HUB8O.40.47.E03.1.454.CMB.1.raw
  modified_base (314)..(314): a, c, t, g, unknown or other
  misc_feature (314)..(314): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactgaaccaatatgacgttggtgttaacaacttatgtctcctgtaaccaactaactacccaggccaaacgcccccaaactcctagtatttagngtaggtcaagtaacgccggccctcgtacgggtccctgtactccgtcttctcgtcggccttaccgaagtcttacgtaccgaaccgaccggtcccttcccgtcgtacccgttcgttcgtcggggtccttaccggaacgggttcctaggggtaacgtacgtcgggtacgttcctttagtttaaccctacgttcgacgtacgtctacacttagtcgacgaggctaacggtactaaggtttaacgtttgggtacgggttacggggaccgggtacacggtccgtcgacccgttcgtacgtacgacggtacccgtaggcccgtacccggtccccgttagtccgttacccg

SEQ ID NO: 47715 - DNA, 631 bp, Homo sapiens
  misc_feature: GYAE6OF02FTAIM.40.47.E03.1.454.CMB.1.raw
  modified_base (311)..(311): a, c, t, g, unknown or other
  misc_feature (311)..(311): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcgccatctcctgcactgaaccaataatgacgttggtgttacaactatcgtctcctgtaccaacaactacccaggacaaacgcccccaaactcctagatttangagtcagtagcggccctgacgggtccctgactcgtcttctcgtggcctacctaagttctgtaccaacgacccggtccctcccgtacgtacccgtctccgtcgggtcctccgacggctaggaggtacgtaggaggtccttacgttttacctaacgttcgaccgtacgtactacaattacgtggtaccagggtccaggtaacttaaagtttaacgttttgggttacggttccggggaccggggtacaacggtcgtaacggtacccggtccgtaaggtccgacggccgaaggtcccgtcccgtccccgttcggtccctaccgg

SEQ ID NO: 47716 - DNA, 848 bp, Homo sapiens
  misc_feature: GYAE6OF02H5947.40.47.E03.1.454.CMB.1.raw
  modified_base (321)..(321): a, c, t, g, unknown or other
  misc_feature (321)..(321): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcacctcctcactcaggcacagggtcctgggcccagtctgccctgactcagcctccctccgcgtccggtctcctggacagtcagtcgccatcctcctgccacgtggaaccaataatgtacggttggtgttaacaatatgtctctggtaaccaacaactacccgaggacaaaccgcccccaaaactccctagtacttttagnggaggttcaaggtaacggcccggtacccctacggaccggggttcccctagaacgttccggctttctacgtcggtcctacccgtaaggtcttacgtacaaaccgtacccggtccccttacccgttacggtacccgttccgttccggtacggggtcccttcccgacgggtcgtacgggaaggtacgtacgggaacggtccgttttacgtttaacctacggttcgaccgttgtacccttacgtaaagttacgtaccgaacggtagggtacccgttaagtaaaccgtttaaaaggtttttaaacggtttttcgggggtttaaccgggtttaacccgggggggtacccggggggtaaacccggttaaacgggtcccgggttttaaaccccggggtaaacccgggttttaccccggtttaaaaccggggtaccccggtaaaccgggtaaccccccggaaacgggtttcccccgggttaccccccggtttaccccccccggtttaccggggtttaaccccttaaccccccgggg

SEQ ID NO: 47717 - DNA, 770 bp, Homo sapiens
  misc_feature: GYAE6OF02IYOQM.40.47.E03.1.454.CMB.1.raw
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcgccatcctcctgctactaggaaacctaataatgacgttgggtagttaacaactattcgtcctccgtacgtaacccaaactaactacccgacggtaaccgaaaacccctacccccctaaaactcccgttagtaacttttagtacggtaacggtacgtaaggtaacggccggtcccgtacggtaccggggtccctaggactccgtcttacgtcgtcggtcctacgtacgtcgtacgtaccgaccgaccgtccctacccgtcgtaccgttcgtcgtcgggtacctccgaggtcgtaggacggtagtacggtaacgttcgttacgtttaccgtacgtcggtacacgtacctataagtgtaccgacgtacgggacctaaaggtacttaaagtttttcggttacgggttaccggggttacggggggaccgggtaaacctcgggttaaccggttacccgggtaccggtttaacccggtaacggtaaccccggtaacccggtaaccccggtaaccgggttcccctacccccgggttacccccgttacggttacccctttaaccccgg

SEQ ID NO: 47718 - DNA, 642 bp, Homo sapiens
  misc_feature: GYAE6OF02IZ0HE.40.47.E03.1.454.CMB.1.raw
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (469)..(469): a, c, t, g, unknown or other
  misc_feature (469)..(469): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacgagggtcctgggcccagtctgccctgactcacgcctccctcgcggtccggtctcctggacagtcagtccgcctatcctcctgcacgtagaaccatagtgtacggttggtagttacaatntgtctcgtgtaccaanaactacccagacaaccgaccccaactcctagtattgtaggagtcaagtacgccgtcctacggtcgggtacctggtacgtcgtcttcgtcgtcggacctcgtagttctcgtaccaacgccgtccctcccgtacgtccgtcgtcgtcggctcgacggtagtgaggagtaggtcgttcgttacgtttactacgtnacgcgtcctanatcgtcggacgcgnaacgtagttaaatttacggttcgggtcggggtaccggggtaccgggacgttaccggtcttacccggggtaccgttacggtaacggtaccgtaccggtaaccccggtcggtacccgtccccgggtccccgtcggtacccgtttaccccg

SEQ ID NO: 47719 - DNA, 641 bp, Homo sapiens
  misc_feature: GYAE6OF02I1MJR.40.47.E03.1.454.CMB.1.raw
  modified_base (202)..(202): a, c, t, g, unknown or other
  misc_feature (202)..(202): n is a, c, g, or t
  modified_base (452)..(452): a, c, t, g, unknown or other
  misc_feature (452)..(452): n is a, c, g, or t
  modified_base (560)..(560): a, c, t, g, unknown or other
  misc_feature (560)..(560): n is a, c, g, or t
  modified_base (585)..(585): a, c, t, g, unknown or other
  misc_feature (585)..(585): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcgcatctcctgcactggaaccaatatgacgttggtgttacactatgtctcctgtaccaacaactacccgaggacaaacgccccccaaatcccgtagatttataggacgtcaacgtaaggccggccctcggacgggtccctgactcgtactttcctcgtcggcctccgtaacgttctcgtacaacacccggcccttaccctcggacccgttctccggtacggtccctaccgcggtactggacggngtacggaggtccgttcgtttacctacgtctccgacgtctacatagtcgacgtggaccgtaagacgtaaacgttttaggtttcggtacgggttccggggaccggggtanaaccggtcgtaaccgttcccggttntaccggtctaccggcccgaacggttcccgtccggtcccccgtgttacccgtacccg

SEQ ID NO: 47720 - DNA, 585 bp, Homo sapiens
  misc_feature: GYAE6OF02F1R4J.40.47.E03.1.454.CMB.1.raw
  modified_base (303)..(303): a, c, t, g, unknown or other
  misc_feature (303)..(303): n is a, c, g, or t
  modified_base (418)..(418): a, c, t, g, unknown or other
  misc_feature (418)..(418): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
  modified_base (467)..(467): a, c, t, g, unknown or other
  misc_feature (467)..(467): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtgttacaactatgtctctgtaccaacaatacccagacaacgcccccaatcctgtattangagtcagtaacgcggcctcgacgggtcctgatcgcttctctggctccgtaagttctgtacaacgaccggccctccctcggtacccgtctcgtcgggcctccgaggtctggaggtntcggacgtcgttagtttacctacgtgacncgtcctntatacgtcgacgnggacagtactaaagtttagttggttaggtccggggacgggaccagtccgtacggacccgtcggtaaggtccaacggcccgtaacggtcccgtccggtcccccgttaggtcctacccgg

SEQ ID NO: 47721 - DNA, 775 bp, Homo sapiens
  misc_feature: GYAE6OF02GRW8E.40.47.E03.1.454.CMB.1.raw
  modified_base (553)..(553): a, c, t, g, unknown or other
  misc_feature (553)..(553): n is a, c, g, or t
tcagtctagcgactcacgaccggtgctcgatttagactcgcgcacagagagaagggggctggggtctcaggaggcagcgctctcaggacgtcaccaccatggcctgggctctgctcctcctcaccctcctcactcgagggcacgagggtcctgggcccagtctgccctgactcacgccctccctccgcggtccggtctccgtggactagtcgagtccgccatcctccgtgacctacgtacggaaacctaaattaacgtcggtaacggttttgggtacgttaaacctaaaccgttgttacgtccttccgttacggttaaaccaaacctaactacccgaaggtaacaaacccgaccccctaaactcccgtagttaacttttacgacggtaacggtactaacggtaaccggcccggtacctacgggtaaccggggttcccctaggtaccgtcgtcctttccgtcgtacgggtcctaccgtacgttctacgtaccgaaccgtcccggtcccttccggtaccgtacccgtttcgttaccggtacggtccgttaccggnggttcgtaacgggtacggtacgtttacggggacgtttccttaacggtttaccgttacgtcgggtacctcgtacgttcgaattcgtcggactacggtactagtaacttaaggtttaacggtttgggtacgggtaccgggtacgggtaccacggtacggtaacggtcctacggtaaccggcgtaccggaccgtacggtccgtcccgtacccgtgtccttaccgg

SEQ ID NO: 47722 - DNA, 685 bp, Homo sapiens
  misc_feature: GYAE6OF02J0G2O.40.47.E03.1.454.CMB.1.raw
  modified_base (229)..(229): a, c, t, g, unknown or other
  misc_feature (229)..(229): n is a, c, g, or t
  modified_base (337)..(337): a, c, t, g, unknown or other
  misc_feature (337)..(337): n is a, c, g, or t
  modified_base (390)..(390): a, c, t, g, unknown or other
  misc_feature (390)..(390): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (526)..(526): a, c, t, g, unknown or other
  misc_feature (526)..(526): n is a, c, g, or t
tcagtctagcgactcacgaccggtgctcgatttagactcgcgcacagagagaagggggctggggtctcaggaggcagcgctctcaggacgtcaccaccatggcctgggctctgcctcctcctctaccctcctcacctcgagggcacagggtccctgggcccagtctgccctgactcagccctccctccgcgtccggtctcccgtggaccagtccagtccgccagttccncctgcacgtacggaacctaattaacgtggtacggtttgtacgttaacactatcgtactcgtgtaccaacacgacccaggactaaccgaccccaatccgagtacttagngacgtacgagtacgccggtacccacggtccgggtacctgtatccggtcttcgngttaccggtcctacgtaacgtctcgaccaaccgtccgtccctaccgtntacccgtntccggtaccggcctacggaccgtcgtagggaactacggtggtaaccgtcgttacgtttaacaccgtgaccttgctactancgtacagtacgactacgacttaacttggttcggacggttccggggaaccggtactaccgggttccgtaaaggtacccttaccgggaaccggttcgaacccgtaccggttacccggtacccgttaccccgtaccccccggggtttcgtaaccgttccccg

SEQ ID NO: 47723 - DNA, 713 bp, Homo sapiens
  misc_feature: GYAE6OF02FFI14.40.47.E03.1.454.CMB.1.raw
tcagtctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctcgccctgactcagcctccctcgcgtccggtctcctgacagtcagtcgccatctcctgcactgaaccatatgacgttgtagtacaactatgtctcctggtaccaacaactacccgaggaccaaacgccccccaaactcctagtatttatgtacgttcaaggttaacgccgtcccgtacgaccggggttcccctaggactccgtctttccgtcgtcggccttaccaaggttctacggtaccaaaccgccggtaccccttccccgtagtacccgtcttacggtcgggtaccctaccgacgggcttagggaaggtacgtacggacggttccttacgttttacctacgtcgaccgtacgtccttaccgtaattacgtacgcgtaacgggacctaaggtaacctttaaacggttacgtttttacgggtcgggttttacccggggggaccgggggttaacccaggtaccggtttaccggaaccccgtttaccgtagggttacccgaccggtacccgtaaggtcccgtcccggttacccccgtacgggttacctaacccg

SEQ ID NO: 47724 - DNA, 772 bp, Homo sapiens
  misc_feature: GYAE6OF02JS8HN.40.47.E03.1.454.CMB.1.raw
  modified_base (148)..(148): a, c, t, g, unknown or other
  misc_feature (148)..(148): n is a, c, g, or t
  modified_base (278)..(278): a, c, t, g, unknown or other
  misc_feature (278)..(278): n is a, c, g, or t
  modified_base (487)..(487): a, c, t, g, unknown or other
  misc_feature (487)..(487): n is a, c, g, or t
tcagtctagcgactcacgaccggtgctcgatttagactcgcgcacagagagaaggggctggggtctcaggaggcgagcgctctcaggacgtcaccaccatggcctgggctctgctcctcctcacctcctcactcaggcacagggtccnggcccagtctgccctgactcagcctccctccgcgtccggtctccctggaccagttcacggttccgaccagtcctccgtgaccaccgttggaacctaagtaacgtgtacgtttggtacggttaactaactnttcgttctacccttaggtaacctaacacttaacccaggaccgtaaaccgacccctaaaacctcccttagtaatttacgtagtaacgggtacctaaggtaacgtcccggtaccctggaaccggggtccctgatccgtacttctccgttaggcccttaccgtacggttacctggtaccaaaccgtccggtccctacctccggtaacccgtnttacccgtcggtcctacccgtaggaccgttaggacggtagtaggtacgttccgttaacggtttaccttaccggacgttaccggtaacttccggtactaacgtacgttaccgtaacgccgggtctaacccgtaagttaacgtttaaccgtttaggttccgggttacggggaccggggggtaactaacggtaccgtaccgggtaaccgttaccggtaaccggttaagacccggtttaccggaacgtcccggtacccgttacccccgggtaggtaccccgttaccccg

SEQ ID NO: 47725 - DNA, 811 bp, Homo sapiens
  misc_feature: GYAE6OF02GZIUJ.40.47.E03.1.454.CMB.1.raw
tcagtctagcgactcacgaccggtgctcgatttagactcgcgcacagagagaagggggctggggtctcaggaggcagcgctctcaggacgtcaccaccatggcctgggctctgctcctcctcaccctcctcactcgagggcacgagggtcctgggcccagtctgccctgactcacgcctccctccggcgtccgggtcctccgtggactacggtcagtccgcctattccttcctgcctaccgttacgggaaacctaataacgtagtaccgggtttgggttacggttaaccaacttacgttacgtccgttacgtacggtaacccaaactaaaccgtaccccgaacgggtaaccaaaaccccgaccccctaaaaccttaccgtaggttaattttacgtaaggtaccgggtaccgtaacggtaaccggcccggtaccccgtaccgggtaacggggttcccctaggtaccgttccggtcctttaccggttccgtacgtacctaaccgtaacgtcgttacgtaccgaaacgcccgttccctaccgtacggtccctacgtccggtacggtacctcggtaccgtcgtaggacggtagtgggtacgttcgtttacgtttaactacgtctacggtacgtcgttactaagtccgttagaccggacgtacgtacggtaaagttaacgtttaagggtttccggggtacgggtaccgggggtaacggggtaccgtaggtccggtacccgttacccggttaggtaccggtagtacccggttacgtcgggtacccgttcccccgggtccgttacggtctaccccggg

SEQ ID NO: 47726 - DNA, 729 bp, Homo sapiens
  misc_feature: GYAE6OF02IFNBZ.40.47.E03.1.454.CMB.1.raw
tcagtctagcgactcacgaccggtgctcgatttagactcgcgcacagagagaaggggggctggggtctcaggaggcagcgctctcaggacgtcaccaccatggcctgggctctgctcctcctcaccctcctcactcagggcacagggtcctgggcccagtctgccctgactcagccctccctccgcgtccgggtctccctggacagtcagtcgccatctcctgcacgtggaaccaataatcgtacgttggtggttaaccaactatgtcctcctggtaaccaacaactacccaggacaaacgcccccaaactcctagtatttagtagagtacagtaaggccggtacctgacgggtcctgactcgtcttctcgtggcctacctagtccgttgaccaaccgaccggtccctaccgtcgtacccttcgtaccgtcgggaccctacccgtacggacgtacggtggtagtaggtacgggttcctttaacggtttaccgttacgtcgacctaacggttcgtactaaacggttacgacccggtaagtccggtacgtaaacgtaacccgttaaaagtttaggttttaccgggggtcggtttaccggggggaccgggggtaacccgtaacgtacccgggtaacggtacccgttaccgggtaacgttacccggaaccggtaaccccggtaagtacccgggtacccccggtccccccggttaccgtacccgttaaccccgg

SEQ ID NO: 47727 - DNA, 754 bp, Homo sapiens
  misc_feature: GYAE6OF02JT2B0.40.47.E03.1.454.CMB.1.raw
tcagtctagcgactcacgaccggtgctcgatttagactcgcgcacagagagaaggggctggggtctcaggaggcagcgctctcaggacgtcaccaccatggcctgggctctgctcctcctcaccctcctcactcagggcacagggtcctgggcccagtctgcctgactcagcctccctccgcgtccggtctcctggacagtcagtcgcctatcctcctgccactaggaaccaattaatcggaaggtttggtaggttaaccaacttagtcgtcgtcctacggtaaccaactaactacccgaacggtaccaaaaccgaccccctaaaactccctagtaacttttatacggtacggtaccgaacggttaacgcccgggtcccttacggtacggggttaccccgtggtaacttccgtacgttcctcgttcggccttaaccgagttccgtacgttaaccaccgtacccggtcccttacccgtaccggtacccgtcttacgtaccgggccttaccgcggcgtaggacgtagtacggacggttacgttacgtttactacggtactcgtactcgtactacgtgtacgcgaacggtactagtaacgttaagttacggtttagggttccgggttaccggggacgggggtaccctagggttacccgtacgggttaaccccggttacggttaccgggtaccgttaccgggtacccgtaacggttacccggttcccggtaccccggtttacccggaccttaacccgg

SEQ ID NO: 47728 - DNA, 796 bp, Homo sapiens
  misc_feature: GYAE6OF02J0ALN.40.47.E03.1.454.CMB.1.raw
  modified_base (203)..(203): a, c, t, g, unknown or other
  misc_feature (203)..(203): n is a, c, g, or t
tcagtctagcgactcacgaccggtgctcgatttagactcgcgcacagagagaaggggctggggtctcaggaggcagcgctctcaggacgtcaccaccatggcctgggctctgctcctcctcaccctcctcactcagggcacgacgggtcctcgggcccagtctgccctgactcagcctccctcgcgtccggtctccgtggacngtcagtccgcctatctcctgccacgtaggaacctaataacgtgtacggttggtacggttaactaactatgtcctccgtagtaaccaactaactaccgagacaaaccgaccccaaactcctagtattagtacgacggtataacgtacggcccgtccctacgggaccgggtcccgtagtaccgtacggttccttcttccggtaggaccttacctaaggtttcccgttacgtacctaaaccggcccggtacccttcccggtacggtacccgttacgttcggtccggtacctaccggtacggtacgtagggtacgggtacgtttcgggacgttaccgtttacggtttaaccgttacgtcgtacgtaccggtacttacgtaacttggtaccgtacggaacggttaacaaccgggtaacctttaaacgtttacgggtttacgggtaccggggttacgggggttaacccggggggtaaccgtaacgggtaccggttacccggttaaccggttaccgggtaacggttaccggaacccggttacccgggtaaccggtccgggtttacccccggtaacccggttccgggtacccttacccggg

SEQ ID NO: 47729 - DNA, 763 bp, Homo sapiens
  misc_feature: GYAE6OF02GNMBU.40.47.E03.1.454.CMB.1.raw
tcagtctagcgactcacgaccggtgctcgatttagactcgcgcacagagagaaggggggctggggtctcaggaggcagcgctctcgaggacgtcaccaccatggcctgggctctgctcctcctcaccctcctcactcgagggcacgacggggtcctcgggcccctaggtctcgcccctggacctcacgccctccctcccggccggtccgggtctcctggacctagtcgacgtccgacctatcctccgtgccacgtacggaaccaataactcggtaggttaggtacggttaacaactatcgtcctcgtacgtaccaacactacccgagaccaaccgacccctaactacctatattataggacgtagaggaacgcgtccgtacggcgggtcccgtagactccgtcttacgtcgtcggtcctaccgtacgttcgtcgtaccgaaccgtaccgtcccgtcccgtaccgtcccgtttacgtccggtcggtaccctcggacgggtcgttacggaacggtagtaggtcggtacgtttacgtttaccgttaccgttcctacgtccttagtaacttaggcgtaccgacggtacctaggttacctaaagttttcgggtttaacggttccgggttacgggggtaccggggttaaccgtacggttacccgtaccgggttacccggtaccggttaacggtcccgaaccggttccccggtaaacggtcccgttaccccgggtacccggttcccggttacccttaccgttacccccgg

SEQ ID NO: 47730 - DNA, 789 bp, Homo sapiens
  misc_feature: GYAE6OF02JPR7Y.40.47.E03.1.454.CMB.1.raw
  modified_base (445)..(445): a, c, t, g, unknown or other
  misc_feature (445)..(445): n is a, c, g, or t
tcagtctagcgactcacgaccggtgctcgatttagactcgcgcacagagagaagggggctgggggtctcagggaggcagcgctctcaggacgtcaccaccatgggcctgggctctgcctcctcctcaccctcctcactcgagggcacgagggtcctgggcccagtctcgccctagactcacgcctcccctccggcggtccgggtcctcctggacagtcaacgtcgcctatcctccgtcgacctacgtaggaaaccaataactgggtaaccggttggtacggttaactaactacgtcgtacgtccgtaggtaaccaaactaacgtaacccggagaaccgtaaaccggaccccctaaactacgtaacgttattacgaggtacgctaaggtacgcgtaccctggcgggtaccttagatccgtactcgtagcgtactaccgacgttacncgtaaactacgaccgtccctcccgtagtacccgtctccgggtacgtacccgtaccggtacgtacgtcgggaatacggtaggaacccggttaggtacctttaccggttaacggttcgacctaacgtccggtaatacggtaagtcggaacgtaacggcgtaaacggtaacgtttaaaagttccgggtttaaagggttaccgggggttaccgggggaaaccgggggtaccgtaacggaccggttacccggggttaaccggttaccgggtaaaccggtaccgaacccggttacgtaaccccgggcctttaccccgggtaaccccggtttcgtaccccggttaacccgg

SEQ ID NO: 47731 - DNA, 1100 bp, Homo sapiens
  misc_feature: GYAE6OF02IGIW1.40.47.E03.1.454.CMB.1.raw
tcagtctagcgactcacgaccggtgctcgatttagactcgcgcacagagagaagggggctggggtctcaggaggcagcgctctcaggacgtcaccaccatggcctagggctctgctcctcctcaccctcctcactcagggcacgagggtcctcgggacccaggtctcgccctgacctcgacgtccctcccgtccggccggttccgggtcctaccgtcgggaacaggtaccacggtccgaccattccctccgttaggcctaaacgtacggaaacccctaaaattaaacgtacggttacgggtttacgggttaacggtttaaaacctaaacgttaacgttccggttaacccgttaccgttaaccgggtaaacccaaaaacccgttaaaaccgtaaacccccgaaacgggtaaacccaaaaacccggtaaccccccccgtaaaaaaccttccccggttaaagtttaaacgttttaaccggttaacggaacgggtttaactaaaacgggttaaccgggtacccgggtacccccgtaacgggtaacccgggggttaccctaacggtaccggttcgggttacctttaacccggttcggtacggtcccttaaccgggtaaccgtttcggtttaaaccggtaacccgttaaaccggaaaccccgggtcccctttacccggttaaacccggtaccgggtttccggttaccggtttaaccgggcccgtttacccgggaaggggtaccccgttaacgggaaagggttaacgttaccgggtacggtttacgttttaccgttttaaaccgtaacccgggtttgaaccgtttaccggaccgtttaaacaaactttaggggacccgtaaacgggtaccggtacgggtaaaaccgaaccggtttaaaaagtttaaacggggttttccgggggttaaaccggggttaacccggggggggtacccggggttaaaaccgttaacccggggacccgttttaaccgggaaccccggtttaaccgggtaaacccgggtcgtaacccccgggtaaccgttaaacccgggtacccggttacccccggttaacccccggttccccggttaaaccggttacccccg

SEQ ID NO: 47732 - DNA, 635 bp, Homo sapiens
  misc_feature: GYAE6OF01AM2DM.47.56.F01.1.454.CMB.1.raw
  modified_base (403)..(403): a, c, t, g, unknown or other
  misc_feature (403)..(403): n is a, c, g, or t
tcagagctcacgtacacgaccggtgctcgatttagcagacgtctggtcgtcgggggggagaactggcgtcagttaggacccagacgggaaccatcggaacgccccaggccgcgagccttctcttcctcctgcctactctggctccgagataccgactgggacaaatgagactgacgcagtcctcacgccacctgtcgtgtcgtcgtaccaaggggtaaacgagcccaaccctctccctgcgacgggccaggtaccaggagtagttacgcgagcctaaacttagtcctggtaccaggaccaagaaaccgtgggcaggcctacccaggccctactcattctatgatgcataccacgcggctactggcacgtcccagactaggtcagtacggctaggtcgggtacncggggacctacgtacgttccacttctccgacctactcacgcacggaccctagacgtcctagtaacgttactttggtaactttatactgtacacgtactagacgtagtacggttcgtcggcctccggactacgtacgttcgggaccggtacgggaccggtacgggtacgggacgtacggtaccgtaaaccggtaccgttacgggtacggtcctacggtccgtacccgttaccg

SEQ ID NO: 47733 - DNA, 582 bp, Homo sapiens
  misc_feature: GYAE6OF01DVB8F.47.56.F01.1.454.CMB.1.raw
  modified_base (511)..(511): a, c, t, g, unknown or other
  misc_feature (511)..(511): n is a, c, g, or t
tcagagctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggaggtccgggggaggcttaattcaggccgtggggggtccctgagactctcctgtgcagcctctggattcaccttcagtagttactggatgcacgtgggtccgcaacgctccgagggaaggactggtgtgggtctcgagtattaactcctgatggaagtcgacaacaaactacggcggactccgtaggacgggaccgtacttcgaaccatcctaccgagacgaaccaaccgaccaaagaaaccacgctagtactctacgaacaaagtcgacacacgtctagacgacgccgacgagtcgcggtctagtatgtttcgngtagacgaagagactacgaacgttgggtacggtaacccttagtttaactttcgaggttccggtaccggggg

SEQ ID NO: 47734 - DNA, 562 bp, Homo sapiens
  misc_feature: GYAE6OF01BDA2N.47.56.F01.1.454.CMB.1.raw
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
tcagagctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagccgtggggggtccctgagactctcctgtgcagcctctggattcaccttcagttagttactggatgcacgtgggtccgccaagcctccgagggagggactggtgtgggtctcacgtattaactcctgatggagtcgacaacaaactcgcggactcggtgacgggaccattccaccatcctccagacgacaacgaccaagaacacgctgtactcgtagacaaagtcgacacgtagtcgtagagacgccgagtatcggcgtctgtacttntttcgngtagacgtaagagtactcgaacggttgggtacgggtacccttatttagttcgagggttcggtacggggg

SEQ ID NO: 47735 - DNA, 686 bp, Homo sapiens
  misc_feature: GYAE6OF01AZU19.47.56.F01.1.454.CMB.1.raw
  modified_base (333)..(333): a, c, t, g, unknown or other
  misc_feature (333)..(333): n is a, c, g, or t
tcagagctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaggtgtccagtgtgaggtgcaacgtggtggagtccgggggaggcttaattcgagccgtggggggtccctgagactctcctgtgcagcctctggattcaccttcagtagttactggatgcacgtgggtccgccaagctccgagggaaggggctgggaggtggtctgnggcagttggtggtagtggtgccgaggacactaattacgtaaacgtccctaggccagggccttagtttctttacgtccttaccgagtaacgaacctaattacccgaaggtaactaacgtactagtactttccgtagacgtaggtacgaaccgagtaccgtagaggtacgtaccggaggaacccgtaccggggtaccgttaattagttaacgtttggtaaaggtttaaacggtggggtaaggttcggggttagggtacccgttaacgggttaaccgtccgggtttaccggggggaccccggggtaacccggttcggggtacccgtaacccggtttccgttccccgtttaaccggg

SEQ ID NO: 47736 - DNA, 708 bp, Homo sapiens
  misc_feature: GYAE6OF01ARVUW.47.56.F01.1.454.CMB.1.raw
  modified_base (444)..(444): a, c, t, g, unknown or other
  misc_feature (444)..(444): n is a, c, g, or t
tcagagctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgcttattttaaaggtgtccagtgtgaggtgcaacgtggtgggaggtccgggggaggtcttaattcagccgtggggggtccctgagactctcctgtgcagcctctggacttccaccttcagttagttactggatcgcgtacgtcgggtccaccgaagccgtaccgaaggggaacgggtcgtggggtcggtgggtcctacgtaacgttattaactccgtagagtaggaacgtccgacaaccgaaacgtacggcggtacctccggtaggacgggtacctacttacacccntacctaccgaagacgaacaaccgacaaacgaacacgtctagtactcgtacgaactaaacgtcggaacctaacgtagttccgaaggaacgaaccggacccgaagtacgttccgggtccggtacgttaggttaacttacgttttccgtaggtaccggaaaccgtaaaggtagtaaccggttaccgtaaacgggttccggggttacgggtaacccctttacgttttacggtttaccgggaaggggtttcccggtaaacccggggggg

SEQ ID NO: 47737 - DNA, 801 bp, Homo sapiens
  misc_feature: GYAE6OF01DY78H.47.56.F01.1.454.CMB.1.raw
  modified_base (184)..(184): a, c, t, g, unknown or other
  misc_feature (184)..(184): n is a, c, g, or t
  modified_base (323)..(323): a, c, t, g, unknown or other
  misc_feature (323)..(323): n is a, c, g, or t
tcagagctcacgtacacgaccggtgctcgatttagcagacgtctgtcggcggggaggaactgctcagttaggacccagacggaaccatcggaacgccccagcgcagcttctcttcctcctgctactctggcctcccagataccactggagaaatagagatgacgcagtctccagccacctgtcngtcgtctccgagggaactcgccacccgtctcctgccagggccagtcagagtattagctaagcgtaaacttgccgtaggtaccaggtcaacggaaacctgggcaacggcctcccgaggcctcctcgatcctagtcggtancactccaccgaggtccctacgtacgggtacctacccgaggtcccgtaaggtttccgacggttaccgggctaacgggttcggggtacccgttacgggaaactacgggtaaccggtttccgtaaaccggtcccgtttaccgaaccccgtaagttaccgaacggtaccgtaaccggtccgttaccgggtaacccgtaacggtttcccgtagggtaaacccgttaggttttttacgaaccggttaaacgtttttaacgttacggttacgttacgtaacggttaccggtaaaggtttaaactaaccgtttaaccgggtacccggtacccgttaccggtaccgtttaccggggtaacccgtaaacggggtaccctaaccgggtaaccggttagggtaaccggttaaacggttaaaaccccggtcgttacggttaccgtacccggttacgtacccggaacccttacggttccgtcggtttaaccc

SEQ ID NO: 47738 - DNA, 632 bp, Homo sapiens
  misc_feature: GYAE6OF01DYJJF.47.56.F01.1.454.CMB.1.raw
  modified_base (279)..(279): a, c, t, g, unknown or other
  misc_feature (279)..(279): n is a, c, g, or t
  modified_base (559)..(559): a, c, t, g, unknown or other
  misc_feature (559)..(559): n is a, c, g, or t
tcagagctcacgtacacgaccggtgctcgatttagcagacgtctgaacacacaaagggggccccagccctgggattcccagctgtttctgcttgctgatcaggactgcacacagagaactcaccatggagtttgggctgagcttggtttttccttgttgcttattttaaaaggtgtccagtgtgaggtgcaacgtgggtggaggtccgggggaggtcttaattcagccgtggggggtccctgagactctcctgtgcacgcctcgtggtacttcaccttnagttagttactggatgcacgtcgggtccgcaagctaccgagggagggcgtgggtgtgggtctcgacgttattaactctgagtaggacgtcgacaacaaacgtcgacggtactccgaggacgggaccgacttaccgactactcctaccgagaacgaaccaaccgacaaacggaacacgtctagtactctacgacaaacgtcgactacgagtctaggacggacgcccgtaagtgtacgtcggtattaggttaacttcgtttcgaggtacgacgtaaaggtanacgttacgaacggttggggaaccgggttaaccctttaagttttacggttccggagggttccggtacccggggg

SEQ ID NO: 47739 - DNA, 660 bp, Homo sapiens
  misc_feature: GYAE6OF01BD0AY.47.56.F01.1.454.CMB.1.raw
  modified_base (133)..(133): a, c, t, g, unknown or other
  misc_feature (133)..(133): n is a, c, g, or t
  modified_base (378)..(378): a, c, t, g, unknown or other
  misc_feature (378)..(378): n is a, c, g, or t
tcagagctcacgtacacgaccggtgctcgatttagcagacgtctgtcggtcggggggagaactgctcagttaggacccagaccggaaccgattggaaggcccctagcgtcagcttctcttcctcctagctacnctggcctacccagataccactgggagaaatagagagtgacgtctagtctcctagtacccacctgtctgtgtcctccgaggggaaactcgcctacccgtctccgtggcacgggccagtcgaggtactatcactcctactgcctgtaccacagaactgtacacgcctaccagctacctcacttctagtcgatcgcctacgtaccgacgacgggcctacgtcggctacctccccgagtacgtcggtanaggtcgacgaggtcggtactacgggactagtacctttcaccgtcgtaccgtacctacgtacacgtaccacggtacctacggtaacgtaccgtaaggtaacgttaccgtttacggttaaccgtttacttaccgtgacctagaccgtaggtcgtagtcgtccggtacgggtccctacggtccctacgtaccgttcgggacggtacggtacggtagggtacgaacgtacgtacgaaacggtaccgtagggtacggtaccgtacgaccgtaacctatccgttaacg

SEQ ID NO: 47740 - DNA, 544 bp, Homo sapiens
  misc_feature: GYAE6OF01BG2ZB.47.56.F01.1.454.CMB.1.raw
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
  modified_base (529)..(529): a, c, t, g, unknown or other
  misc_feature (529)..(529): n is a, c, g, or t
tcagagctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccgagggaagggactggtgtgggtctcgacgtattaatcctagatggaagtcgacacaaactacgcggactccgtggacgggaccgattcaccatctcagagacaacgccaaagaacacgctgtatctgacaaatgacacagtctagaggacgcccgagatggcggctggtatntttctgtgacaaagngatcaaacgttgggtacgggtaccgttactttatttcgnggttcggtaccgggg

SEQ ID NO: 47741 - DNA, 807 bp, Homo sapiens
  misc_feature: GYAE6OF01DYD7Z.47.56.F01.1.454.CMB.1.raw
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
tcagagctcacgtacacgaccggtgctcgatttagcagacgtctgtcggcgggggaggaactgctcagttaggacccagacggaaccatggaagccccagcgcagcttctcttcctcctgctactctggctcccagataccatcggagaagttgtgttgacacagtctccagccaccctgtctttgtctccgaggggaaancgccaccctctcctgcagggccagtcagaatattcactcctacttagcctgtaccaanagaacctggtcagctccgagctcctcatctatgatgacatccaaacgacgggcccaacgtgggacctaactaccccgaagtaaccgtacgggtttacaaggttggaccgtaagggttgggggtccgtagggggaacctaacggtacccttttaccgaaccttcccgtacctaaacccctaagttacccgaagggacctaaaccggtacccgttaaagggacggtaaccccgttaaggtaaacggttaaaccgtttttaagggtaaccctttttttaaacgtttaccgtttacggtaccgtaacggtaccgtaaacgggtccggttacgggttacggtttccggtaccgggtaccccgttcccggtaccgttacccgttacccgggttttcccgggggaaccggggttaaccggggtaaacccgggtaaggggggtacgggtaacgggtaaacgttaaacccggtaaaaaccgggttacgttacgggtaaccgggtccgttaacgacccgtaaaccgttaccgttaccgtttcggttccgtttaacccg

SEQ ID NO: 47742 - DNA, 601 bp, Homo sapiens
  misc_feature: GYAE6OF01CBTYB.47.56.F01.1.454.CMB.1.raw
  modified_base (300)..(300): a, c, t, g, unknown or other
  misc_feature (300)..(300): n is a, c, g, or t
  modified_base (397)..(397): a, c, t, g, unknown or other
  misc_feature (397)..(397): n is a, c, g, or t
tcagagctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgcttattttaaaaggtgtccagtgtgaggtgcaactggtggaggtccgggggaggcttaattcagccgtggggggtccctgagactctcctgtgcagcctctggattcaccttcagttagttactggatgcacgtcgggtccnccaagctaccgaggggagggctgggtgtgggtctcacgttattaatcctgatggaagtcgacacaactacgcgactccgtgacggaccgatacaccntctcgagagaccaacgccaaagaccacgctagtactctagacaaatgaccacgagtccaggaacgacggacccgagtagtcggccgtacttgttattagtttcgtagtagaccgtaaagtagattaccgaaacggttggggttaaccgggttaacccgttaactttttaaggttccggtacggggttccgggtaacccgggggg

SEQ ID NO: 47743 - DNA, 904 bp, Homo sapiens
  misc_feature: GYAE6OF01BOR98.47.56.F01.1.454.CMB.1.raw
tcagagctcacgtacacgaccggtgctcgatttagcagacgtctgaacacacaaagggggccccagccctgggattcccagctgtttctgcttgctgatcaggactgcacacagagaactcaccatggagtttgggctgagtctgggttttccttgttgcttaattttaaaggtgtccagtgtgaggtgctaacgtgggtggacggtccgggggaggtcttaaagttccgacggtccggttcggggggtccctggacgtaccttccgtcctggtcgcgacggtcctcgtggactttccgtaccttcgtaggttacgttacgtggtactgacctacggtcgggtcccgaccgtaaacgtcccgtaccggaaggggtaacgggtaccgttggggttacgggttccgggttcttaccgtaacggttttaaacgtttaaccgttcccgttaggtaacggttcgggtaaccgttaaggtttaacgttttaaaagtttaaaaggttttacggtacgggtaacccgggttacccgttaccggggtacggggtaccgggggtacccgttacgtttacggacgtaccgtaccgtttaccgacccggtaaaggaacccggtaaccgaaaccgggtaccgtaaaagggttacgttaaacgttaccggttaagttaacgttaaccgtaaaggggtaaaccttaagaaccgttaagtacgtaggtaaccgtacggttaaccggaacgtacgttacggtaccgttagtacttagtacgtttaggtttacggttttacgttttacggaaccgtttccggttaccccgggtttcccgggccccgggttaccgggtttacccggtttaccggggacccggggtaacccggtaaccggggttaccccgttcggggtaacccg

SEQ ID NO: 47744 - DNA, 618 bp, Homo sapiens
  misc_feature: GYAE6OF01AH3B2.47.56.F01.1.454.CMB.1.raw
  modified_base (289)..(289): a, c, t, g, unknown or other
  misc_feature (289)..(289): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (373)..(373): a, c, t, g, unknown or other
  misc_feature (373)..(373): n is a, c, g, or t
  modified_base (418)..(418): a, c, t, g, unknown or other
  misc_feature (418)..(418): n is a, c, g, or t
tcagagctcacgtacacgaccggtgctcgatttagcagacgtctgaacacacaaaggggccccagccctgggattcccagctgtttcctgcttgctgatcaggactgcacacagagaactcaccatggagtttgggctgagctgggttttcctgttgctattttaaaggtgtccagtgtgagtgcaactggtggagtccggggagcttaattcagcctggggggtccctgagactctcctgtgcagcctctggattcaccttcagtagttactggatgcacgtggtccncaagctccgagggacggctggtgtggtctnacgtattancctggatcggagtcgcaacgaactcggcgactccgtgacgggacntcacatctcagacacaacggaccaagaaccacgctagtactcgtnacgtaaatgaccactaggtaccgttaggacgtaacggcccgaacggtacgtcggtaccgggacttacggttaacgtttacgtttaccgttaggttacgaaccgtaaaggtacgtaacgttaccgtaacggttacggggttacggggtaacccgtttaactttttaaggtttaccgtaggggtttcccggttaccgggggg

SEQ ID NO: 47745 - DNA, 696 bp, Homo sapiens
  misc_feature: GYAE6OF01EZANM.47.56.F01.1.454.CMB.1.raw
  modified_base (151)..(151): a, c, t, g, unknown or other
  misc_feature (151)..(151): n is a, c, g, or t
  modified_base (288)..(288): a, c, t, g, unknown or other
  misc_feature (288)..(288): n is a, c, g, or t
tcagagctcacgtacacgaccggtgctcgatttagcagacgtctgtcggcgggggaggaactgctcaggttacggacccagacggaaccatggaagccccagcgcagcttctcttcctctgctactctggctcccagactaccacgtgganaaatagagatgacgctagtctccacgcccacctgtctgtcgtcctaccgaaggggaacacgcccacccgtctccgtcgcgacggccagtcagtagtatacgcagactaattacgctacggaccagacaacgaaccgnggacaggcctccgacggtccttcctctacgtcgtagtcgggtcactacgaccgacggacggtccacgttagtacctcccgagtccgtacggtacgtgtcggcgtcggttcggtacgacgggtacgtaacggtacttacccgtacgtccgtaccgaactacgtacgtaccgtacgtacgtcgtacgtcgtaacgttcgtaagtacttacgttacgttaacttaacgtttacttacgtacgtacgtaacgtaacgttaacgtaacttaacgtaacgttcgtaccgtttaacgtccgtacggtaaccggtaacggtaccgtaacggtaccgtaacgggtaacttaaccggttaaacggacgtacggttaccgaccggttacgtaaccgtacgttacttcggtacgttaccg

SEQ ID NO: 47746 - DNA, 661 bp, Homo sapiens
  misc_feature: GYAE6OF01BGORM.47.56.F01.1.454.CMB.1.raw
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (323)..(323): a, c, t, g, unknown or other
  misc_feature (323)..(323): n is a, c, g, or t
tcagagctcacgtacacgaccggtgctcgatttagcagacgtctgtctcgggggaggaactgctcagttaggacccagacggaaccatggaagccccagcgcagcttctcttcctcctgctactctggcctcccagataccactggaagaaatagagatgacgcagtctccagcccaccctgtctgtntctccgaggggaaancgcccacctctccngcgagggccagtcagagtatagcagctaactgcctggtaccagacaacggtaaccgtgggacacggcctcccgacggtcctccgtacacgttcttagtcgggtacncctacgtaccccgaccggacgggccctaacgttcggtacctccccgagacccgttaggtccaggtcggcgtagggttcgggtcgtaggggactaggtcgtactaccgtctaccgacctatccgacgacacgtcctcgactagtcgttagtaacgtttatttacgaactttaattttagtacccgttagtacgaagtaaccttaagttaaccttaagtaaccgttcggaccttacggtaccgttacgggaaccgtaacgggcctaaccgtacgtaaggtaacgtaacgttaacggaccgttgacggtacgtaccgtaacaccttcggtccttggttacc

SEQ ID NO: 47747 - DNA, 846 bp, Homo sapiens
  misc_feature: GYAE6OF01DE2TB.47.56.F01.1.454.CMB.1.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (376)..(376): a, c, t, g, unknown or other
  misc_feature (376)..(376): n is a, c, g, or t
tcagagctcacgtacacgaccggtgctcgatttagcagacgtctgtcggcggggaggaactgctccacgtttaggacccagacggaaccatggaagccccagcgcagcttctcttccctcctgcttactctggctcccgagtacgaccctgtaggaagtaaagttgtgtacgtacggaaccgttacgaacgttcctccgacgtccctaccgttgtctcgttacnccgtacggaagggaaacgcgaccactcgtcctccggtgggtacgggtcccgtanaggtaacgttntacgcttaactacgtaaacttcgccgttagtaccacgaccagaacggtaccgtgggccaacggtcctaccccgagtccctcccgtanctacgttagcgtaggtccgtacccgtaccgaacggtcggtcccttacggtttaccggtaccccgtaaagcccggttaaggtacgtacgggtacgtaacggtaacggttcgtacggttaccgttaacggggaacttaacgggttacgttttacccgaaccgtttaccggaacccgtaaactacgttaaacccgaacccggtacccggttaccgtacggtaaccgttaacgttaccgttaaacggttaaacgtttaaccggtttttaccgtaacgtttaaccggtttttaactacgtttaccgtaacggtaactccgttaaacgttacgttactaaaccgttaacgtccgggtacccttcgtaccttacccgggtacgttaaccggaacggtaccgttaacggtacgtaacggacgttaaaccggtaacgacgttgaccggtaacgtcggtaaccgtacgtgttccggtacg

SEQ ID NO: 47748 - DNA, 808 bp, Homo sapiens
  misc_feature: GYAE6OF01DXEHQ.47.56.F01.1.454.CMB.1.raw
  modified_base (201)..(201): a, c, t, g, unknown or other
  misc_feature (201)..(201): n is a, c, g, or t
  modified_base (550)..(550): a, c, t, g, unknown or other
  misc_feature (550)..(550): n is a, c, g, or t
tcagagctcacgtacacgaccggtgctcgatttagcagacgtctgtcggcgggggaggaactgctcagttaggacccagacggaaccatggaagccccagcgcagcttctcttcctcctgctactctggctccagataccactggagaaatagagatgacgcagtctaccagccacctgtctgtgtctacgaggggaaacncgcccaccgtctccgtgcgacgggccagtcaaggtacgtagttacgacagtacctaacgttacgccgttacggtaaccagccgaaacggtaaacccgtggggacctagggccctccgaacggtcctcctacgtatccgtagtcgggtacgctacctaccgaaccggtacgggacccttacggtacggttacctaccccggacgtaccgttagggttcgaacgggtcgggtacgtggggttcggggtaacggtcgggaacgttaaggtaccggttcaccgttaccaccgaaccgtagtccgaacgtaccgtacgtcccgtcgaacgtacggtacgtaaaggtaacgtttntttaacggtactttaacgttttaacttacgtcgtaacgtacgttaacgtaggtttaaactttaaccggtacggttaccgttcccgttacggtaacccgggtttaccgggaacccggttaaagggtccgtaaaaccggtaaccgggttaacggggtaaaacgttaaaaacccggttaaacgggttacccgggtaacgggtttccgaaaaccggttcccgtaacccgttaacgtttaccgttcgttttccgtttaacccg

SEQ ID NO: 47749 - DNA, 807 bp, Homo sapiens
  misc_feature: GYAE6OF01AM2RL.47.56.F01.1.454.CMB.1.raw
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (362)..(362): a, c, t, g, unknown or other
  misc_feature (362)..(362): n is a, c, g, or t
  modified_base (475)..(475): a, c, t, g, unknown or other
  misc_feature (475)..(475): n is a, c, g, or t
tcagagctcacgtacacgaccggtgctcgatttagcagacgtctgtcggcgggggaggaactgcgtcagttaggacccagacggaaccatggaagccccagcgcagcttctcttcctcctgctactctggcctcccagactaccactggagaaatagagatgacgcagtctccacgccaccctgtctgtntcctccgagggaacncgcccaccctctcctgcgacgggccagtcagtacgtattacgccgagacctaacttacgcccgttagggtaacccaggtaccgtaaacggtaaaccggttggggacctacggtccctacccgaaggtcctacccgtcaacttccgtaagtggtaccnccgtactacccgacgtacgggaccctacgtacggtaacctccccgacggtccgtacgggttacacggttacggcttacgggttacggttcgagggactaaggtcgtttacccncgttaccgtaccacccgtaattccgaacggtccgtaaccgtccgttacggacttaccggtacgttaaggttaaacggttcttttacgtaacgtttaaactttttacgttaacgttaccgataacggttaacgttacgttaaaacttaccggttaaacctccccggggtaaactttcccgggtaccgtttaacccggaaccggtaaaccgggtaccttaccggaaagggtttaccggtaaaccggttaaaacgggtttaaacccgtcggtaccggtttacggaaccctttaccgggaccttaaacccgtacgtttcgtaaccccggttttccc

SEQ ID NO: 47750 - DNA, 830 bp, Homo sapiens
  misc_feature: GYAE6OF01CLY8Z.47.56.F01.1.454.CMB.1.raw
  modified_base (154)..(154): a, c, t, g, unknown or other
  misc_feature (154)..(154): n is a, c, g, or t
tcagagctcacgtacacgaccggtgctcgatttagcagacgtctgtcggcgggggaggaactgctcagttacggacccagacggaaccatggaacgccccagcgcagcttctcttcctcctgctactctggcctcccagactaccacgtggaanaaatagagatggacgcacgttcctaccacgcccacctgtctgtacgtcctaccggaaggggaaacaccgccctacccgtcctccgtcgacgacgggccagtacgagtaagttactacgacacgtaactaacgttcgaccgttacgaacccaggaaccgaacgtaaaccgtcgggaccacgggtccctaccgacggtcctaccgtacacgtttcgtaacggtcgtacgacctaccgtaccccgaacgggaccggtcccgttaaccgtttccggttacccaacggttcccgtaggtaccagggtcgacgttacggtcggtaccgtcggtaacgggacgttacggttaccgttccacctttacccgaacctaacctaacctaaccggaactacggtacccgtagtaccgtaacgttacgttaagttaacgtttgtttactaacgtttaagtttacaacttcggtacgtagtaacgttaacttcctaaacgttacgtacccggtgaccccgtttacgtaacccgtttacccgtaacggaaacccgggtaacggtaaccgttaaccgggaacggttaaaccggaaacggtttaaaacccgttaaacggtacccgggttacggtaaccggtttcccaaaacccggtccctttacggtaaaccgttttccgtttaaacccggg

SEQ ID NO: 47751 - DNA, 762 bp, Homo sapiens
  misc_feature: GYAE6OF01BVS4W.47.56.F01.1.454.CMB.1.raw
  modified_base (551)..(551): a, c, t, g, unknown or other
  misc_feature (551)..(551): n is a, c, g, or t
  modified_base (650)..(650): a, c, t, g, unknown or other
  misc_feature (650)..(650): n is a, c, g, or t
tcagagctcacgtacacgaccggtgctcgatttagcagacgtctgaacacgacaaaggggccccagccctgggattcccagctgtttctgcttgctgatcaggactgcacacagagaactcaccagtggtaggtttggctgagtcgttgggtttttccttgttgtactttaagttttaaaggtcgtcgaggttgtgtaggtgacgtaacggttgggtaggtacgggtccggggagtacttaagttccgacggtccggttcgggggtccctaggacggtaccttccgttccgtggtcgaccgtacgtccgttcggttacggtactttcctaccgtttacgtaagttacgttacgtaggtacgttcgccgtacggttccggtaccgacgtacgtaccgtacggaggggtaacggtacgtgggttcggtacggtctacgtacgttattacgtcgtagtagtacgtacgtcgacaacgtaacgtccgacggccgtacggcgaacggtcctacttcaactcgttcgaccgagaacgaacaaccgactaaacgtacncgtacttagacgtcgtaactactaaacgcgtacaaggtctacgaggtaccgaccggtccgaagtgtaccggtcgtgttaccttagttacgttcggtaanacggtaacgtaaagttccggtaaaccggttaccggtacgggttggggttaaaccccgttaacgtttttacggtttaccgtacggggttcgggtccgggttaaaccccggggg

SEQ ID NO: 47752 - DNA, 664 bp, Homo sapiens
  misc_feature: GYAE6OF01DY78F.47.56.F01.1.454.CMB.1.raw
  modified_base (212)..(212): a, c, t, g, unknown or other
  misc_feature (212)..(212): n is a, c, g, or t
  modified_base (351)..(351): a, c, t, g, unknown or other
  misc_feature (351)..(351): n is a, c, g, or t
  modified_base (444)..(444): a, c, t, g, unknown or other
  misc_feature (444)..(444): n is a, c, g, or t
  modified_base (629)..(629): a, c, t, g, unknown or other
  misc_feature (629)..(629): n is a, c, g, or t
tcagagctcacgtacacgaccggtgctcgatttagcagacgtctgtcggcgggggaggaactgctcagttaggacccagacggaaccatggaagccccagcgcagcttctcttcctcctgcctactctggctcccagatacccactggagaaatagagatgacgcagtctccagccaccctggtctgtgtctcgaggggaatagccaccttncctgcagggtccagtcagagtatgctagcctaacgttgcctggtacagcagtaaaccgtggcaggtcctcccgaaggtcctaccgtcaattccagtggtcgcaatccaccgagggtccacgtgtactcccaggtaccgnggttcacgtggacgaccgggtgggttcgtggggaacctagggtccgtttacacgttacctcgaaccgtaatcgaacgttccgaagtcccgttnacccggtagttctaggaacgttacttttagaccgtaattttcggtaactcgtacgttaagcgttaagtaactaacgtaacgttcgggtacccctaaggttcccgtacggtaacccgaaaagggtccaaccggtaccgttagggtaccggtaaaattacccgggtaaatcgggtaaccgtaaccgngtttaaccgggaccctggtaacccttggttacccc

SEQ ID NO: 47753 - DNA, 899 bp, Homo sapiens
  misc_feature: GYAE6OF01CBMMW.47.56.F01.1.454.CMB.1.raw
tcagagctcacgtacacgaccggtgctcgatttagcagacgtctgaacacacaaagggggccccagccctgggattcccagctgtttctgcttgctgatcaggactgcacacagagaactcaccagtggagtttgggctgagtcgttgggtttttcctttggttgcttaagttttaaaaggtgtccagtgtgtaggtgacaacgtgggtgggacgggtccgggggaggtacttaagttcgacggtccggtcggggggtccctggacgtacgttccttcctggtgccacgtcctgttggtacttcctacccgtttcgtaggttacgtttacgtggtatcgccgtacggttcgggtcccgaccgaacggtcccgtaccggaagggggtaacggggtaccgttggggtcgggttacggggttaccgtaccgttaaagtttaacgtttaacgtccgttaggtaacggtacgggtaaacgtccgtaaccgaaaaccgtaaaaccgttaccggacccgggtacccgttccgggtacgggtaacgggaacccgtacgttaccccgaacctactacccgttacctaaacgaaccggaaccgtaaaccccgacgtaaaaaccggtacccgacccgttaacgttacggtaactttacccgtagtaaagttaaacccgcggtaacctaacggtacggtttcgaaggtaccgggtaccggaaccccggtagtacggtacggtcccggttagtttaaggttactttacggtttttccggaggtaacccggtaaataacgggtaaacgttcggttaacccgtaacggggttcgggggttaaacccggttaaccccgtttttaaagtttttacgttacccggggtaaggggtttccccggggtaaacccggggg

SEQ ID NO: 47754 - DNA, 710 bp, Homo sapiens
  misc_feature: GYAE6OF01BOWJR.47.56.F01.1.454.CMB.1.raw
  modified_base (151)..(151): a, c, t, g, unknown or other
  misc_feature (151)..(151): n is a, c, g, or t
  modified_base (230)..(230): a, c, t, g, unknown or other
  misc_feature (230)..(230): n is a, c, g, or t
  modified_base (293)..(293): a, c, t, g, unknown or other
  misc_feature (293)..(293): n is a, c, g, or t
  modified_base (353)..(353): a, c, t, g, unknown or other
  misc_feature (353)..(353): n is a, c, g, or t
tcagagctcacgtacacgaccggtgctcgatttagcagacgtctgaacacacaaaggggccccagccctgggattcccagctgttctgcttgctgatcaggactgcacacagagagctcaccatggagtctgggctgagcgtggttttctnttggcttcttttaaagtgtcctagtgtgagtgcaggtagtggcggtccggggagtccttagttcagcgtggggatcccngagtcctctctgtgtcgtcttctaggtaatcgtagtttcacgttccttcgaggtactggaccncggttcgggtaccaacccgtaagtacccgagggtaacggtcgtagggtgtacggtcttanacgttactactaacgtctaggactcggactaggtttacgttaaagtaacttggtacggaccgtaccgtccgggtaggacggggtaccctagttgaacgtctatacctacgagaacgaacgaaagtcgaaagtagtaattacggtacgtaacgtacggtaacggtaatacgtaaaccgtaattcccgtaaggaccggtaacgtaccttaaccggaagttaccgtcgtacgttaacgtatttaccgttaagtttttccgtacggtttaacctttccccgggtacccggtttacccggttcggggttaacctttacggggacccggttaaaccgacccgggttaaccgttccggtaaccg

SEQ ID NO: 47755 - DNA, 514 bp, Homo sapiens
  misc_feature: GYAE6OF02ILS7G.47.56.F01.1.454.CMB.1.raw
tcagagctcacgtacacgaccggtgctcgatttagcagacgtctgaacacacaaaggggccccagccctgggattcccagctgtttctgcttgctgatcaggactgcacacagagaactcaccatggagtttgggctgagcgtgggtttccttgttgctatttaaaaggtgtccagtgtgaggtgcaactggtggagtccggggaggcttaattcagcctggggggtccctgagactctcctgtgcagcctctggattcaccttcagtagttactggatgcactgggtccgccaagctccaggggagggactggtgtgggtctcacgtattaatcctgatggaagtcgcacaaactacgcggactccgtgagggaccgattcaccatctccagagacaacgccaaagacacgctgtatctgcaaatgcacagtctgagagccgacgatgcgctgtatatttctgtgcaagagatcaacgtggtagggaccgtatttagttcagggtctcggggg

SEQ ID NO: 47756 - DNA, 382 bp, Homo sapiens
  misc_feature: GYAE6OF02GMRBU.47.56.F01.1.454.CMB.1.raw
  modified_base (356)..(382): a, c, t, g, unknown or other
  misc_feature (356)..(382): n is a, c, g, or t
tcagagctcacgtacacgaccggtgctcgatttagcagacgtctgtcggcggggccgattcaccgtctccagagacaattccaagaacgacgcctatatttgcaaatgaacagcctgagacctgaggacacggcctgtgtattacctgtacgagaccttatggcggggactactttgactactggggccagggaaccctggtcaccgtctcctcagcctccaccgaagggcccatcggtcttcccccgtggcaccctcctccaagagcacctctgggggcacagcgccctgggctgcctggtcaaggctacgttccctacgtgagctcgtggagcgggctgggcaaggcgcatagnnnnnnnnnnnnnnnnnnnnnnnnnnn

SEQ ID NO: 47757 - DNA, 737 bp, Homo sapiens
  misc_feature: GYAE6OF02JEPQK.47.56.F01.1.454.CMB.1.raw
  modified_base (263)..(263): a, c, t, g, unknown or other
  misc_feature (263)..(263): n is a, c, g, or t
tcagagctcacgtacacgaccggtgctcgatttagcagacgtctgtcggcgggggaggaactgctcagttaggaccagacggaaccatggaacgcccagcgcagcttctcttcctcctcgctactctggctcccagataccactggagaaatagagatagacgacagtctccacgccacctcgtctgtcgtctcgagggaagacgaccacctcctccgtcgcgacgggaccgacgtacgaacgacgtacgttacgacgacganacgtaacgtacgtaccgtacgtacgaacgacaggaaaccctaggggaccaacgggaccgtacccgaacgggtaccgtaccgtaccgtaacgttaccgtaacgttacggtacgtaccgtaacgtaccgaaccgtaacgggtaccgtaacgtacggtaacgtacccgtaacgtaccgtaacggttaccgtacggtacggtacgtacggtacggggtacgtacgggtaacgtacggtacgttacgtacgtaccgtacgtaccgtaacgtaccgaacgtacgtacgtaccgtacgtacgtacgtacgtacgtaacgtacgtttacgtactaactttacgttaacgttacgtacgtacgtacgtaacgtaacgttaactaacgtacgtacgtacgtacgtacgtacgtacggtaacgtacgtacgtaacggtaacgtaacgttaacgtaacgtaacgtacggtacgtacgtacgtaacg

SEQ ID NO: 47758 - DNA, 620 bp, Homo sapiens
  misc_feature: GYAE6OF02IPTMS.47.56.F01.1.454.CMB.1.raw
tcagagctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagccgtgggggtccctgagactctcctgtgcagcctctggattccaccttcagttagttactggatgcacgtcgggtccgaccaagcctaccgaaggggaacgggacgtgggtgtcgggtctcgtacgttattaactccgtgagtaggaagtcgacaacaaacgtacgcggtactccgtggacgggaccgattccaccactcctaccaagacgaaccaacgaccaaagaaccacgctagtactcagaactaaagcgacacagtctagacgagcccgaagtatggcgtcttaggttaacttcgtttcgtggtacgacgtaaaggtagtaacttaccgaaacggttggggtaacggtaacccgtttaccgttttaaggttccggtagggtttccgtaccggggg

SEQ ID NO: 47759 - DNA, 587 bp, Homo sapiens
  misc_feature: GYAE6OF02ILV4S.47.56.F01.1.454.CMB.1.raw
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
tcagagctcacgtacacgaccggtgctcgatttagcagacgtctgtcggcgggggaggaactgctcagttaggacccagacggaaccatggaagccccagcgcagcttctcttcctcctgctactctggctccagataccactggagaaatagagatgacgcagtctccagccacctgtctgtgtctccgaggggaaancgccacctctcctgcagggccagtcagagtatagcagcaacttagcctggtaccagcagaacctggcaggctccagctctcatctatggtncatccacgaggccagtgtactcccagccaggttcaggtgcgaggtcggcttgggactaggtacgttcaaccgttctccgaacctatcacggccacgcctgactagtctaggtaagttactttaggactttaagttttactacgttgtcgtaagtactaagttaaattaacttaacggtcggtccttaccgtcggttaccggaacccgaagggtacctacggaccgttagggaacgtaaacggttaaaccgtaccgtaggtaccggttcgacgtccaaccgtacttcgtacgttaccc

SEQ ID NO: 47760 - DNA, 715 bp, Homo sapiens
  misc_feature: GYAE6OF02IA994.47.56.F01.1.454.CMB.1.raw
  modified_base (201)..(201): a, c, t, g, unknown or other
  misc_feature (201)..(201): n is a, c, g, or t
tcagagctcacgtacacgaccggtgctcgatttagcagacgtctgtcggcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaangcccacctcctcctgcgacgggccagtcagagtattagcagcaacttagccttaggtaaccagcaacgaaaccgtgggacctaggcctcccgaggcctccgtacacttctaagtcggtcgaccactacccgaaccgacgggccctaacgttcggtacctccccgagtaccctagggttcaacggtcggacgtagggttacgggtacgtaggggactaaggtacgttaccgacttccgtacctaccgtataccgtacgaccgacgtcccgtaggacctagtacgtaaggtaaacgtttgttttacggaacttttaaacttttaacgtttaacgttcgttacgaacgtaccgtaaagtttaacgtaaacgttaaccgtcggtaccgttaccgttacgttacccggaaccgttaacgggactaacggtacggtacggtaaataaccggttaaaacggtacggttacggtacggtccgtacggtacccgtaaccgtacgttaccttacggtttacccg

SEQ ID NO: 47761 - DNA, 747 bp, Homo sapiens
  misc_feature: GYAE6OF02JKRX9.47.56.F01.1.454.CMB.1.raw
  modified_base (632)..(632): a, c, t, g, unknown or other
  misc_feature (632)..(632): n is a, c, g, or t
tcagagctcacgtacacgaccggtgctcgatttagcagacgtctgaacacacaaagggggccccagccctgggattcccagctgtttctgcttgctgatcaggactgcacacagagaactcaccatggagtttgggctgagtcgttgggttttccttgttgtcttaagttttaaaaggtgtccagtgtgaggtgcaacgtgggtggaggtccgggggaggtcttaagttcgacggtccggtcggggggtcccctggacgtacctcgtccgttggtcgccgacgtcctacgtcggtacttcctaccgttctaggttacgttacgtggactgtcctacgtcgggtccgaccgaacgtccgtaccggaaggggtaacgggtacgtgggtcggtcgggtcctacgtacgttattaacgtccgtgtagtaggtaacgtccgacgaacgtaaaccgtccggaccggtaccgtaccggtaggaaccgggtaccgtacttaccgactacgtacccgtacgaacgtaacgaacctaaccggaacgtaacgaacaccggtcttagtactaccaggaacctaaacggcaccgaacttacggtactacggacggacgacccggtaagtacgtcgggtaaccgtnttaacgttagttaccgtttctaggtacgaagtaacggtaataccgttaccggaacggttcggggtaacccgttaactttacgtttacggttacggagggttcccgtaaccggggg

SEQ ID NO: 47762 - DNA, 641 bp, Homo sapiens
  misc_feature: GYAE6OF02GUDAD.47.56.F01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (277)..(277): a, c, t, g, unknown or other
  misc_feature (277)..(277): n is a, c, g, or t
  modified_base (365)..(365): a, c, t, g, unknown or other
  misc_feature (365)..(365): n is a, c, g, or t
  modified_base (461)..(461): a, c, t, g, unknown or other
  misc_feature (461)..(461): n is a, c, g, or t
  modified_base (469)..(469): a, c, t, g, unknown or other
  misc_feature (469)..(469): n is a, c, g, or t
  modified_base (491)..(491): a, c, t, g, unknown or other
  misc_feature (491)..(491): n is a, c, g, or t
  modified_base (513)..(513): a, c, t, g, unknown or other
  misc_feature (513)..(513): n is a, c, g, or t
  modified_base (533)..(533): a, c, t, g, unknown or other
  misc_feature (533)..(533): n is a, c, g, or t
  modified_base (632)..(632): a, c, t, g, unknown or other
  misc_feature (632)..(632): n is a, c, g, or t
tcagagctcacgtacacgaccggtgctcgatttagcagacgtctgttcggtcgggggagaactcgacgtcacgttacggacccgagacggaacccaagtcggaaaccgccccagcgcacgtctttccctccctttccctccgtgtcctaccttcctcggcctaccgaggactaccgactagggacgaaatagaagatgacgcagtctccagcccaccttgtctggtgtcnccgaggggaaancgcccacctctcctggccagggcctagtcagaatnttcactctacttagccttggtaccaacacgaaacctgtcgacggcctcccaggcctcctcattcctaatgactgcctactaccaaacncgggaccctagttcgggctacgccccaagaacgtgggttaccaggttcggactagggtcgggtccgtagggaactaggcttcaccttcgcctaacncgtcacgnacgctagagtcctagaacgttntggtactttgtactgtaccganccgtgaccgttgacggttcncgggtccctcgacttccggaaccgtttcgggcgggtacggtcctaaggggttcgacgtacggtaactaaccggaatccggttaggcctgacctaccgtntcgttaacg

SEQ ID NO: 47763 - DNA, 848 bp, Homo sapiens
  misc_feature: GYAE6OF02H79UG.47.56.F01.1.454.CMB.1.raw
  modified_base (141)..(141): a, c, t, g, unknown or other
  misc_feature (141)..(141): n is a, c, g, or t
  modified_base (175)..(175): a, c, t, g, unknown or other
  misc_feature (175)..(175): n is a, c, g, or t
  modified_base (199)..(199): a, c, t, g, unknown or other
  misc_feature (199)..(199): n is a, c, g, or t
tcagagctcacgtacacgaccggtgctcgatttagcagacgtctgaacacacaaaggggccccagccctgggattcccagctgtttctgcttgctgatcaggactgcacacagagaactcaccatggagtttggctgagtntgggttttccttgttgtacttattttaaaaggtntccagtgtcgaggtgcaacgtggnggaggtccggggagcttaatcagccgtgggggtccctgacgtctctctgtgcacgtcctcgtggtacttccgtacctttcgtaagttacgttacgtggtatcgtaccgtacggttcggccgtaaccgaaggtcccgtaccggtaaggggtaacgggtacgttggggttacggttcgggtaccttcgtaacggttaacttaacggttccgtaggtacgttacgggtaagttccgaaccgtaaactaaaccggtaacggaccggtaccgtttacccggaacgggtaccgggtaaccgtacgttcccgaaaccggtactacccgttacgaacggaaccgtaaacgtaaccccggaaccgaaaaccgaaacccgtacggtaccgttacgttaactaaccgtaggtaaccctaaaaagttcgaaacgttacgtaacggtaacgtacggtaaccgtaacgggtacccgaacggttacggaccggttaccgggttaacccgtttaggttttaaaacgttccggtttttacgtacgggttacggtaaacccgtaaggttaaaccgtagttacccgggttaaaccgttcgggggttaccggttaaaccgtttaccttttaacggtttaccggttacgggtacccgggttaacccgggg

SEQ ID NO: 47764 - DNA, 809 bp, Homo sapiens
  misc_feature: GYAE6OF02G0IS6.47.56.F01.1.454.CMB.1.raw
tcagagctcacgtacacgaccggtgctcgatttagcagacgtctgaacacacaaagggggccccagccctgggattcccagctgtttctgcttgctgatcaggactgcacacagagaactcaccagtggagtttgggctgagtcgttgggttttcctttgttgtacttaagtttttaaaaggtgttacctagtggtgaggtgactaacgttggtgggacgggtccggggggaggtactttaaagttcgacggtccggttcgggggggttcccctaggacgtaccgttccgtccgttgtgcacgtcccttcgtaggtacttcctaccgtttacgtaagttaacgttacgtaggtatcgctacggtcgggtacccgaccgaacgtccgtaccggaaggggtaacggggtacgttggggtcggtcgggtccgtacgtaacgttaattaacgtccgtaggtacgtaggacggtacgaccgaaactaaacgtacggaccggtacgtccggtaggacgggtaccgtacttccacctactaccgtcgaacggaacaaccgaaccgaacgaaacgaaccgtcgtacttaggtacctacgtacgtaaactaaacgtacgcctaaacggtcgttaacgacgggaacggtaacccgacccgggtaactacggtccgggtacgtttcgtaagtttaacgttttacctttcggtgtaaccgtaaggtaaagtacgtaacgttaccggtaacgggttgggttacccgggttaaccttttaacgtttttaacggttccggtaacgggttcccggtaacccgggg

SEQ ID NO: 47765 - DNA, 713 bp, Homo sapiens
  misc_feature: GYAE6OF02HGPY7.47.56.F01.1.454.CMB.1.raw
  modified_base (307)..(307): a, c, t, g, unknown or other
  misc_feature (307)..(307): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
  modified_base (598)..(598): a, c, t, g, unknown or other
  misc_feature (598)..(598): n is a, c, g, or t
tcagagctcacgtacacgaccggtgctcgatttagcagacgtctgaacacacaaagggggccccagccctgggattcccagctgtttctgcttgctgatcaggactgcacacagagaactcaccatggagtttgggctgagcgttgggtttttccttgttgacttaagttttaaaaggtgtccgagtgtgaggtgacaacgtggtaggacggtccgggggagtacttaattcgaggccggtgggggtccctgacgtacctctccgtgtgacacgtcctgtggacttcctaccttcagttagttacgnggatcgcacgtcgggtaccgaccaagcccgtacggaaggggaacgggtacgtgggtggtcgggtctacgtaacgttagttaactccgtagagtcgggaagtccgacaaacaaaccgtccggacgtacgtccggtacggaacggtacctactaccacgacttcaccgaaggacgaaccaaccgaccgaaagacctacgtctagtactcgtagactaaagtcgaaccacgngttacgngaacgaccgaccggacgagttcggaccgttcgttaagttagttacgttttccggnggttacggaacgtaaacgggtacttaacggtaaccttaacggggttcgggttaaccgggttaacccgtttacgtttttaacggttccggttaccggggttacggtacccgggggg

SEQ ID NO: 47766 - DNA, 720 bp, Homo sapiens
  misc_feature: GYAE6OF02GHZD8.47.56.F01.1.454.CMB.1.raw
  modified_base (151)..(151): a, c, t, g, unknown or other
  misc_feature (151)..(151): n is a, c, g, or t
  modified_base (214)..(214): a, c, t, g, unknown or other
  misc_feature (214)..(214): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (528)..(528): a, c, t, g, unknown or other
  misc_feature (528)..(528): n is a, c, g, or t
tcagagctcacgtacacgaccggtgctcgatttagcagacgtctgtcggcgggggaggaactgctcagttaggacccagacggaaccatggaagccccagcgcagcttctcttcctcctgctactctggcctaccagatacccactggaanaaatggagatcggaacgcagtcctaccagcccacccttgtctgtacgcctccgaaggggaaancnccctaccctntccngccgacggccagtcaggtactatacgcacgacttaacgtcgccgttcggaacagacgtaacgaacgtggaccgacggtaccctcccggagtccttaccgtactacgttacgtagttgggacctaccgtacctacccgacggtaacggcccttaagtttacccgtaccgtcccaacggttaccggttaacgtttccgagggttaccgggcgttaggggttccggggttactaaacgggggactacggtttaccggttcctaaccgtcccggttacaaaccctgtaccgactccggtacnccgtacgtacgtaacgttcgtaacgtagtttacttaacgtcgtttaagtttacgtcgttagtaccaggttacagttaaactccgtaagtccgtacgttcggaccttcggacgtaacgctacggtcgtaaggtacgtaacgttacgtaaccgtgtaacggctaaccgtgtaccgttgtaccgttctaacccgg

SEQ ID NO: 47767 - DNA, 746 bp, Homo sapiens
  misc_feature: GYAE6OF02HFH2I.47.56.F01.1.454.CMB.1.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
tcagagctcacgtacacgaccggtgctcgatttagcagacgtctgaacacacaaagggggccccagccctgggattcccagctgtttctgcttgctgatcaggactgcacacagagactcaccatggtagttgggctgagcgttcgggttttccttggttgtacgttaattttaaaaagggtgtacctagtggtgaagggtcgacaacgtgggtggagggtccgggggaggtcttaattcgacggtccggtcggggggtccctgacgtactctccgtgtcgacncgtcctcgtggacttcctaccttntagtagttacgtagatcgcacgtcggtccgacgacgcctcggaagggacggtacggtgggtcgtcgggtctacgtaacgtattaaccgtcgtagtacgtaggtaactcgtaccgaaacgtaaaccgtaccggaccggtaccgtaccggttagggaccgggtaaccgtacttacccgaccgtaccgtaccctacggacgtaacgaaaccgaaccgtaaaccgaacgtaaaccgacgtacgttacggttacacgtacgtaaacgtagtaccgactaacgtgtacgtaagacgtaccgacgaccgtagtaggtacgtcttaggttacttacgttcgtacggacgtaacggtaaggtaacggacttaaaccggttacgggtaggggtaccggttaaccggttacgtttttaaggcggtttacggggtcccggtaaccggggg

SEQ ID NO: 47768 - DNA, 727 bp, Homo sapiens
  misc_feature: GYAE6OF02FPLNP.47.56.F01.1.454.CMB.1.raw
  modified_base (268)..(268): a, c, t, g, unknown or other
  misc_feature (268)..(268): n is a, c, g, or t
tcagagctcacgtacacgaccggtgctcgatttagcagacgtctgaacacacaaaggggccccagccctgggattcccagctgtttctgcttgctgatcaggactgcacacagagaactaaccatggagtttgggctgagctgggttttccttgtgctatttaaaaggtgtccagtgtgaggtgcaactggtggagtccggggaggcttaattcgagccgtggggtccctgagactctcctgtgcagcctcgtggtacttcgaccttnagttagttacgtggatgcacgttgggtccgaccgtaagcctaccgaggggaaggtacgttggtcggtgggtcctacgtaacggtatttaacgtccgttagagtacggtaacgttccgacgtaacgtaaaaccgtacgaccgggtaccgtaccggtaggaaccggggtaaccgtaaccgttaccaacccgtacgttacccgttacccgaaggaccgtaaacccgaaccgtaacccgaaaacgtaaacccgtacccggtctagttactaccgtacgacttaaacgcgacaccgtacgtacgaggtaacgcggacccgtaagacgttcggcgtactaggtttaactagtttttcggagttacgagtaacggtataaccggttaacgtaacgtccgggttaacggtaacccggttacctttttttaaggtaccggtaacggttccgggtacgggtaaccccgg

SEQ ID NO: 47769 - DNA, 806 bp, Homo sapiens
  misc_feature: GYAE6OF02GSPW5.47.56.F01.1.454.CMB.1.raw
  modified_base (207)..(207): a, c, t, g, unknown or other
  misc_feature (207)..(207): n is a, c, g, or t
tcagagctcacgtacacgaccggtgctcgatttagcagacgtctggtcggcgggggaggaactgctcagttaggacccagacggaaccatggaagccccagcgcagcttctcttcctcctgcttactctggcctcccagactaccacgtggaagaaatgagatgacgcagtctccagccaccctgtctgtcgtctccgaggggaaancgcccacctctcctgcagggcctagtccaggtacgttataacgcaacgactaaacgtttcgccgtaggtaaccagaccgaaacggtaaaacccgtcggggacctaacgggcccgttacccccgaagggtccccttcccgttacaacctttacgtacgttcgggtcaccgtacgtccccaaccggacggggaccctacggttcgggtaaccctaccccgacggtaccccgtacgggtttaccgaacggggttcggacggttaacggggttcggggttacggttacggggggaaccttaacgggggtttaccgtttaccctaacccgttccggtttacccaaaccttaacgtccgaaaccgccgtaaccggtcccgtacggtaccgtacggtcgttaaggtaaacggtttacttttcgtaaactttaacttttacgtttacgtacgtactaacgtactaggttaaacttaagtaccgttacgtaccgttcgtacggttccggtaacggacgtaaccgtaccgtacggttaacggaaggttaaacctaaaccggtcgtagtaccggtacgtacgacgtacgttacgttccgttagttacccg

SEQ ID NO: 47770 - DNA, 825 bp, Homo sapiens
  misc_feature: GYAE6OF02FH0AA.47.56.F01.1.454.CMB.1.raw
  modified_base (242)..(242): a, c, t, g, unknown or other
  misc_feature (242)..(242): n is a, c, g, or t
tcagagctcacgtacacgaccggtgctcgatttagcagacgtctgaacacacaaaggggccccagccctgggattcccgagctgtttctgcttgctgactcaggactgcacacagagaactcaccatggacgtttgggctgagtctgggttttcctagttgctatttaaaggtgtccagtgtgaggtgctaacgtggtggacgtccggggaggtcttaagttcgagtccgtcggggggtccnggacgtacgttctccgtgtagctacgtcctcgtaggtacctccttaccgttacgactaaccgttcgtagtccgaagttcgggtccgttcggggtacccaccgacgggtaccgtaccgggggaacgggtacgtaggtacggttggggttacggaacgtaaaccgtaagtaaacgtaccgaaggtaacgttaggtaaacgtacgtaaacggtaaaaccttggtacgtaacggtaccttacggtacgttaacgggaacggtaccgtacgttacaccgtataccgtacaacggtaactaaccgaaccgaccgtaaaacgtaccgttactccgttacgttacacgtaactaaacggtcgacgaccggtactaggaaccggtacgtaccgaacggtaccggttaccgtacgttacggtaacgtttaacttacggtaggtttaccggttcggttaccgtacgttaacccggtacccgggaccccggttttaccgggggaccccggttttaacccgttcggggttaccctttaccgggggaacccgggtttccccggtaaccgggttacccccggttaggtttacccccgg

SEQ ID NO: 47771 - DNA, 779 bp, Homo sapiens
  misc_feature: GYAE6OF02JFM42.47.56.F01.1.454.CMB.1.raw
  modified_base (597)..(597): a, c, t, g, unknown or other
  misc_feature (597)..(597): n is a, c, g, or t
tcagagctcacgtacacgaccggtgctcgatttagcagacgtctgaacgacacaaagggggccccagccctgggattcccagctgtttctgcttgctgatcaggactgcacacagagaactcaccatggagtttggctgagcgttgggttttccttgtgcttagttttaaaggtgtcctagtgtggaggtgcaacgtggtaggacggtccgggggaggtcctttaaagttccgaacggtcccggttcgggggggttcccctaggtacgtaccttccgttcccgttggttcgccgtaaccggtacccttcgtacggtacctttcccgtacccgttcgtaggttacgttaccgtagtagttccggactaccggtcgggtccccacgaatcccggtaacggaggaagggtcttggggtcgtgggtcctgtaacgttatactcgtagtagtcgagtccataaaccacgtacgccgtaacgtcgtaggacggaccttatcccatacctacgtacctaacgacggaaccaaccgaaccgtaacgtaacgaccgtcgtaacgtaccgttagacgtaaaccagttaccgaccgtacgtacggttnaacgggtacgaaccggtacccggtaagacggttacgtaccggttaccggttattaccggttatttacccggagtttaccggaaggtaaacgtagttaaaacccgtcgttaaaccggttaccggggtacgtttaacccgttaacgttttaaccgacggtttccgggtaccggtaacccggggg

SEQ ID NO: 47772 - DNA, 530 bp, Homo sapiens
  misc_feature: GYAE6OF01EA8TS.25.76.G10.1.454.CMB.1.raw
  modified_base (426)..(426): a, c, t, g, unknown or other
  misc_feature (426)..(426): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatccacttgccaggcgactcagaacatctactaacttttaaatggtatcagacaaaaacctgggatggacccctaaactcctagatctaccgtgcatccagtttgaaacagggtcccatcaaggttcagtggaagtggatagtgggactagttattttactttcacattcagctagcctgcagccggaagtattttgactaactataattactgtacaacnctgtcttactctccctccgttggtttcgccgtacggggtacccaccgttcgacgtactaccgaaacgtactcggtcggctgacctaccatctgttcttcgtacc

SEQ ID NO: 47773 - DNA, 517 bp, Homo sapiens
  misc_feature: GYAE6OF01ACP6X.25.76.G10.1.454.CMB.1.raw
  modified_base (194)..(194): a, c, t, g, unknown or other
  misc_feature (194)..(194): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtggganacagagtcacatcacttgccaggcactcaagaacatctaactaacttttaatgtatacagacaaaacctggatcggacccctaaactcctgactctaccgtncatccagttacggaaacncgggtaccatcgaaggttcaggtgaagtggatagtggactattatttacttcaccatcagcagcctgcagacgaatntttanacaatatatactgtacaactctgtcttactcctcccttcgttggtttcgacccgtagggacccaccgtgaagtactacgaaacgacttggtcgctgacctaccattctcgttctctacccg

SEQ ID NO: 47774 - DNA, 545 bp, Homo sapiens
  misc_feature: GYAE6OF01BMM1D.25.76.G10.1.454.CMB.1.raw
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatcacttgccaggcgactcagaacatctacaacttttaaatggtatcagcaaaacctggatggcccctaaactcctgatctaccgtgcatccagtttggaaacagggtcccatcaaggttcagtggaagtggatagtgggactattattttacttcactatcagcagcctgcagccggtaatattttgcaactattatttactgtacaactacttcgttccttaccttccttaccccttccgtttgggtttttcgggcccgtacgggggtacccctacccgtcgacgacttaccgaaaccgtaactggtcggctgaccaccattcctcgttcttcgtacc

SEQ ID NO: 47775 - DNA, 574 bp, Homo sapiens
  misc_feature: GYAE6OF01DBIZF.25.76.G10.1.454.CMB.1.raw
  modified_base (194)..(194): a, c, t, g, unknown or other
  misc_feature (194)..(194): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtggganacagagtcaccatcacttgccaggcgactcagaacatctactaactttttaatgtatacagacaaaacctgggatcggacccctaaactcctgactctaccgtgcatccagtttacggaaacacgggtccatcaaggttcagtaggagtgatagtggactattatttacttcaacatcagctagcctgacagccggtaagtattttgactaatattaattactgtacaactacttagttcctttactccttacccttccgttcggttttcggaccgtacggggtaaccctaccccgtacgaccgtaacgtaccgtaaaaccggtaacgttacggtcggtaccgtcgtacccaccgtacttaccttcgtttcttccctacc

SEQ ID NO: 47776 - DNA, 637 bp, Homo sapiens
  misc_feature: GYAE6OF01C6Q30.25.76.G10.1.454.CMB.1.raw
  modified_base (194)..(194): a, c, t, g, unknown or other
  misc_feature (194)..(194): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtggganacagagtcaccatcacttgccaggcgactcagaacatctacaacttttaaatggtatcagacaaaacctggatggcccctaaactcctgatctaccgtgcatccagtttgaacagggtcccagtcaaggttcagtggaagtggatagtggacagttattttacttcaccatcagcagcctgcagccggtaagtacttttgactaactattaatttactagttacaactacgttgttaccttttaaccgtcctttaccccgttccgtttcggggtttttacgggaccccgtaggggggtaccccctaaccccggtttacggaaacggttaccgttaacccgaaaaaccggtaaacccgttcgggttccggggtaccctttacgggaaccccgttaaccccgtaacgttccccgttttacggtttccccttttaccgtaaccccg

SEQ ID NO: 47777 - DNA, 558 bp, Homo sapiens
  misc_feature: GYAE6OF01CTCZ9.25.76.G10.1.454.CMB.1.raw
  modified_base (195)..(195): a, c, t, g, unknown or other
  misc_feature (195)..(195): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatccctccctgtctgcatctgtggganacagagtcaccatcacttgccaggcgactcagaacatctactaactttttaaatggtatcagacaaaacctgggatcggacccctaaactcctgatcctaccgtgcatccagtttaggaaacgagggtacccatcgaaggttcaggtggaagtggatagtagggactagttattttacttcacctatcagtcagcctgacagaccggtaagtactttgactaatattatactagtactaactacttcgttaccttactccttcccttcgttggttttacgccgtacggggtaccctacccgtcgacgtataccgaaacgtatggtcggctcgacctaccctattccgttatccttactacccg

SEQ ID NO: 47778 - DNA, 531 bp, Homo sapiens
  misc_feature: GYAE6OF01B3H6N.25.76.G10.1.454.CMB.1.raw
  modified_base (315)..(315): a, c, t, g, unknown or other
  misc_feature (315)..(315): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatcacttgccaggcgactcagaacatctaactaactttttaaatggtatcagacaaaaacctgggatggcccctaaactcctgatctaccgtgcatccagtttggaaacngggtccatcaaggttcagtggaagtggatagtggactattattttacttcacctatcagcagcctgcagccggtaagtattttcgactaactatattactgtacaacacttgtcttactccttcccttccgttggttttcggccgtacggggtaccctacccgtcgacgactacgaaacgtactggtcggctgctaccattcctcttccttctacc

SEQ ID NO: 47779 - DNA, 623 bp, Homo sapiens
  misc_feature: GYAE6OF01CXZU1.25.76.G10.1.454.CMB.1.raw
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaaggccgtggggggtccctgagactctcctgtgtagcctccggattcagcttcagcaaatatagtgtgaactgggtcccgcgaggcctaccggaggggaaggggctgggaggtgggtcgctagttcgtgagtagtagtagttacttaataaatactacgcagagtcagtggaggccatcatatctacagagacaacaccgaagagtcttaattttgttctgtaactaaagttgaaacagtcctaggacgtacggaccgaagggactacgggcttacgttagttaattagttggtcgacggaacgtaacgtaaagttaaaggaaagtaacggtagggttacggtcggttacggggtacctttacggaacgtttaaccgggcgggggggtaccccgtaaaaccggggg

SEQ ID NO: 47780 - DNA, 614 bp, Homo sapiens
  misc_feature: GYAE6OF01A01SP.25.76.G10.1.454.CMB.1.raw
tcagactgtacagtcacgaccggtgctcgatttagtcactcatacagggggtaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatcacttgccaggcgactcagaacatactactaactttttaaattggtatctagacaaaaacctggatcggcccctaaactcctgatctaccgtgcatccagtttaggaacgaggggtcccatcaaggttcagtggaagtggatagtggactattattttactttacacctatcagcagcctgacgagacggtaagtatttagactaacattacttactgtactaactacttcgtactttaaccttcccttaccccttccgtttgggttttcggtaccgtaccgggggaccctaaccccgttcggacgtaaccgttaccgtaaaaccggtaaccgtggtacgggtccgttacgacccacccctaaacgtttcccgttacggtttacctttcccgtaacgtttccccccg

SEQ ID NO: 47781 - DNA, 661 bp, Homo sapiens
  misc_feature: GYAE6OF01CFWBX.25.76.G10.1.454.CMB.1.raw
  modified_base (304)..(304): a, c, t, g, unknown or other
  misc_feature (304)..(304): n is a, c, g, or t
  modified_base (477)..(477): a, c, t, g, unknown or other
  misc_feature (477)..(477): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgcttattttagaaggtgtcctgtgtgaggtgcaacgtggtggagtcgtgggggaggcctggtcaagccgtggggggtccctgagactctccgtgtgtagccgtccggattcgagtcttcagacaaatatagtgtagaacgtgggtccncgaggctaccggaaggggagggctgggaggtgggtcgctagttcggtgagtagtagttaagtacttaataaactactacgcaagagtacgaggtggaacgggccctattcaacgttatcctaccgaaggaacgaaaccaaccaaccgaaagacgtacttagtttttgtttacnggaacctaaatcgtaaacagtccctaggaacggacggacccggaaggtacgtaaccgggtcttcgttaggttaatttagtgggtagccgaaagtaacaaagttaaacggaagacgtagggttacggccggttaggggtacttacggtaaccgttacgggtccgggggaacccggtaacccgggg

SEQ ID NO: 47782 - DNA, 568 bp, Homo sapiens
  misc_feature: GYAE6OF01DK3R5.25.76.G10.1.454.CMB.1.raw
  modified_base (555)..(555): a, c, t, g, unknown or other
  misc_feature (555)..(555): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctcctgtctgcatctgtgggagacagagtcaccatcacttgccaggcactcagaacatctaactaactttttaatgtatcagacaaaaccgtgggactcggacccctaaactcctgtactcctaccgtgacatccgtagtttaggaaacgcgggtaccatcgaaggttcagtggaagtgatagtggactattattttacttcacctatacagcagtcctgacagaccggaagtatttcgactaataatacttactacgtactaactacttcgttacttacctccttcccgttcgttcgggttttcgaccggtaccgggtaacctaccccgtagaacgtactaaccgtaaacgtacgtggtacgcctgccctaactacttccttnttccgttcgtacg

SEQ ID NO: 47783 - DNA, 598 bp, Homo sapiens
  misc_feature: GYAE6OF01DAPRO.25.76.G10.1.454.CMB.1.raw
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgttgagacagaatcagcatcacttgccggngagtcgagggcattagctaattatttagcctggttanacaaccagaaaaccgagggagtagttccttaagctcctgatctatcgctgccctactacgttacacgtacgacggggtccctagttccgtcggttacaggccggctagtcgaaatccggtagggaacctagtacgttacctacttcctactaaccttatcaacgaccgacgtccgtcgcgacgtccctaggaagtagttcgttacgtacttaacttactttacgtagtaactaaagttaactaacttaccgtaccgtccctacctactaccggtttacggaccgggtacgggtaaccgtaagggtacggaagtaacgtaacgaaacgtaacgtggtacgtaccg

SEQ ID NO: 47784 - DNA, 629 bp, Homo sapiens
  misc_feature: GYAE6OF01C97NT.25.76.G10.1.454.CMB.1.raw
  modified_base (258)..(258): a, c, t, g, unknown or other
  misc_feature (258)..(258): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatcgacccagtctccatcctccctgtctgcatctgtggatacagagtccactatccacttcgccgaggcactcaagaacatactactaacttttaatgtatcanacaaacgtggactcgaccctaactctgtactcgtacgtgcctactaccgtaggtttacggaaacgtacggggtacccagtacgtaaggttcgaaggtaggtaagtggaatagtaggtactatttaactttacttacaactatcacgtcacgcctgacgacggaccgtaagtctttagactaactagttattacgtactactaacgtcttcgttaaccttccttcccttacccgttccggtttacggtttaccgggacccggtaccggggtacccctacccggttagaccggtaactaaccggtaaaccgtacggttacggtcggtacccgtacgaccctaaccttatccgttacgttccttccgttacccg

SEQ ID NO: 47785 - DNA, 625 bp, Homo sapiens
  misc_feature: GYAE6OF01A6DFA.25.76.G10.1.454.CMB.1.raw
  modified_base (199)..(199): a, c, t, g, unknown or other
  misc_feature (199)..(199): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (435)..(435): a, c, t, g, unknown or other
  misc_feature (435)..(435): n is a, c, g, or t
  modified_base (454)..(454): a, c, t, g, unknown or other
  misc_feature (454)..(454): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtcctccatccctccctgtctgctatcgtggtggganacagacgtcaccatcacttgccaggcgtactcagacatactaacttaacttttaattgtatacaacgaactaaaaccgtggactaccggacccctaactccgtagactcctaccgtcactacgttacgtaggtaacgaacggtacgtacctagtacgtacgtcgaggtagagtagtagtagtagtattatttactttactctaactacagcncgtacncgagacgagtacgtattntacaactatattactacgntaacgactcgttacttaccttccttacccgttccgtttaccggtttcggttacccgaccgggtaccggtacccctacggttacgaacgtaaccgttaaaccgaacggttacgtcggtccgacgtaccgtacctaacttccgttacgttcccttaccgttaccgttaccccg

SEQ ID NO: 47786 - DNA, 677 bp, Homo sapiens
  misc_feature: GYAE6OF01D3E42.25.76.G10.1.454.CMB.1.raw
  modified_base (154)..(154): a, c, t, g, unknown or other
  misc_feature (154)..(154): n is a, c, g, or t
  modified_base (199)..(199): a, c, t, g, unknown or other
  misc_feature (199)..(199): n is a, c, g, or t
  modified_base (496)..(496): a, c, t, g, unknown or other
  misc_feature (496)..(496): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccanatcgacccagtctccatccctcctgtctgctatcgtggtaggganacaggactcacctatcacgttcgccgaggccgactacaacgaactacttactaaacttaaactttttaaagtggtaactacaagtaacctaaaaaccggtgggtactacccggtaccccctaaactccctagtactcctaccgtgactacgtccgtaggttaaggaaccgtacgggtacccaagtacgtaacggttcgaaggtaggaacggtggaatacggtaggtaacttatttaacttttacgttacacctatacgtagaccacgtccgtagacgacgtaccggtaattcgttanacgtaactattacgttactcgtaactaactcttacgttacccttaccttccctccccgtttacgttcggtttaccggaccggtaccgggtaaccctccgtacgacgtaactaaccggtaaacctaggttcgtacggtccctagtaccctaacctcgttacttcgttcctaccgttaccccg

SEQ ID NO: 47787 - DNA, 556 bp, Homo sapiens
  misc_feature: GYAE6OF01DTHYN.25.76.G10.1.454.CMB.1.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
tcagactgtacagtcacgaccggtgctcgatttagtcactcatacgagggggcaggagtcagtcccaaccaggacacagcatggacatgagggtccctgctcagctcctggggctcctgctgctctggctctcgaggtgaccagaggtgacatccacatcgacccagtcctccatccctccgtgtcctgcatcgtggagganacgagacgtcacatcacttccgaggcactacagacatactaactaacttttaagtgtatctacgaactaaaacgtggactcggaaccctaatctagactcacgtncgtatcgtagttacgaacgtcggtacagtacgagttcaggtcgagtgatagngactagttattactnactntcanctagtcngcgtagacgtattagttgacctaatattacgtatacgtacaacgtctgttaactcctctaccgtcgtttcggtacggaccgcggtaccacccgtagaacgactaaacggaaccgcgttagcggactcgtaccctacgtactcgtaactttctaacctcgttaccccg

SEQ ID NO: 47788 - DNA, 547 bp, Homo sapiens
  misc_feature: GYAE6OF01C946D.25.76.G10.1.454.CMB.1.raw
  modified_base (402)..(402): a, c, t, g, unknown or other
  misc_feature (402)..(402): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggatacagagtcaccatcacttgccaggcgactcagaacatctacaactttttaaatggtatcagacaaaaacctgggatggacccctaaactcctgatctaccgtgcatcctagtttaggaacaggggtcccatcgaaggttcagtaggaagtggatagtggactattatttacttcactatcagcagctgcagccgaatatttgactaanatatactgtacaactctgtcttactccttcccttcgttggttttcggacccgtacggggaccctacccgtacgacgtactaccgaaaaccgtacgttggtcggacgttcgacctacccgtattccgttacgtccttcgttacccg

SEQ ID NO: 47789 - DNA, 616 bp, Homo sapiens
  misc_feature: GYAE6OF01AD1KJ.25.76.G10.1.454.CMB.1.raw
  modified_base (195)..(195): a, c, t, g, unknown or other
  misc_feature (195)..(195): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatcgtgtggganacagcgtcaccatcacttgccaggcactcgaagaacatacttaactaacttttaaagtggtatacacgacaaaacgtgggatccggacccctaaactcctagacttcctacgtgcactaccgtaggtttacggaaaacgtcggggtacccagtacgtaacggttcaaggtggaagtggactagtggtaactagtttacttttacttacactatcagtcagtcctgacgtagaccggtaagttatttaggaccttaagtacttacgttaactcgtaactaactaccgtttgttaccttaccgttccttacccgttcgttacggttttacggacccggtacgggtaccctaccgtacgacgtaactaccgtaaacgtacgttcggtcgtacctggacctacctacttctcgttctccgtaccc

SEQ ID NO: 47790 - DNA, 684 bp, Homo sapiens
  misc_feature: GYAE6OF01A0NAA.25.76.G10.1.454.CMB.1.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
tcagactgtacagtcacgaccggtgctcgatttagtcactcatacgagggggcaggagtcagtcccaaccaggacacagcatggacatgagggtccctgctcagctcctggggctcctgctgcttctggctctcaggttgccagaggtgacaatccacatgacccagtctccatcctcctgtctgcatctgtgganacagagtccacatcacttcgcagcactcagaactactactaacttaacttttaatagtatacagactaaaacgtggactccggaaccctaactccgtagtactcgtacgtnctactcctagttacgaacgtaggtccagtacgtaaggtcgtaagtaacgtgatagtacggtactaagtttacgttttaccttcaacctacttacgactacgtacgtaccgtagtacccaaaggtaacccggtaattacgtttagaccttaaagtactttaatacgtacgtaaccaaacttacgttaccgtactttaccgtacccgtttaccccgttacggtttcgggtttaaccgacccggtaaccgggtaccccctaacggtacgtaaacgtaccctaaaccgtaaaaccggttaccgtccgggtacggtccgttacccgtacctacccgttacgttccccttaagtttacccccttacgtacccgtttacccccg

SEQ ID NO: 47791 - DNA, 688 bp, Homo sapiens
  misc_feature: GYAE6OF01BXAAA.25.76.G10.1.454.CMB.1.raw
  modified_base (207)..(207): a, c, t, g, unknown or other
  misc_feature (207)..(207): n is a, c, g, or t
tcagactgtacagtcacgaccggtgctcgatttagtcactcatacgagggggcaggagtcagtcccaacaggacacagcatggacatgagggtccctgctcagctccgtggggctcctgctgctcgtggctctcgaggtgccgaggaggtgacatccacactcgacccagtcctccactccctcctgtcctagctgtcgtggagganacgtagcgtaccaactatctacgtcgaccgagggacctacacaagaaacctattaaccttaacctttaaagtttttaaggtcggtactaacaacaaccgtaaacggtcgggtactaccggtaacccctagtctagactacctacggcactacttacgtaaggttacggaaccgtacgggtaccagtcgtaaggttcgaaggtacggagttaggagttagacgtaacttagtttactttcgtacacgtatcgagtcgtacgtcgagaccgtaacgggacgttaagtacgttaagactaaccgttagttacgttacgtaacgttaacactttaccgttcgtttaccttaccgttcccgttacccgttcgggttaccggttcgacccggtacccggtcctaccgtagaccgtaaccaaccggtacgtacggtcggtccggtactaccggacctaaccgtgttacgttaccctacgttctacccg

SEQ ID NO: 47792 - DNA, 599 bp, Homo sapiens
  misc_feature: GYAE6OF01D059T.25.76.G10.1.454.CMB.1.raw
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatccctccctgtctgcatctgtggatacagagtcacatcacttgccaggcactcagaacatctactaacttttaatgtatcagacaaaacctggatggacccctaaactcctagactctaccgtgcactccagtttaggaaaccgtacggggtcccatacgtaaggttcagtaggtaagtggatagtggatattattttacttcactatcagcagcctgactacggaccgaagtcttttagactaactagtaatttacttatacgtaactacgttcgttacttaaccttcccgtaccctttcccgtttcgggttttcggacccggtacggggtaccctacccgtacgtaacgtaccttaaccgtaaaccgtaacgtcggttcggaccttcggacccctaacctagttaccttcgttcccgttcgttacccc

SEQ ID NO: 47793 - DNA, 592 bp, Homo sapiens
  misc_feature: GYAE6OF01EZYRW.25.76.G10.1.454.CMB.1.raw
  modified_base (357)..(357): a, c, t, g, unknown or other
  misc_feature (357)..(357): n is a, c, g, or t
  modified_base (379)..(379): a, c, t, g, unknown or other
  misc_feature (379)..(379): n is a, c, g, or t
tcagactgtacagtcacgaccggtgctcgatttagtcactcatacagggggcaggagtcagtcccaaccaggacacagcatggacatgagggtcccctgctcagctcctggggctcctgctgctctggctctcaggtgccagaggtgacatccacatgacccagtctccatcctccctgtctgcatctgtgggatacagagtcaccatcacttgccaggcgactcagaacatctactaacttttaaattgtatcagacaaaaccgtggatcggacccctaaactcctagactcgtaccgtgcattcctaggtttaggaaacgcgggtaccatacaaggttcagtggaagtggatagnggactattattttacttcactntacagactacgcctgcgacggaccggtaagttcttttacgacctaagtaattaacgttacttacgtaactaaacctcgttacgttacctttacccgtccttaccccgttccgttttcgggtttacggaccggtaccgggtacccaccgtacgacgtactaacgaaccgtaactggtcgtctacgcctaacctactcgttcgttcctcgtaccc

SEQ ID NO: 47794 - DNA, 768 bp, Homo sapiens
  misc_feature: GYAE6OF01BI2JW.25.76.G10.1.454.CMB.1.raw
tcagactgtacagtcacgaccggtgctcgatttagtcactcatacagggggcaggagtcagtcccaaccaggacacagcatggacatgagggtccctgctcagctcctgggctcctgctgctctggctctcaggtgccaggaggtgacatccacatcgaccctagtcctccactccctccctgtctgcatcgtggtgggatacgagacgtccacatcacgttcgaccaggcgactcgaagaactactacctaactttaactttttaagttggttaactacgaacgtaacgtaaaaacccggtgggtaaccgtaccggtaaccccctaaacgttcccgtacgtaacctttacccgtaaccggttacgaccttacttacccggttaaggtttaacgggaaaccgtaccgggttaccctacgttaccgtaacggtttacgaaggttagggaaagttacggtaagttaggttacggtaactttagtttaacgtttttacctaccaaccgttagtccgtaacgacgttaccgtaccgttacgacggtaacggtaaccggtaaggtttacttaccgaactaacgtatttaaccgtataccgtaactaacgtacgtttacttaccttaccttcccgtaccgttccgttttacgggttacgtaccccggacgggtacccctaccggtagtaaccgtaaccgttaaccgaacggttacttcggtacgtacctcgtaacccctaacgtctttaccgttcgttccttcccgttaacccg

SEQ ID NO: 47795 - DNA, 592 bp, Homo sapiens
  misc_feature: GYAE6OF01BFESG.25.76.G10.1.454.CMB.1.raw
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (584)..(592): a, c, t, g, unknown or other
  misc_feature (584)..(592): n is a, c, g, or t
tcagactgtacagtcacgaccggtgctcgatttagtcactcatacagggtcctgggcccagtctgtactgacgcagccaccctcagtgtctgggaccccccgggcagagggtctccatctcttgttctgggagcagctccgacgtcggaaattaagtttgtctactggtaccagcagctcccagaaaccggcccccaagctcctcatctataggaatgatcagcggccctgagggatacctgaccgattctctggctcgaagtctggctcctcgcctcctgccntcngtggcctccgggtccgaggntggaggctagaattattacgtgtgcgtaggtttgggatcgcctagtctggaggtcggtccggacgggttggttcggggcgggacgggaccgaagccgtacggtacccgtccgttagggtccacggacccgaacggtcccgtcccggtcccccgttaccgggtcctacccgttcccgttcccggttcccccgtccccttccctcctaccgttccgtacgtacgtcgtggaccggcgggtccgtcggacgtaacgggcgacgacgtagcnngnantgcnnnnnnnnn

SEQ ID NO: 47796 - DNA, 810 bp, Homo sapiens
  misc_feature: GYAE6OF01EFDRJ.25.76.G10.1.454.CMB.1.raw
  modified_base (178)..(178): a, c, t, g, unknown or other
  misc_feature (178)..(178): n is a, c, g, or t
  modified_base (189)..(189): a, c, t, g, unknown or other
  misc_feature (189)..(189): n is a, c, g, or t
tcagactgtacagtcacgaccggtgctcgatttagtcactcatacagggggagagaggagccttagccctggattccaaggcctatccacttggtgatcagcactgagcaccgagattcaccatggactgggctccgcttggttttcttgtgctatttagaggtgtctgtgtgaggtncacgtggtggngtcgtgggggacgccgtggtacaaggtccggtcggggggtccctgacgtaccttctccgttgtgtacgcccgtccggtattcgacgtcttacgacgaactaaaagtattaggttggtacgtaacggttcgggtccccgccgacggtcccgtaccgggaagggggacggggtcgtggggaggttcgggacctcgtagtttcggaggtaagttaggttaagttaacgtttaacttaaagttaaacgtaccgttaacggacgtaaggtagtcgtagggtcggggacgggtaccgtactttccgaaccgttactcctaacgaaggaaccaaccaacgaacgaagtcgtacgtttagtttttacgttacgagtaaacttaagtacgaaacgaccgtacgtaggaacggtacggacccggtaaggtaccggttaacggtccgttttacgtttaagtttacgttttacggttacggtaccggtaacggtaaacgtaaaccggtaaaaggttaaaacccgggtaagggttaacccggtagggttaccgggttaccgggttcggggtttaacctacggggtaaacccggtttacgggggacccgggggtaaccccggtaaaccccggggg

SEQ ID NO: 47797 - DNA, 676 bp, Homo sapiens
  misc_feature: GYAE6OF01AQ6QU.25.76.G10.1.454.CMB.1.raw
tcagactgtacagtcacgaccggtgctcgatttagtcactcatacagggggcaggagtcagtcccaaccaggacacagcatggacatgagggtccctgctcagctcctggggctcctgctgctctggctctcaggtgccaggaggtgacatccacatcgacccagtcctccactccctccctgtcctgcatctggtcgggagacagagtcaccatcacttcgccgaggccgactcaagaacctatacctaacttaaacctttttaaattagggtatacgtaagaaccaaaaaccggtgggtaactaccggaacccccttaaacctcctacgtacttccgtaccgttacgactactaccgtaaggtttacgggaaaccgtacggggttacccaagtaccgtaaaggttcgaaggttagggaacggtggtaacgttaggtacgggtactaagtttacttttaacttacacctactcagtcacgtctacgcacggtacggtaagttactttacgactaaacgttaatactttaacgcgttaacctaactaccgttcgttaacccttttaccctcccgtttcccgttacgtttcggggtttaccgccggtaacgggcccttaccgacgtacactaccgaaacgtgtagtcgacttcgctaactctctacttcctctaccc

SEQ ID NO: 47798 - DNA, 564 bp, Homo sapiens
  misc_feature: GYAE6OF01E1JRU.25.76.G10.1.454.CMB.1.raw
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtggggggtccctgagactctcctgtgtagcctccggattcagcttcagacaaatatagtgtgaactgggtccgccaggcctccgaggggaaggggcgtgggaggtgggtcgctagttcgtgagtagtagtagtacttaataaatactacgcagagtcgagtggagggccgattcactatctaccagacgaacaacaccaaganctattttgttcngactaaagtagaaaacgtcctaggagagaccgagggataccggcttacgtagttattagttggtgacgagaacaagtaaacgagtagaggtggcgtgggctgactacgtcggggccagggtacccg

SEQ ID NO: 47799 - DNA, 701 bp, Homo sapiens
  misc_feature: GYAE6OF01EI6Q2.25.76.G10.1.454.CMB.1.raw
  modified_base (201)..(201): a, c, t, g, unknown or other
  misc_feature (201)..(201): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccaacatcgacccagtcctccatccctccctgtctgctatcgtggtggganacagacgtccaccatccacttcgaccgaggccgacctacaacgaactaacttaccttaaacctttaaaaccttttttaaagtttacggtaacttaccaaggtaaacctaaaaaccggtgggtaacttacccggtaaccccttaaaccttccgtacgtacttaccgtaccgtcgctacgtaccgtaaggtttacggaaacgtacgggtacccaagtacgtaacggttacgaggtaggaaggtggtaagtaggtagggtaacttagtttaactttttaccttaccgtacttactactaacgccgtacgtccgtcgacgacggtaacggaagttactttacgactaatattacttactagtactactacttcgttaccttacctccttcccttcgttcggtttccggaccggtaccgggacctacccgtacgtacgtaacgtaccgtaaacgtaccgttcggcgtactccgactaccgtacttacgttcttcctccgttaccc

SEQ ID NO: 47800 - DNA, 735 bp, Homo sapiens
  misc_feature: GYAE6OF01ESROL.25.76.G10.1.454.CMB.1.raw
  modified_base (198)..(198): a, c, t, g, unknown or other
  misc_feature (198)..(198): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcgaggtgccagaggtgacatccacatcgacccagtcctccatcctccctgtctgcatctggtggganacgagacgtccaaccatcctacgttcgccgaggccgactcaagaacataccttaacttaactttttaaattaggttaataccaaaacaaaaaccgttgggtactaccggtaccccttaaactccgtacgtactaccgtacgtgacctacttaccgtaagtttaacgggaaaccgtacggggtaccctaagtacgtaaggttaccgtaagggttagggaaaggtaggtaagtaaggtacggggtaacttaagttttaactttttacctttaccaaccgtaagtaccgacgtacgtacggtaccctgaccgaacggtacccggtaagttactttacgaactaacgtattaacgttactacgtacctaactacgttgttacctttaacctcccttccccgtttccggtttcgggttttaccgggacccgtaccggggtaacccctaccggtaaccggtaagtaccgtaaccgtaaacggtacgtaggttcggacctacgaccctacgtacttccgttacgttccttctaccgttcccccg

SEQ ID NO: 47801 - DNA, 727 bp, Homo sapiens
  misc_feature: GYAE6OF01CJCAO.25.76.G10.1.454.CMB.1.raw
  modified_base (668)..(668): a, c, t, g, unknown or other
  misc_feature (668)..(668): n is a, c, g, or t
  modified_base (687)..(687): a, c, t, g, unknown or other
  misc_feature (687)..(687): n is a, c, g, or t
  modified_base (695)..(695): a, c, t, g, unknown or other
  misc_feature (695)..(695): n is a, c, g, or t
  modified_base (705)..(705): a, c, t, g, unknown or other
  misc_feature (705)..(705): n is a, c, g, or t
tcagactgtacagtcacgaccggtgctcgatttagtcactcatacgagggggcaggagtcagtcccaaccaggacacagcatggacatgagggtccctgctcagctcctggggctcctgctgctcgtggcctctacgaggtcgaccgtaggtaggtgacactaccactatcgaccctagtcctaccactcccttccctgtcctagctacgtcgtaggtagggacacgtaagtacgtaccactactcacgttcgaccgacggctactacaaataacctaattaaccttaaactttaaacgtttttaaacgttacggtaactaaccgaacgtaaaccgtaaaaccggtgggaccgttacccggtaacccccttaaacctcgtacgtaccgttccgtaaccgtgacctacgttaccgtaaggttacggaaaccggtccgggtacctagtacgtagtacgaggtacgaggtagagtaggtacgtaacttattttactttaccgtactacctagtaccgaacgtccgtacgttccacggaacgtacggtaaccggttaatttacttacgaaccttaatactttagtaccgtaactactaacttacgtcgtttacccttacctcccgtttaccgttcggttacgggtaccgacccgggtacgaccctacggtanaccgtactaaacgtaccgngttcgtcnctagaccctnttacgtcttactcttccgtacc

SEQ ID NO: 47802 - DNA, 728 bp, Homo sapiens
  misc_feature: GYAE6OF01BX5GC.25.76.G10.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (301)..(301): a, c, t, g, unknown or other
  misc_feature (301)..(301): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatcgacccagtctccactcctcctgtctgcatcgtggtggganacagagtcaccatcacttgccaggccactcagaacntacctaactaacttttaatgtatcagacaaaacgtggactcggacccctaactccagactcgtacgtnctataccgtaggttacggaaacgtccggggtaccctagtaccgtaaggttcgtacggtacgggtaaaggtggtaacgtaacgtacggggtaacttaagtttactttttaaccgtttaccaacccgtaacttccgaacgtacctaaccggtcctttacgggaccgtaacggaaccgggttaaacggttacttttacgggacttaaaccgtacttaaacgtttacgtacggtacctaacctacgtttcgttacccgtttacctaccttccccgttttccggtttacgggttttccggaacccccggttacggggtaacccctaccccgtacggtaacgtaaccgttaacccgaaaaccgggttgttacgggtccggtaccttacgacccgtaacgttacttaccgttacgttccctttaccgttacccg

SEQ ID NO: 47803 - DNA, 609 bp, Homo sapiens
  misc_feature: GYAE6OF01EE2Z3.25.76.G10.1.454.CMB.1.raw
  modified_base (152)..(152): a, c, t, g, unknown or other
  misc_feature (152)..(152): n is a, c, g, or t
  modified_base (194)..(194): a, c, t, g, unknown or other
  misc_feature (194)..(194): n is a, c, g, or t
tcagactgtacagtcacgaccggtgctcgatttagtcactcatacagggggcaggagtcagtcccaaccaggacacagcatggacatgaggtccctgctcagctcctgggctcctgctgctctggctctcaggtgccagaggtgacatccanatgacccagtctccatcctccctgtcctgcatctgtcggganacagagtcaccatcacttgccaggcgactcagaacatctactaacttttaatcgtatcaagactaaaaactgggactcggaccctaactcctagactctaccgtgacatccagtttggaaacgtgggtacccatcgaacggttcaaggtcgggaagtgggaatagtagggaacctagttacttttaactttcgaacctattccgagtacctagccgttagaccgtaacggtaccggaagtagttttacgacctaaactattaacgttacgtcgtacgaacctagtcgtcgttaacccttccttcccttacgttcggtttcggaccgtacggggaccctacgtaccgtacgattaaccgaaaccgtactacggtcgtaccgtacaccgtaaccacgttactcgtacctcgtaaccg

SEQ ID NO: 47804 - DNA, 756 bp, Homo sapiens
  misc_feature: GYAE6OF01DNY42.25.76.G10.1.454.CMB.1.raw
  modified_base (105)..(105): a, c, t, g, unknown or other
  misc_feature (105)..(105): n is a, c, g, or t
  modified_base (152)..(152): a, c, t, g, unknown or other
  misc_feature (152)..(152): n is a, c, g, or t
  modified_base (206)..(206): a, c, t, g, unknown or other
  misc_feature (206)..(206): n is a, c, g, or t
  modified_base (289)..(289): a, c, t, g, unknown or other
  misc_feature (289)..(289): n is a, c, g, or t
tcagactgtacagtcacgaccggtgctcgatttagtcactcatacagggggcaggagtcagtcccaaccaggacacagcatggacatgagggtccctgccccctnagctcctggggctcctgctgctctggctctcgaggtgccgagaggtnacatccacagtcgacccagtcctccactccctcctgtctgcatcgtggaggganacaggactaccactataccacgttcggccaggaccgacacgaacgaactactacttaacttaaactttttaaagtaggttaanaccgtaagtaaccgtaaaaccgtagggtaacgtacccggtaaaccccttaaacctccgtacggtaccttaccgttaacccgttcgtaaccgtaaccgttacggttaacgggttaaaccggaaccgggttaacccggaaccgttaacgtaaccggttaacgttacggtaaagggtaagggtaaggtaggtaacggtaacgtaagggttaacttaacgtttttaaccttttaacttaaccgtaactacgtacgacaccgtacgttacgacggtacgtaacggtaacggttaattacgttaacgaacctaagtacttacgtactacgtaactactactcgttaacctaccgtaccttccgttcgggttacgtccggtaccgtaccggtacccgtacgtacgaacgtaccgtaaaccaggttactaggtcgtaacgccaaccgttctactacgtacgttctccggttaccc

SEQ ID NO: 47805 - DNA, 665 bp, Homo sapiens
  misc_feature: GYAE6OF01A2V9Z.25.76.G10.1.454.CMB.1.raw
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtggggggtccctgagactctcctgtgtagcctccggattcagcttcagcaaatatagtgtagaacgtgggtccgccaggctccgaggggaagggctgggagtgggtcgctagttcgtgagtagtagtagtacttaataaatactacgacagagtcaggtggagggcctagttccactatccgtaccaggacgaaccaacacccgaagacgtacttagttttttcgttccaggtaacctaaaattcggaaaccacggtcccgttaggaacggtacggacccggtaaggggtaccttaaccggggtcttacgttaggtttaactttaggttcgtcgggacgtaaggaactaacgtaaaaggaacggaactaggggttccgggacgtttggggaacccttttgggaaacccgtttcgggcgggggtaaccccgtaaaccgggggg

SEQ ID NO: 47806 - DNA, 743 bp, Homo sapiens
  misc_feature: GYAE6OF01CJUV5.25.76.G10.1.454.CMB.1.raw
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
tcagactgtacagtcacgaccggtgctcgatttagtcactcatacgagggggagagaggagccttagccctggattccaaggcctatccacttggtgatcagcactgagcacgaggatcaccatggactgggctccgcgttgggttttcctgttgcttatttagaggtgtctgtgtgaggtgcaagtggtggaggtcgtgggggagtccgtggtacaggccggtcgggggtcctgacgtctcgtccgtgtgtacgccgtacggtnttccgngtcttacacgtataaatagtaggtgtaggtacggtggtcccgcgacggtccgtaccgggaagggggaacgggtcggtagggtacggtcgggtaccggtattaacggttcggtaagggtaggttaagggttaagttaaaccgtaatttaaagtaaactacgtaacgtacgaagtacgtacgagggtacggaacggggaccttagtactacgtattccgacgtaagaacgtaccaaacccgagaagntacgttttnttagttacgagtaaacttaaagacgaacgtacgaccggttaaggaacggtaccggtaaccggaagggtaacgttaacccggggtcctttaaggtttaacttcgttttaagtggtaacgaacgtacgggaaacttaagtaaaagggaacaccggtttaggccggttaagggttcgtaccgttaggaaccgtttcggggacccgggtacgggtaaccccg

SEQ ID NO: 47807 - DNA, 627 bp, Homo sapiens
  misc_feature: GYAE6OF01BQIP0.25.76.G10.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcgaggtgccagaggtgacatccacatgacccagtctccatccctccctgtctgcatctggtggganacagagtccaccatcacttgccaggcactcagaactntactaactaacttttaatgtatcagacaaaccgtggatccgacccctaactcctagacctactacgtgccatccgtagtttaggaaaccgtacgggtacccaatcgtaaggtcgagtggtaagtagtatagtagggtactaagttttacttttacttacaccgtataccgtagaccagtacccgttagacccgtaacggtaccggtaagttacgtttacgaaccttaactatttaactacgtctactaactacgttcgttaccttaaccgtcctttacccgttcgtttcggtttaccgaccggaaccgggtaccctacccgtcggaataccgtaacgaacgttacgtggtcgtaccgagccctaacgttcttccgtacttctaaccgttcccg

SEQ ID NO: 47808 - DNA, 660 bp, Homo sapiens
  misc_feature: GYAE6OF01AN7TZ.25.76.G10.1.454.CMB.1.raw
  modified_base (195)..(195): a, c, t, g, unknown or other
  misc_feature (195)..(195): n is a, c, g, or t
  modified_base (643)..(643): a, c, t, g, unknown or other
  misc_feature (643)..(643): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctggtggganacagagtcacatcacttgccaggcgactacaagaacactactaactaacttttaaattggtatcagacaaaaccgtgggatcggacccctaaactcctagactcctaccgtgacacttccgtagtttacggaaaccgacggggtacccaagtacgtaaggttccgaaggtagggaacgtaggtacgtaagtacgggaacttaagtttatttttaacctttctaccctactacgagactacgtcctgacacggacggtaacgtatttagacctaataattaattacgtacgtacaactacgtttactccgttaaccttccctttacccgttcccgtttagggttttaccggacccggtaccgggtacccctaccggttacgaaacgtaccgtaacgtaaaaccggtacgtcgggttcggacctccggaacctaccgtaacttcccgttnttaccgttccttacccg

SEQ ID NO: 47809 - DNA, 824 bp, Homo sapiens
  misc_feature: GYAE6OF01A2A5F.25.76.G10.1.454.CMB.1.raw
tcagactgtacagtcacgaccggtgctcgatttagtcactcatacagggggagagaggagccttagccctggattccaaggcctatccacttggtgatcagcactgagcaccgaggattcaccatggaacgtggggctccgcttgggttttccttgttgcttattttagaggtgtcctgtggggtgaggtgcaactgggtggagtcggtgggggaggccgtggtcaaggccggtcggggggtccctggacgtaccttcgtcctggtacgtacgcccgttcggattcagtcttcgagacaaaattatagttgtacgtaacgtcggggtcccgaccgacgggtccgtaccggaagggggaacgggggtcgtaggggtacggggttggggtccgtacgtacgttttacgggtaggttaacgggttaaggtaagttaacggtttaactttaaagttaaaagtacccgtaacgacggtaaggtacggtttaccggaagggttcggggaacggggtcccgttaagtttacccgaactttaaccgtcccgttaacccggaaagaacccgggtaaaccccaaaaccgaccccggaaaaggtaccgttaccttttaggtttttttacgtttacccagtaaacccttaaaagttcggaaacccttacggacccgtttaagggaaaccgacggggtaacccgaaggggttaccgtaaccgtcgtttaacttagggtttactttagttcgggagaccgtaaacgaataacgaaaggtaacacggtagggtgacggtggttctacggttacggaccggtcgggaaccggtacccggg

SEQ ID NO: 47810 - DNA, 759 bp, Homo sapiens
  misc_feature: GYAE6OF01AWK8H.25.76.G10.1.454.CMB.1.raw
  modified_base (139)..(139): a, c, t, g, unknown or other
  misc_feature (139)..(139): n is a, c, g, or t
  modified_base (143)..(143): a, c, t, g, unknown or other
  misc_feature (143)..(143): n is a, c, g, or t
  modified_base (155)..(155): a, c, t, g, unknown or other
  misc_feature (155)..(155): n is a, c, g, or t
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (583)..(583): a, c, t, g, unknown or other
  misc_feature (583)..(583): n is a, c, g, or t
  modified_base (727)..(727): a, c, t, g, unknown or other
  misc_feature (727)..(727): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcgaggtcncagnggtgacatccanatgacccagtctccactccgtcctgtactgcctaattccgnggtgggactacgaggtcctcaacntcctacgtcgccaggcctaactcgaagaactactacctaacttaacgttttaagtcggttaactacaagtaaccgaaaaccgtaggtacttaccggaaaccccttaacgtaccgtacgtactaccgtttaccgacgtccgtaacttaccgttaaccgggttaagaaacccggtaccggggttactaaccgttaaggtaaaccggttacgtaacgggttaaggtaacggttagggtaaacgtacggtaacgggtaacttaacgttttacttttacgtactaaacgtcgtttacactaccgtaacggtcttacggaccgacgtaacgtaagtttccttaggaaccctataacgttacttacggtntaccgtaagtacctgtttccttaacctttcccgtacgttttcgtaccggttacggtacccggtaagggccccttacggtaacgtacgtaaccgttaacccggtaattacccgtagggtccgtacgttaccacgggtttaacccncgggttaaccgtttcttaaccgtccttacccg

SEQ ID NO: 47811 - DNA, 657 bp, Homo sapiens
  misc_feature: GYAE6OF01EIXWG.25.76.G10.1.454.CMB.1.raw
  modified_base (150)..(150): a, c, t, g, unknown or other
  misc_feature (150)..(150): n is a, c, g, or t
  modified_base (164)..(164): a, c, t, g, unknown or other
  misc_feature (164)..(164): n is a, c, g, or t
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccaggaggtgacntccacatcgacccngtctcatcctcctgtctgcatcgtgtgggancagagtcaccatcacttgccagcgacncagacatctaacttaacttttaaattggtacttacaagactaaaaccgtggaactacggacccctaaactcctagtntctaccgtgctacgtacctaagttacggaaacgtcgggtacctatacgtaaacgttcgtaacgtgggaacgttaggattacggtagggtaactaacgtttaatttttaccgttaccgtaccgtattacaagtccaacggtcctgaccgtaacggtaccgtaagttactttacgaactaactattaacgttacgtacgttacaaccgttcttccgttaccttaccttaccgttccccctttaggtttcggttttaccggaccggtaaccgggtaccctacccgtacgtaacgtaacctttacgaaaccgttacgttcggcgtacgtcgaccgtactacgtccgttattccgtctacccg

SEQ ID NO: 47812 - DNA, 701 bp, Homo sapiens
  misc_feature: GYAE6OF01C7RAL.25.76.G10.1.454.CMB.1.raw
  modified_base (139)..(139): a, c, t, g, unknown or other
  misc_feature (139)..(139): n is a, c, g, or t
  modified_base (670)..(670): a, c, t, g, unknown or other
  misc_feature (670)..(670): n is a, c, g, or t
tcagactgtacagtcacgaccggtgctcgatttagtcactcatacagggggcaggagtcagtcccaaccaggacacagcatggacatgagggtccctgctcagctcctggggcctcctgctgctctggctctcaggtcnccgagaggtgacactccacactcgaaccctagtcctccactccctcctgtctcgctactcgtgggtagggaacacgaggtactacccaacctactacctacgttccggacccggtaacggccgtaacctaacgaaacgtaaacctactaaccttttaaaacctttaaaacttttttaaagttacggttaacctaacgtaaaccggtaaaccgtaaaaaccgggttcgggaaccgttacccggttaaacccccttaaccgttaccgtacgtaccttaccgtaccgtacgtacctacttaccggtaacggttaacggaacggtaccggtacctaacgtacgtaggtacgacgggtaggaggtagtacgtagtacgtattatttactttactactactatacatcgactcgtgacgagtacgtagtattacgatatacttactactgacacgtctactctaccttcgtaccgttcgtacgttcgaccgtacgaccctacggacgtactacgaacgtacgattcgggcaccgtanaccttaccttattcctacgtctccgttaccc

SEQ ID NO: 47813 - DNA, 943 bp, Homo sapiens
  misc_feature: GYAE6OF01CAG2K.25.76.G10.1.454.CMB.1.raw
  modified_base (204)..(204): a, c, t, g, unknown or other
  misc_feature (204)..(204): n is a, c, g, or t
  modified_base (865)..(865): a, c, t, g, unknown or other
  misc_feature (865)..(865): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtcgccaggaggtgacatccacatcgacccagtcctcctacttccctccctgtctgctatctggtggganactagacgtcacatcacttcgcgaggccgactacaagaactacttaccttaacttaaacgtttttaaagttcggtaacttaccgaacggtaaaccgtaaaaaccggttcggggtaaccgttacccgggtaaccccctttaaaaccgttacccgttaacggttaaccgttacccgttaaccggttcggtaccttaaaccgttacccggttaaacgggttttaaccgggaaaaccggtaccgggggttaaccccctaaaggttaccggtaaacggttttaccggtaaagggttacgggggtaaaggtacgggtaaagtttacggttaacggggtaaactttaagtttttaacctttttaacccgtttaacctaacccgttaacgttaccgaacggtaccgtaaccggtaccccggtaggtacccggtaaccgggtaaccgggttaaacgtttaccgttttaacgggaacccttaaactttaaacggtttaacctttaaccttaacgtttaaacccgtaacttaaccgttacgtttaccctttaacccttccccgttttaacccgtccgggttttaaccggggttttacccgaacccgggttaccgggtaaccccgtaacccggttaccgaaacgttacccgtaaacgtaaaaccccgggtttntaaccgggttcccggtaccggttaccaaccggttacccttaacggttccctttacgttcccgtttaccgtttaccccg

SEQ ID NO: 47814 - DNA, 619 bp, Homo sapiens
  misc_feature: GYAE6OF01BAFS9.25.76.G10.1.454.CMB.1.raw
  modified_base (525)..(525): a, c, t, g, unknown or other
  misc_feature (525)..(525): n is a, c, g, or t
  modified_base (603)..(603): a, c, t, g, unknown or other
  misc_feature (603)..(603): n is a, c, g, or t
  modified_base (606)..(610): a, c, t, g, unknown or other
  misc_feature (606)..(610): n is a, c, g, or t
  modified_base (613)..(619): a, c, t, g, unknown or other
  misc_feature (613)..(619): n is a, c, g, or t
tcagactgtacagtcacgaccggtgctcgatttagtcactcatacagggtcctgggcccagtctgtactgacgcagccgccctcagtgtctggggccccaggcgagagggtcaccatctcctgcactggggacagttccaatatcggggcaccttataatgttcactggtatcaacaacttccagggacagccccaaactcgtcattcatgctgataacaatccgtccctcaggtcgtccctgaccgtattccgtccggctcctaagtctcggccacctcgacgtccctcccgtggtactactcacgtcgggtcctccgagtacgtggacggtagtaggtaaggttagtaactttactacgtcgacctagtacctagtacgaacaacgacgcctagtcggttggtttcggtccggttcgggccgggtacgggaaccgtagggtcgtccgtaccgtaccgtaacgtcgacgacccgtaagtccgtccggtccccgtcggtacctaccgttccgtcccgttcccccncccttcctcctacgtcgttaccgtacgtcgtacggtacggccgggtacgtcgggacgtaacgggccgtactagtacgngcnnnnngcnnnnnnn

SEQ ID NO: 47815 - DNA, 864 bp, Homo sapiens
  misc_feature: GYAE6OF01CXAA3.25.76.G10.1.454.CMB.1.raw
  modified_base (848)..(848): a, c, t, g, unknown or other
  misc_feature (848)..(848): n is a, c, g, or t
tcagactgtacagtcacgaccggtgctcgatttagtcactcatacgagggggagagaggagccttagccctggattccaaggcctatccacttggtgatcagcactgagcaccgagatcaccatggacgtggggcctccgtcgtttcgggttttccttgttgtctttagttttaaggaaggttcgttccgttggtggtggtaggtcgactaacggttggggtgggtacggtcgggtggggggcggtccgtgggtaccgaacgggtcccgggtcggggggtccctggacgtaccttcgtccgtggtcgtaccgtcccgtccggtattcgagttccttacgaagtaactaaagttagttaggtacgtacggtaccgggtccgggtaccccgaccggacgggtcccgtaccgggggaagggggtaaccggggtcggtaggggtcggttacggggtccgtacggttacggtttacggtaagggtagtttaaaggtaacggtttaaaccgtttaagtttaaaacgtaaacgttaacccggttaaccggacgaagggtacggtccggtaaggggtacggggaccggtaccttacgttacgaaccttacgtacccgtaaccgtaagaaaccaaaccgaaaccctaaccggtaaagtacgttttacttttacgttttacgggttaaccaagttaaaccgttaaagcgggaaaccctgggtaaccgtgaaccgggtaacgccgtaagtcgtaccgtcttagttcgttaattcgtggcgtaccaagtaagtaaagacggagtaccgtgggttacccggaagttcccgggttaactacgtacccgggttacccgggggnggtaacccggtacggg

SEQ ID NO: 47816 - DNA, 970 bp, Homo sapiens
  misc_feature: GYAE6OF01EZ6A5.25.76.G10.1.454.CMB.1.raw
  modified_base (177)..(177): a, c, t, g, unknown or other
  misc_feature (177)..(177): n is a, c, g, or t
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
tcagactgtacagtcacgaccggtgctcgatttagtcactcatacagggggagagaggagccttagcccctggattccaaggcctatccacttggtgatcagcactgagcaccgaggattcaccatggacgtggggcctccgcgttgggttttccttgttgcttagttttagaggtntctgtgtgaggtgcacgtggtggnggtcggtgggggacgtccgtggtaccaacggtccgggtcgggggttcccnggacgtaccgttcctcccgttgtcgtaccgtcccgtccggtattccgagtccttacgaagactaaaatacgtagttacggtacgtacggtccgggtacccggccgtacgggccgtaccggggaaggggggtaacggggtcggttggggacgggttcggggtaccgtcgttaacgtttcggtacggtaaggttaacggttaaggttaacgtttaaaccgttaaagttaaaactaccggttaacgacgtaacggtagtacggtacgggtacggggaccgggttaccgtaccgtttacccgaacgtttaccttacccgtaacccggtaaagaccccggtaaaaccaaaccccgtaaacccgtaaagggttaccgtttaaaccgttttttacgttttttccggtttaacgttaacccgggaaaacgtttaaaccgttaccgggaaaccgtaaccggtttcccggtaaagggaccgggtaaacccggtccgggttaaacggttacccgggtacccggttacccgtttacggtttatttttaacccgggttaggttttcggaaacgggtaccggttaaaaccgaaaaatttaaacggggtaaacggtaaacggttaacggggttacggtacgggtttaccccgggggtgttaaacccccggtttggggaaccccggttttaacccggggggaaccgggggtttaaccccccggtaaacccggggg

SEQ ID NO: 47817 - DNA, 746 bp, Homo sapiens
  misc_feature: GYAE6OF01A5FKF.25.76.G10.1.454.CMB.1.raw
  modified_base (130)..(130): a, c, t, g, unknown or other
  misc_feature (130)..(130): n is a, c, g, or t
  modified_base (154)..(154): a, c, t, g, unknown or other
  misc_feature (154)..(154): n is a, c, g, or t
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (713)..(713): a, c, t, g, unknown or other
  misc_feature (713)..(713): n is a, c, g, or t
tcagactgtacagtcacgaccggtgctcgatttagtcactcatacagggggcaggagtcagtcccaaccaggacacagcatggacatgagggtccctgctcagctcctgggctcctgctgctctggcctntcaggtgccagaggtgacatccanatcgacccagtctccatcctccctgtctgcatctaggtgggatacgagcgtcaaccntctaccgtgaccgnggaccgactacgaanaactacgtacttaaaccgtttaaatttttaaagtacggtaattaccgaacgtaaccgtaaaaccggtgggtactcccggtaaccccttaaaccgcgttacgacgtaccgttaccgacgtactaacgtacccggtaagtttaaggaacccggtagggtaccctagtaccgtaaggttcgaaggtaggtaaggtaggtaacgtacggttagggaaactttacttttacgtttttacccttacgaacccttagtaccgtaacgcgttacgcgtacggtcgaacgggtaccgttaacgttatttaccgaactaaactacgtttacgttaacctcctaacgttaacgtcttaacgtttccttacctcccgttcccgtttacggttcgggtttacccgacggaccggttccctaacgggtcctaagtaaccgttacccggaaaagttccttaccgggcgttgaccaccggttaaccttnttacccggtaactttcccctcggttaaaccccg

SEQ ID NO: 47818 - DNA, 701 bp, Homo sapiens
  misc_feature: GYAE6OF01A8OQK.25.76.G10.1.454.CMB.1.raw
  modified_base (137)..(137): a, c, t, g, unknown or other
  misc_feature (137)..(137): n is a, c, g, or t
  modified_base (233)..(233): a, c, t, g, unknown or other
  misc_feature (233)..(233): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtnccagaggtgacatccacatcgaccctagtctccatccctccctgtctgcatcgtggaggagacaggactcacccatcacttcgcctaggaccactnaacgactattacctaacgttaacttttaatggtatacaacgtaactaaaccgtggactccggaacccctaactctagtactcgtaccgtgtacgtactccgttaggttacggaaacgtacgggtaccagtacgtaagttcgaaggtaggtaagtacggtataggtacggtaactattttaactttttaccttacgaaccttacgacgtacgactaccggtctacggaccgtaggtaaccggtaagttacgtttagaacctattaacttacgttaccgttactaccgtaacttaacttcgtttaccttaacccgttcccgtttacccgtttccggttttacgggtttaccggaccccgggttaccggtaaccccgttaccgttaaccggaactacgtaaaccgtaaccgtaacgtcggtccggtcgtacccgtacgtaccgtacttccgttacgttccgttcttacccg

SEQ ID NO: 47819 - DNA, 794 bp, Homo sapiens
  misc_feature: GYAE6OF01EFX7B.25.76.G10.1.454.CMB.1.raw
tcagactgtacagtcacgaccggtgctcgatttagtcactcatacagggggagagaggagccttagccctggattccaaggcctatcctacttggtgatcagcactgagcaccgagatcacatgacgtgggctccgctggttttcttgttgtcttatttagagtgtctgtgtgagtgctagtggtggagtcggtggggagtccgtggtacaacggtccggtcggggggtccctggacgtaccttcctccgtgtcgtacgccgtccggtatcgagtcttacgagactaaatagtagtgtagtacggtcggtccgaccgaggtccgtacggaagggggacgggtcggtaggggtacggttgggtcgcgttaacggtttcgggtaaggtaaggttaaggttaacgttaagttaaactttaaacttaaataccgtaaggacgtaaggtaaggtcgagggtacgggacgggtcctagttactaactacttccgtaacgaagaaccgtaaaccaaaccgaaccgtaaaggtcttaacgttttacgtttttgtaaccggtataacggtaaaataccggtaaacgtcggtccgttaagggaaccggtaaggaacccgggtaagtaccggttaccggttactttacggtttaagtttaagttttggttacgggtacgaacggtaacgtaaagtaaagtaaaacgggtaaccggtcggtaacggggttggtaaccggttacgggttacggtaacggtttaaccgggtacgggggtaccccgggtaaaccggggtaacccccggg

SEQ ID NO: 47820 - DNA, 874 bp, Homo sapiens
  misc_feature: GYAE6OF01EEP62.25.76.G10.1.454.CMB.1.raw
  modified_base (351)..(351): a, c, t, g, unknown or other
  misc_feature (351)..(351): n is a, c, g, or t
tcagactgtacagtcacgaccggtgctcgatttagtcactcatacgagggggagaggaggagccttacgccctggattccgaaggcctatccacttggtgatcagcactgagaccaccgaggatcaccatggaacgtggggtctccggtcgttcgggttttcctttgttgtacttaattttagaacggttcgtctgtggtggaggttcgactaacgtgggtaggtacggtcgggtagggggaggtcccggttagggtaccgaacggttccgggttacggggggtccctaggacgtaccttccgtccgttcggttacgtaccgtccggtcggtaacttcgaacgttccttanaacggtaactaaaacgttgttagttacggtagaccggtacgggtcccgaccgagggtcctaaccgggaggggacgggtacggtgggtaggtcggtacgcttagttcggaggttagttaggttaagtagttaactaagtaaactccgtaacgcgtaaggcttaaggcggggtacggacggggtacctattaccgaacttacgtaccgtaacgaaggtaccgaaaccaaccgtaacgtaaacggattacgtttaagtttttactacggttacgaaacttaagtaagaacctacggtactacggaacggtaccggaacgggtaacgaacggttaccggtcgtttaacgtttaaggttaacgtttacggttaggtacggtaaaccgtaaggaaacccgttaaagggtaaaaccgggaacggtaacgggtaccggggtttacgttacggggttacggtttaacccgggttaaacccgggttagggttaaccgggggtaaccggggtaccccggtaaaaccccgggggg

SEQ ID NO: 47821 - DNA, 531 bp, Homo sapiens
  misc_feature: GYAE6OF02GDYB1.25.76.G10.1.454.CMB.1.raw
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatcacttgccaggcgactcagaacatctactaacttttaaatggtatcagacaaaaacctgggatcggacccctaaactcctgatctaccgtgcatccagtttggaaacaggggtcccatcaaggttcagtggaagtggatagtgggactattatttacttcaccatcagcagcctgcacggccggaagtactttgactaacatacttactgtacaacacttgtcttactctcccttcttggtttcgcctagggtaccctacccgtcgacgtactaccgaaacggtaacttggtacggctagcacctactctacgttcttctaccg

SEQ ID NO: 47822 - DNA, 563 bp, Homo sapiens
  misc_feature: GYAE6OF02FR5FD.25.76.G10.1.454.CMB.1.raw
tcagactgtacagtcacgaccggtgctcgatttagtcactcatacagggggtaggaggtcagtcccaaccaggacacagcatggactatgagggtccctgctcagctcctgggctcctgctgctctggcttcgtcaggtgccaggtacggtgacatcctacatgacccagtctccatcctccctgtctgcatcggtgtgggagacagagtcaccactcacttgccaggcgactcagacatctactaacttttaaattgtaatctagcaaaaacctgggatcggaccccttaaacgttcctgagttcctaaccgtgacgatccgaggttttggaaacgtaggggtaccctatacaaggtttcagtggaaagtggaaatagtggacattacttttactttcaccgtatcacgcagcctcgcagaccgtaagatttacgacaactattacttactgtcaacactgtcttactctcctctcgtttcgccgtaggtacctaccgtcgagactcgaacgtaactcgtaggcctacgccacctacgtaccttacgtcttcgacttacccg

SEQ ID NO: 47823 - DNA, 538 bp, Homo sapiens
  misc_feature: GYAE6OF02GWI7I.25.76.G10.1.454.CMB.1.raw
  modified_base (436)..(436): a, c, t, g, unknown or other
  misc_feature (436)..(436): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtctgggggaggcctggtcaagcctggggggtccctgagactctcctgtgtagcctccggattcagcttcagcaaatatagtgtgaactgggtccgccaggctccgagggaaggggctgggagtgggtcgcattcgtgagtagtagtagtacttataaatactacgcagagtcagtggagggccattcactatctccagagacaacaccaagagctattttgttctgctaaaatgaacngcctgagagccgaggatacggctcgtgtattattgtgcgtagacaagtaaagaagacaggtggcgtggggtcttaggacctacggtcggggacctaacgggg

SEQ ID NO: 47824 - DNA, 583 bp, Homo sapiens
  misc_feature: GYAE6OF02GJUYV.25.76.G10.1.454.CMB.1.raw
  modified_base (298)..(298): a, c, t, g, unknown or other
  misc_feature (298)..(298): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatcacttgccatgcgactcagaacatctactaacttttaattgtatcagacaaaaccgtggatcggacccctaaactcctagactctaccgtncatcctagtttacggaaacgtacgggtccatacgtaaggttcagtaggaagtgatagtaggactattattttacttacacctatcagcacgcctgcagcctagaatacttctacgacctaacttattattcgtaactaaacttaaagtttaacgtacctttaccctcttaccgttaccgttccgggacggtaacgggaaccgtaagggtcgaacgtacgtaaccgtaaacgtaacgtcggttacggacgttacgacctaaccgtacttacgttcgtccgtttacc

SEQ ID NO: 47825 - DNA, 545 bp, Homo sapiens
  misc_feature: GYAE6OF02IV0K3.25.76.G10.1.454.CMB.1.raw
  modified_base (194)..(194): a, c, t, g, unknown or other
  misc_feature (194)..(194): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtggganacagagtcaccatcacttgccaggcactcagacatctacaacttttaatggtatcagacaaaaacctggatacggcccctaaactccttgactctaccgtgcataccagtttagaactagggtcccatcaaggttcagtggaagtggatanggacatattttacttnacatcagtcagcctgcagccggaagtactttgactaacattactactagaccctaaataataattaaataattaacttacgaaccttacttttaggaccctaaagggaccgtaaggtaggagtaataccgtaaaacggaacttggtcggtacctggtacaacctatccgttacgttcttaatcg

SEQ ID NO: 47826 - DNA, 490 bp, Homo sapiens
  misc_feature: GYAE6OF02F6Y9Z.25.76.G10.1.454.CMB.1.raw
  modified_base (241)..(241): a, c, t, g, unknown or other
  misc_feature (241)..(241): n is a, c, g, or t
  modified_base (474)..(474): a, c, t, g, unknown or other
  misc_feature (474)..(474): n is a, c, g, or t
  modified_base (480)..(490): a, c, t, g, unknown or other
  misc_feature (480)..(490): n is a, c, g, or t
tcagactgtacagtcacgaccggtgctcgatttagtcactcatacagggtcctgggcccagtctgtactgacgcagccgccctcagtgtctggggccccaggcgagagggtcaccatctcctgcactggaaccagccgtgacattggtgcttataactatgtctcctggtcccaacaacacccaggcaaggcccccaaactcatcatttatgatgtcagtcatcggccctctggagtttcnggtcgcttctctggctccaagtctggcaactcggcctcctgaccatctcggggctccaggctgaggacgaggctacttattattgctatttcatacagagacaccaacagtctggtgttcggcggagggaccaagttcgaccgtccgtcggtcacgcccaaggcctcgccccctcggtcactctcgttccccgccctcctcacctgtaccagtctgagcgggctggcaaggcncgatgnnnnnnnnnnn

SEQ ID NO: 47827 - DNA, 536 bp, Homo sapiens
  misc_feature: GYAE6OF02GRTN4.25.76.G10.1.454.CMB.1.raw
  modified_base (194)..(194): a, c, t, g, unknown or other
  misc_feature (194)..(194): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtggganacagagtcaccatcacttgccaggcgactcagaacatctacaacttttaaatggtatcagcaaaacctgggatggcccctaaactcctgatctaccgtgcatccagtttggaaacaggggtcccatcaaggttcagtggaagtggatagtgggacattattttacttcaccatcagcagcctgcagccggaagtattttgctaacatattactgtacactactgtcttacttctccctccttggttttcgcccgacgggtacccaccctcggtacgtacgtaccgtaaaccggaacttcggtacggcttggacctacctattacctggttcctacttacccg

SEQ ID NO: 47828 - DNA, 515 bp, Homo sapiens
  misc_feature: GYAE6OF02FJSO3.25.76.G10.1.454.CMB.1.raw
  modified_base (194)..(194): a, c, t, g, unknown or other
  misc_feature (194)..(194): n is a, c, g, or t
  modified_base (475)..(475): a, c, t, g, unknown or other
  misc_feature (475)..(475): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtggganacagagtcaccatcacttgccaggcgactcagaacatctacaactttttaaatggtatcagacaaaaacctgggatggacccctaaactcctgatctaccgtgcatccagtttggaaacaggggtcccatcaaggttcagtggaagtggatagtgggacattattttacttcacctatcagcagcctgacaggccggaagtattttgactaacatattactgtacaacactgtcttactcctcccttcttggttttcgccgtagggtacccacccgtcganactacgaaacgactggtgctgaccacatctgttcttctac

SEQ ID NO: 47829 - DNA, 509 bp, Homo sapiens
  misc_feature: GYAE6OF02F02ZJ.25.76.G10.1.454.CMB.1.raw
  modified_base (505)..(505): a, c, t, g, unknown or other
  misc_feature (505)..(505): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatcacttgccaggcgactcagaacatctacaacttttaaatggtatcagcaaaaacctgggatggcccctaaactcctgatctaccgtgcatccagtttggaaacaggggtcccatcaaggttcagtggaagtggatagtgggacattattttacttcaccatcagcagcctgcagccggaagattttgacaactatattactgtcaactactgtcttactcctcccttcctggtttcgcctacggggacctacccgtcgagactacgaaacgactcgtcgctgcacctatctgttcttntacc

SEQ ID NO: 47830 - DNA, 558 bp, Homo sapiens
  misc_feature: GYAE6OF02HQXUT.25.76.G10.1.454.CMB.1.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtcctccatccctccctgtctgcatctggtggganacagagtcaccatcacttgccaggcactcagaacatctactaactttttaattggtatcagacaaaaccgtgggatcggacccctaaatcctgactctaccgtgcatcctagttaggaacncggggtccatcaaggttcagtggaagtggatagtggactattattttacttcactattcagcagtcctgcagaccggaagtactttgactaactattattactgtacaactacttgttaccttacctcctcccttcgttcggttttcgccgtacgggtaccctaccgtacgacgtactaccgaaacgtactggtacggtctacggacctaccgtacttccgttacgttccttactacccg

SEQ ID NO: 47831 - DNA, 666 bp, Homo sapiens
  misc_feature: GYAE6OF02FQ7JC.25.76.G10.1.454.CMB.1.raw
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatcacttgccaggcgactcagaacatctacaacttttaaatggtatcagacaaaacctggatggacccctaaactcctgatctaccgtgcatccagtttggaaacaggggtccatactaacgtacgtacgtaggtaaggtaggtagtagtaggtacgaattaagttttaacttttacttaccgtaactactacgacgacgtacgtcgtcgacgtaccgggaacgtaagtttacgttacgaactaactatttaacttacgttacgtaacctaacttacgttacgtttaccttaccgttacccctttcccgttccggtttttcggtttacccggtaaccgggttaacccgggtaccccgttacccgtacggtaacgttaaccgtaaaccggtaaacccgttacggttacggtaccggtacgtaccgaaccctacttaccgttccgttaccgttaccttacccg

SEQ ID NO: 47832 - DNA, 569 bp, Homo sapiens
  misc_feature: GYAE6OF02H892Q.25.76.G10.1.454.CMB.1.raw
  modified_base (199)..(199): a, c, t, g, unknown or other
  misc_feature (199)..(199): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (383)..(383): a, c, t, g, unknown or other
  misc_feature (383)..(383): n is a, c, g, or t
  modified_base (476)..(476): a, c, t, g, unknown or other
  misc_feature (476)..(476): n is a, c, g, or t
tcagactgtacagtcacgaccggtgctcgatttagtcactcatacagggggcaggagtcagtcccaaccaggacacagcatggacatgagggtccctgctcagctccgtggggctcctgctgctctggctctcaggtcgcccaagagggtcacatccacatgacccagtcctcatcctcctgctgcatcgtggtggaanaccaggagttcaccattcaccgttgcccaaggcaacttcaagaccatctacaattttaaaattggaatccagacaaaaacctgggatacggcccctaaacncctgaattcaccggtnacactccaggtttagaaaactcgggggtaccaattccaaacggttatagtagggaattgggaattanaggggacctaattaacttttaactttcaaccaattccaagggcctaggccttgacccagtccgaaagtatttggacaatatatacccggttanacactatcgtctactcctcttcgttgttacgtcgacgccctacgacgacacgacaacgtctgtcgtctcgactacctatcgttctctctaacc

SEQ ID NO: 47833 - DNA, 500 bp, Homo sapiens
  misc_feature: GYAE6OF02GCNVE.25.76.G10.1.454.CMB.1.raw
  modified_base (230)..(230): a, c, t, g, unknown or other
  misc_feature (230)..(230): n is a, c, g, or t
  modified_base (485)..(485): a, c, t, g, unknown or other
  misc_feature (485)..(485): n is a, c, g, or t
  modified_base (487)..(488): a, c, t, g, unknown or other
  misc_feature (487)..(488): n is a, c, g, or t
  modified_base (490)..(500): a, c, t, g, unknown or other
  misc_feature (490)..(500): n is a, c, g, or t
tcagactgtacagtcacgaccggtgctcgatttagtcactcatacagggtcctgggcccagtctgtactgacgcagccgccctcagtgtctggggccccaggcgagagggtcaccatctcctgcactggggacagttccaatatcggggcaccttataatgttcactggtatcaacaacttccagggacagcccccaaatcgtcattcatgctgataacaatcgtccctnaggtgtccctgaccgattcctccggctccaagtctggcacctcagcctccctggtcatcactgggctccagactgagatgaagtgattactactgccagtcctatgacacagcctgcgtggtttgtcgttcggcggcgggaccaggtcgctcgtcctaagtcagcccaaggcctcgccccgtcgtcacttctcgttccccgccctcctcactcgtacagttctgacgcgggtctcgggacaagggccgacagagngnnannnnnnnnnnn

SEQ ID NO: 47834 - DNA, 522 bp, Homo sapiens
  misc_feature: GYAE6OF02JHHPI.25.76.G10.1.454.CMB.1.raw
  modified_base (194)..(194): a, c, t, g, unknown or other
  misc_feature (194)..(194): n is a, c, g, or t
  modified_base (312)..(312): a, c, t, g, unknown or other
  misc_feature (312)..(312): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtggganacagagtcaccatcacttgccgggcactcagaacatctacaactttttaaattggtatcagcaaaaacctgggatggcccctaaactcctgatctaccgtgcatccagtttggaaacncggggtccatcaaggttcagtggaagtggatagtgggacatattttactttcaccatcagcagcctgcagccggaagtatttgacaacgtattattactgttacaactactgttcttactctccctcttggttttcgccgtagggtacccaccgtcgacataccaaacgtaactgtacggctacgctaccactctcgtcttctacttccc

SEQ ID NO: 47835 - DNA, 575 bp, Homo sapiens
  misc_feature: GYAE6OF02HU8MY.25.76.G10.1.454.CMB.1.raw
  modified_base (309)..(309): a, c, t, g, unknown or other
  misc_feature (309)..(309): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatcattcgccgggcagtcagggcattggaaatttagtttggcctggtatcagcagaaaccagggaaattcctaacctcctcatctatgctgcactcctactttnctaacgtttcggggtcccttcgtcgtattccaggcgcaggttggtctgggacagattccgactctcaccatcagcacgctgcagcctagaagtagttgttgactaactttagtttaaccgtagtaactaaaactttcgaacgttacgtacggacccgtagggttacttccgggttaccgacccggtaacgggaacccgtaagggtacgtaacctaacgtaaccgtaaaccggaacgttacggtacggtaccgttagaccctaaccg

SEQ ID NO: 47836 - DNA, 537 bp, Homo sapiens
  misc_feature: GYAE6OF02GMLE5.25.76.G10.1.454.CMB.1.raw
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtctgggggaggcctggtcaagcctggggggtccctgagactctcctgtgtagcctccggattcagcttcagcaaatatagtgtgaactgggtccgccaggctccgaggggaaggggctgggaggtgggtcgcattcgtgagtagtagtagtacttataaatactacgcagagtcaggtggagggccgattcactatctccagacgacaacaccaagagctattttgttcngacaaatgaacngctgagagccgaggatacggctcgtgtattattgtgcgagacagtaaagaagtacaggtggactggggcttaggactacggtcggggcctaacgggg

SEQ ID NO: 47837 - DNA, 662 bp, Homo sapiens
  misc_feature: GYAE6OF02IK29Z.25.76.G10.1.454.CMB.1.raw
  modified_base (460)..(460): a, c, t, g, unknown or other
  misc_feature (460)..(460): n is a, c, g, or t
  modified_base (476)..(476): a, c, t, g, unknown or other
  misc_feature (476)..(476): n is a, c, g, or t
tcagactgtacagtcacgaccggtgctcgatttagtcactcatacagggggagagaggagccttagccctggattccaaggccttatccacttggtgatcagcactgagcaccgaggacttcacccatggaactggggctaccgcttgggttttccttgttgctagttttacgaaggtgtcctgtgtggaggtgacaactggtggagtcgtgggggacggcctggtcaagccgtgggggtccctgacgacgtcctccgtgtgtagccgtcggattcgagtccttacgagacaaatatagtgtagaacgtgggtccgccgaggtccttccggagggggaacggggcgtagggaggtgggtcgcgtagttcgtgagtagtagtagtacttataaactacgtacgcagagtacaggtcggacggccgattcgactactctacgagtacgacaacgacgaaagngtactagtttgttacngactaaagtcgaaactacgtccgtaggaacgacgccggaagggtacgtaccgggcttacgttagtttaacttaggtttcgaggtacgtaaggaactaaagtaagggaaaccgtacgtaagggtcgggaccggttggggacttttacggggaaccgtttcggtaccggggggaccctaaaccggggg

SEQ ID NO: 47838 - DNA, 543 bp, Homo sapiens
  misc_feature: GYAE6OF02IM9U7.25.76.G10.1.454.CMB.1.raw
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtctgggggaggcctggtcaagcctggggggtccctgagactctcctgtgtagcctccggattcagcttcagcaaatatagtgtgaactgggtccgccaggctccgaggggaaggggctgggaggtgggtcgcattcgtgagttagtagtagtacttataaatactacgcagagtcagtgggagggccgattcactatctccagagacaacaccaagagctattttgttcngacaaatgaaacngcctagagagccggaaggactacggctctagttattattgtgcgagacagtaagaagacaggtggcgtgggctttgacgttacggtcggggacctaacgggg

SEQ ID NO: 47839 - DNA, 543 bp, Homo sapiens
  misc_feature: GYAE6OF02GEC8D.25.76.G10.1.454.CMB.1.raw
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtctgggggaggcctggtcaagcctggggggtccctgagactctcctgtgtagcctccggattcagcttcagcaaatatagtgtgaactgggtccgccaggctccgaggggaaggggctggagtggggtcgcattcgtgagtagtagtagtacttataaatactacgcagagtcagtggagggccgattcactatctccagagacaacaccaagagctattttgttctgactaaaatgaaacagcctgagagccgaggactacggctcgtgttattagttgtgcgagacagtaaaggaagactaggtcggcttggggcttggacttacggtggggacccaacgggg

SEQ ID NO: 47840 - DNA, 619 bp, Homo sapiens
  misc_feature: GYAE6OF02GTXE9.25.76.G10.1.454.CMB.1.raw
tcagactgtacagtcacgaccggtgctcgatttagtcactcatacagggggcaggagtcagtcccaaccaggacacagcatggacatgagggtccctgctcagctcctgggctcctgctgctctggctctcaggtgccagaggtgacatccacatgacccagtctccatccctccctgtctgcatctgtgggagacagagtcaccatcacttgccaggcgactcagaacatctactaacttttaatggtatacagacaaaaccgtggactacggacccctaaactcctgactcctaccgtgctatccgtagtttaggaaactacggggtacccatctaaggttcagtaggagtaggatagtgggactattacttttacttcacctatacacgacgtagcctagacgtaacggacggtaagttattttacgacctaaacgttattaactttaacttcgtaaccaactacgttcgttaccctttaaccgttcccttacccctttcggtttacgggttttcggtcccggtaacgggtaacccctacccgttaccggtacgtaactaccgtaaacgtaaccgttgtacggtcctaggaccacgtacttctacgtactctaccg

SEQ ID NO: 47841 - DNA, 755 bp, Homo sapiens
  misc_feature: GYAE6OF02FLFP9.25.76.G10.1.454.CMB.1.raw
  modified_base (208)..(208): a, c, t, g, unknown or other
  misc_feature (208)..(208): n is a, c, g, or t
  modified_base (267)..(267): a, c, t, g, unknown or other
  misc_feature (267)..(267): n is a, c, g, or t
tcagactgtacagtcacgaccggtgctcgatttagtcactcatacagggggcagggagtcagtccccaacccagggtaccacagcatggtacatgagggtccctgctcagctcctggggctcctgctgctctggctctcaggtgccagaggtgactatccacatgacccagtctccatcctcctgtctgcatctggtgggagacaggngtcaccatccacttcgccaggccgactcagaacatctactaactttttaaatgtatcanacaaaacctgggactcggacccctaaactcctagactccgtaccgtgacctattccgtaagtttacgggaaacgtacggggtacccctaagtaccgtaaggttcgaaggttaggtaaggttaggtaattaacggtagggtactaagttttactttttaaccgttccaaccgtatactaacgtacaccgtcctacggacctacgggtacccggtaaagttacgttttacgaacctaaacgttaagtttaactttacttacgttaactaaacctacgttacgtttacctttaaccgttcccgtttaccccgtttcccgttttacggggtttttaccgggaaccccggttaacggggggtaaccccctaccccggttaaccgggtacgtaaccgtttaacccgtaaaacgggtaaccgttacggggttccgaccggttaacgtacccgtaaccgtacgtttacccggttcggtttaccttacccttacccg

SEQ ID NO: 47842 - DNA, 570 bp, Homo sapiens
  misc_feature: GYAE6OF02IWTAW.25.76.G10.1.454.CMB.1.raw
  modified_base (437)..(437): a, c, t, g, unknown or other
  misc_feature (437)..(437): n is a, c, g, or t
  modified_base (464)..(464): a, c, t, g, unknown or other
  misc_feature (464)..(464): n is a, c, g, or t
  modified_base (524)..(524): a, c, t, g, unknown or other
  misc_feature (524)..(524): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtggggggtccctgagactctcctgtgtagcctccggattcagcttcagcaaatatagtgtagtaacgtgggtaccgccaggcctaccgaaggggaacggggctgggaggtggggtcgcagttcgtgaggtagtagtagtattaataaatactagcagagtcaggtggaaggcgattcgaactatctccaaggaacgaacaaacaaccaagacgntaagttttgttctgactaaatgaaacngctagagagaccgagtatacggctgtagttaattatggtgacgaggaacagtaaaggaanacgtaaggtcggactgggcttagacgtacgtggggacctaacgggg

SEQ ID NO: 47843 - DNA, 603 bp, Homo sapiens
  misc_feature: GYAE6OF02IJI4Q.25.76.G10.1.454.CMB.1.raw
  modified_base (307)..(307): a, c, t, g, unknown or other
  misc_feature (307)..(307): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctggtgggagacagagtcaccatcacgttgccaggcgactcagaacatactactaacttttaaattgtatcagacaaaaccgtgggactacggacccctaaactcctagtactcctaccgtnctactcctaagttaggaaacgtcggggtcccatacgtaacggttcgaaggtaggaagtggaatagtagggtaactaagtttacttttaccttacaacctagtacgagtcctagtcctgacacggaccggtaagtgtttagacaaacgtattaattactagtacaactacttgtaccttacctcctcccttcgtttggtttccgaccgtacgggaccctaccgtacgagactaacgaaaccgtacgttggtacggcctacgaccctacctagttccgttacgttcccttactacccg

SEQ ID NO: 47844 - DNA, 620 bp, Homo sapiens
  misc_feature: GYAE6OF02H9P7E.25.76.G10.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
  modified_base (403)..(403): a, c, t, g, unknown or other
  misc_feature (403)..(403): n is a, c, g, or t
  modified_base (528)..(528): a, c, t, g, unknown or other
  misc_feature (528)..(528): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtcctccatcctccctgtctgcatctggtggganacagagtccaccntcacttgccaggcactcagaacactctaactaactttttaatggtatcaagacaaaacgtgggatcggacccctaaatcctagactcgtacctnctactcgtagttacgaaacgngggtcccatcgaagttcaaggtggaagtggataggtggactaatttacttttacctcactagtcaagctacggctgacnggaccgtaagttatttcgaactactaattaactttacgacgtactaaacacgtttctaccgtttaactcccgtttccctacggtttcggtttaccgggacccgtaaacgggccccttaacccggngtaacgtaacccgttacgaaaaccgttcggttacgtccggtaccgtttcgacccgttaaccgactttcggtttcttacccgtcgttaacccg

SEQ ID NO: 47845 - DNA, 554 bp, Homo sapiens
  misc_feature: GYAE6OF02H8WGM.25.76.G10.1.454.CMB.1.raw
  modified_base (294)..(294): a, c, t, g, unknown or other
  misc_feature (294)..(294): n is a, c, g, or t
  modified_base (442)..(442): a, c, t, g, unknown or other
  misc_feature (442)..(442): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtctgggggaggcctggtcaagccgtggggggtccctgagactctcctgtgtagcctccggattcagcttcagcaaatatagtgtgaactgggtccnccgaggctccgagggaggggctgggagtgggtcgcagttcgtgagtagtagtagtacttaataaatactacgcagagtcagtggagggccattcactatctcagagacaaacaccaagagctattttgtttctagactaaatgaaacngcctaggaacgagccgaggactacgggctctagtattagttgtgcgagacaagtaaagaagacaggtggcgttgggcctttaggaccttacggtcgggggccctaacggggg

SEQ ID NO: 47846 - DNA, 737 bp, Homo sapiens
  misc_feature: GYAE6OF02F8AKX.25.76.G10.1.454.CMB.1.raw
tcagactgtacagtcacgaccggtgctcgatttagtcactcatacagggggcaggagtccagtcccaaccaggacacgagctatggacatgagggtccctgctcagctcctggggctcctgctggctcgtggctctcgtacggtgtccagaggttgacgatcccacatcgacccagtctaccatcctcctgtcgtgctatcctggtcgggagacgagagtacgaccatcctacttgcctaggccgactcgagtaaccatctaactaacttttaatggtatacagacaaaaccgtgggtactaccggtaccctaactcctagactactaccgtgcatcctagtttacggtaacgtacggggtacccagtacgtaacggttcgtaggtacggaaggttggtaataggtacgggtaacttaagtttacgttttaacgtttaccgaacccgtattaccgaacgtacctaacggtcctacggacgtaacggtacccggtaaacgttaatttaccggaactaaacttaactttaactttaaccgttcgtacctaaactaaccgttacgtttaacccttaccgttcccgtaccccgttacggtttcggggtttttaacgacccggttaaaccgggacccttacccggtacgtaacggtaccgtaaccggtaaaccggtaaccgttggtaccgtactaccggttacctaccgttaccgttcgtaccggttacttaccgttacccg

SEQ ID NO: 47847 - DNA, 654 bp, Homo sapiens
  misc_feature: GYAE6OF02GKQF8.25.76.G10.1.454.CMB.1.raw
  modified_base (428)..(428): a, c, t, g, unknown or other
  misc_feature (428)..(428): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatccctccctgtctgcatcgtgtgggagacagagtcaccatccacttgccaggcactcagaacatacttaactaaacttttaattggtatacaacgactaaaaccgtggtactccggtacccctaaacgtcctagtacttccgtaccgtcgctacttcctaggtttacggaaaccgtacggggtaccctatacgaaggttcaagtaggaagtggatagtggtactagtttactttacttcactatacgatcacgtccgtnacgacggtaccggtaagttactttacgactaatacgttaattacgtagtacctaactcttacgttacccttaccttcccgtttcccttaccggtttcgggttttaccggaccggttacccgggtaaccctacccgtacggtacgtacgtaaaccggaaacgtaccgtttcggtaccggttcctacgtacccgaccttacgtccgttcggtttaccctcgttacccg

SEQ ID NO: 47848 - DNA, 547 bp, Homo sapiens
  misc_feature: GYAE6OF02FPXK5.25.76.G10.1.454.CMB.1.raw
  modified_base (194)..(194): a, c, t, g, unknown or other
  misc_feature (194)..(194): n is a, c, g, or t
  modified_base (517)..(517): a, c, t, g, unknown or other
  misc_feature (517)..(517): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtggganacagagtcaccatcacttgccaggcactcagaacatctactaactttttaaatggtatcagcaaaaactgggatcggacccctaaactcctgactctaccgtgcatccagtttaggaaacgaggggtcccagtcgaaggttcagtggaagtggatagtgggactattattttacttacacctatcagcagtctgcacggcgaagtatttacgcaaactatattactcgtacaactacttagtcttacttcctacccttccgttcggttttcggcctaacggggtacctaccgtacgtagactaacgtaaacgtaacgttcggngtacctgactaccattcgcttactctaccg

SEQ ID NO: 47849 - DNA, 595 bp, Homo sapiens
  misc_feature: GYAE6OF02HH0QR.25.76.G10.1.454.CMB.1.raw
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatcacttgccaggcgactcagaacatctactaactttttaatgtatcagacaaaacctggatcggacccctaactcctgactctaccgtgcatccagtttaggaaacgacggggtcccatcaaggttcaggtggaagtggatagtgggactattattttacttcacctatcagtcagcctagccgagacggtaatagttttagacctaaatacttaattaacgttgtacctaaactacttcgtacctttaaccttccttccccttacgtttcgggttttacggcccgtaacggggaccctacccgttcgaacgtacttaacccgaaaacgtaccgttaggtaccggtacgtacgacctacccgtaatccgttcgtttaccttcgtaaccc

SEQ ID NO: 47850 - DNA, 521 bp, Homo sapiens
  misc_feature: GYAE6OF02HCTPS.25.76.G10.1.454.CMB.1.raw
  modified_base (313)..(313): a, c, t, g, unknown or other
  misc_feature (313)..(313): n is a, c, g, or t
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
  modified_base (424)..(424): a, c, t, g, unknown or other
  misc_feature (424)..(424): n is a, c, g, or t
  modified_base (507)..(507): a, c, t, g, unknown or other
  misc_feature (507)..(507): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (520)..(521): a, c, t, g, unknown or other
  misc_feature (520)..(521): n is a, c, g, or t
tcagactgtacagtcacgaccggtgctcgatttagtcactcatacagggtcctgggcccagtctgtactgacgcagccgccctcagtgtctggggccccaggcgagagggtcaccatctcctgcactggggacagttccaatatcggggcaccttataatgttcactggtatcaacaacttccagggacagccccaaatcgtcattcatgctgataacaatcgtccctcaggtgtccctgaccgattctccggctccaagtctggcacctcacgcctcctggtcatcactggctccagctgaggatgaaggtnattacatgcctagtcctatcgacaacngtcctgcgttggtttcggtcttcgggcggcggacagggtcnctcgtctagtcacgccagctcgccctcgtcactctcgttcccnccctcctcactcgtactacgtcgtaggacggtcgggcgttcgggaccgtaacgggccgtaccgtacgttaggcgcgtgctgcngcgcgcncgcncnn

SEQ ID NO: 47851 - DNA, 589 bp, Homo sapiens
  misc_feature: GYAE6OF02GAVGK.25.76.G10.1.454.CMB.1.raw
  modified_base (194)..(194): a, c, t, g, unknown or other
  misc_feature (194)..(194): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtggganacagagtcaccatcacttgccaggcgactcagaacatctactaacttttaaattggtatcagacaaaaacctggatcggacccctaaactcctgatcctaccgtgactactcctagtttacggaaacacggggtcccaagtacaaggttcaggtggaacgtggaactagtagggactagttattttacttcacctatcagcagtctgcagtacgtaagtatttacgactaatattacttactatacaactacttagtcttaaccttcttacccttcgttaggttttccggcccgtacggggtaccctacccgtacgtacgtaacgtaccgtaaacggtaacttcggtacggtcttacgaccaaccgttacttcgttccgttaccttaccttaccg

SEQ ID NO: 47852 - DNA, 959 bp, Homo sapiens
  misc_feature: GYAE6OF02J1EXE.25.76.G10.1.454.CMB.1.raw
  modified_base (196)..(196): a, c, t, g, unknown or other
  misc_feature (196)..(196): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatcgacccagtcctccatcctccctgtctgcatctgtggganacagacgtcaccatcacttgaccgaggaccgtactacaagaacctattaccttaaccttaaacttttttaaagttcgggttaataccgtaacggtaaccctaaaaaaccggttcgggggtacttaccgggtaaccccccttaaaccgttacccgttaggtaaccttccggttaacccggtcggtacctacgttacccggttaacggttttaacggggaaaccggttaccggggggttacccctaaggttaaccgtaacgggtttaccgtaagggttaacgggtaaagggttacgggtaacgttaacggttcgggggtaaacctttaaacgtttttaacctttttttaacccggtttaccctaaccgtaacgtttaccgtaaccggttaccaaccggttaccccgttaggtaccccgggtaacgggttaacccggggttaaaacgtttaccgtttttaaccggaacccgttaaaacttaacggtttttaaacctttaccgtttaaccgggttaaccctaaacgtaaccggttttaggtttaccctttaaccgtttacccccttttaccccgttacgggttttaccggggttttaacccgggacccggtaacccggggtaacccctttaccccggtacgggtaccgtaaccgtttaaccggaaaaccccgggttagttaccgggttaaccggtaccgtttaacccggaccctaacccggttaacgtttcccggttttacctttacccggttaacctttaccccgg

SEQ ID NO: 47853 - DNA, 548 bp, Homo sapiens
  misc_feature: GYAE6OF02F6GN4.25.76.G10.1.454.CMB.1.raw
  modified_base (343)..(343): a, c, t, g, unknown or other
  misc_feature (343)..(343): n is a, c, g, or t
  modified_base (388)..(388): a, c, t, g, unknown or other
  misc_feature (388)..(388): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctcctgtctgcatctgtgggagacagagtcaccatcacttgccaggcgactcagaacatactaactaacttttaaattgtatcagacaaaaacctggatcggacccctaaactcctgatctaccgtgtcatacctagtttacggaaacgtacggggtaccagtacaaggttnagtaggtaagtggatagtggactattatttacttacacatacgancagcctagcagaccggtaagtatttcgactaatatacttactagtacaactactcttcttacttcctacccttccgttggtttacgccgtacgggtaccctaccgtacgagacgtacgaaacgtacgtgtacgtcagaccactattctcgtccttactac

SEQ ID NO: 47854 - DNA, 703 bp, Homo sapiens
  misc_feature: GYAE6OF02G5ZPY.25.76.G10.1.454.CMB.1.raw
tcagactgtacagtcacgaccggtgctcgatttagtcactcatacagggggagagaggagccttagccctggattcccaaggccctagtcctacttggtgtatctagcactgagcaccgaggattcaccatggaactggggctcgctgggtttcctgttgctattttagaggtgtccttgtgtgaggtgcaacgtggtggagtcgtgggggagccgtgggtacaaggtccgtggggggtcccctgggacgtactctcctgtcgtacgccctccggattcagtcttcagtacctaaatactagtggtagtaacgtcggggtccgccgaggcctaccggaggggaagggtcgtagggaggtggggtcgcgtagttacgtgtacgtagtagtacgttacttaataaactacgtacgtacgaagtagtcgaggtcggaacgggtccgtagttccaacttactcctaccgaaggaaccgaacccgaaacaacccgaaggtactacctttagttttttcgttacacgtaactaaaacgtgaaaccacgtcccgtaaggaaggtaccggaccgggtaaagacgttaccgggtacttcgttaagtttacttagtttggacgtcgagtactaaggtaaacgacgtaacgtgggtacggttacgtacgggttctttaggacccggtttcgggtacggggacccctaacggggg

SEQ ID NO: 47855 - DNA, 702 bp, Homo sapiens
  misc_feature: GYAE6OF02I7UQQ.25.76.G10.1.454.CMB.1.raw
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtcctccatccctcctgtctgcatctggtggagacagacgtcaccatccacttacgccaggcactcaagacatctactaacttttaatgtatacagacaaaacgtgggatcggacccctaaacgtctgactctaccgtgctactacacgtttaggaaacgtacggggtccatacgaaggttcagtacggaagtaggtactagtacgggaacttaacgtttaacgttttactttacgacctagtaccgtacgacctacggtccttacggaccgtaacgggtacccggaaaggttacttttcggaacctaaacgtaagtttacttaacgttacgtaacctaaaccgtacgttacgttaccgttaacctttccgttaccccgtttcggtttaccgggttttcgacccgggtaacgggtaaccctacccggttacggtacgttaaccgtaaccgtaaaccggttaacttacggggttaccgtaccgttaccggtaacccacccgttaaccgttcggttaacctttaccgttacccgttaacccg

SEQ ID NO: 47856 - DNA, 704 bp, Homo sapiens
  misc_feature: GYAE6OF02G5SWS.25.76.G10.1.454.CMB.1.raw
  modified_base (197)..(197): a, c, t, g, unknown or other
  misc_feature (197)..(197): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctcctgtctgcatctgtggatacagngtcaccatcacttgccaggcactcagaacatctactaacttttaatgtatcagacaaaaccgtggatcggaccctaactcctgactctaccgtgactactcctaggtttacgaaacgtacggggtaccctaagttaccgtaaggtttcaagggtacgggtaagtacgggaagttacggtacgggaacttagttttaaactttttaccgtttacctaaccgttaacttaccgtaaggtccctaacggtccgttacggacgtaaccggtaaccgggtaaattacgttttacggaaccttaaactaacgtttaacgtttaacgttacgtaacctaaccgtacgtttaccgttacctttacccgtttacccgttcccgtttaccgtttaccgggtttacgtacccggtacgggtacccctacccgttacgtacgtaacgttaaccgaaacggttacctagggtaccgtacgttacgacctaccgtagtccgttacgttcttacgttacccg

SEQ ID NO: 47857 - DNA, 734 bp, Homo sapiens
  misc_feature: GYAE6OF02HRLYB.25.76.G10.1.454.CMB.1.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
tcagactgtacagtcacgaccggtgctcgatttagtcactcatacagggggcaggagtcagtcccaaccaggacacagcatggacatgagggtccctgctcagctcctgggctcctgctgctctggctctcaggtgccagaggtgacatccacatgacccagtctccatcctccctgtctgcatctgtggganacagagtcaccatcacttgccaggcgactcanaacanctaactaacttttaattaggtatcagacaaaaccgtggatcggacccctaaactcctgactctacctgcactaccagttaggaaacgtacgggtccatcgtaaggttcgaggtaggagtaggatagtagggtatagtttacttttacttaccaactacttaccaggtccaacgtccttacgcgtaacggtacccggtaaagttactttttacggaacctaaattaaacgttttaactttaccttacgggttaaccctaaacttaacccgtttagttttaacccctttaacccgtttccctttaccccgtttccccggttttagggggtttttacccgtaccccgggtaaccgggggtaaacccccttacccgggttaccggttaaccgtaaccgttttaaaccccgaaaacggttaaacccggtttacgggtacggtaaccccgttcggtaccctaccggttaactttcccggttttagtttccccgtttacccttaaccccgg

SEQ ID NO: 47858 - DNA, 795 bp, Homo sapiens
  misc_feature: GYAE6OF02HZ064.25.76.G10.1.454.CMB.1.raw
  modified_base (211)..(211): a, c, t, g, unknown or other
  misc_feature (211)..(211): n is a, c, g, or t
  modified_base (762)..(762): a, c, t, g, unknown or other
  misc_feature (762)..(762): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgaccatccacatcgaccagtcctccatcctcctgtctgacagtcttgagggacatagactcaaccntcgacttcgaccagggctaactcagtaacatctaacaacttttaagtgtatactagactaaaaacctgggatacggaccccttaaactccttaggataccttaacgtcgtacactcctaggtttacgaacgtacggggttcccattactaacgggttacaggtaggtaagttacgggaataaggtagggaaccttagttttaacgtttttaacccgttttaacaaccctaagtttacctaacgggtccaaacggttccccgttaggacccgtacgggtaacccggttaaaaaggttcgtttttaccggaacccttaaataaaacggttttaaacttaacccgggttttacgaaacccgtaaaacttccggtttaaaccgtttccgtttaaccgttaaccctttccccgttttacccggtttacgggttttttaccggggaaccccgtttaaaggggggtaaaccccctacccccgtttaagggtaccgtaaccgttaaccgaaaaaccggttaacccgtggttacccggacttacggtcctaaacccggtnttaccgtttcggttcccgtttacttaaccccgg

SEQ ID NO: 47859 - DNA, 586 bp, Homo sapiens
  misc_feature: GYAE6OF02GGSDS.25.76.G10.1.454.CMB.1.raw
  modified_base (356)..(356): a, c, t, g, unknown or other
  misc_feature (356)..(356): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggagacagagtcaccatcacttgccaggcactcagaacatctataacttttaatgtatcagacaaaaccgtggatacggaccctaaactcctagactctaccgtgctactccagtttacggaaacgtggggtacccagtcgaaggttcaggtaggaagtggatagnggactattatttacttacactatcagcgagcctgcacggtacgaagtctttagactaactattacttactagtactaacgtacttgttaccttacttcccgttcccttccgtttacgggttttccgacccgtacgggtaaccctacccggttacggtactacgttaccgaaaacggtaccgttgggtacgtcgttacgacctacctatcccttcggttaccttcctaccg

SEQ ID NO: 47860 - DNA, 551 bp, Homo sapiens
  misc_feature: GYAE6OF02FJZEA.25.76.G10.1.454.CMB.1.raw
  modified_base (193)..(193): a, c, t, g, unknown or other
  misc_feature (193)..(193): n is a, c, g, or t
tcagactgtacagtcacgaccggtgctcgatttagtcactcatacagggggcaggagtcagtcccaaccaggacacagcatggacatgagggtccctgctcagctcctgggctcctgctgctctggctctcaggtgccagaggtgacatccacatgacccagtctccatcctccctgtctgcatctgtggganacagagtcaccatcacttgccaggcgactcagaacatctactaacttttaatggtatcagacaaaaacctgggactcggacccctaaactcctgactctaccgtgcactccagtttaggaacgtacggggtaccatcaaggttcagtaggagtggatagtagggactattattttacttactacatcagcagcctcgcagccggaagtagtttcgactaactatattactgtacaactacttagtcttactccttcccttcgtttcggtttcggaccctacggggtacccacccgtcgacgacttaccgaaaccgtacgtacgtacggtctacgactaccgtatcctcgttcttctac

SEQ ID NO: 47861 - DNA, 660 bp, Homo sapiens
  misc_feature: GYAE6OF02HEBEU.25.76.G10.1.454.CMB.1.raw
  modified_base (198)..(198): a, c, t, g, unknown or other
  misc_feature (198)..(198): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatcgacccagtcctccatccctcctgtctgcatcgtggtggganacgagagtccaaccatcctacttcgccgagggccactacaagaaccatctaacttaaacctttttaaagttggtatcaagactaaaaaccgtgggactcggacccctaaactcctagactctacgtgctactcgtaggttaggaaacgtacggggtcctaatcgtaaggttacgagtaggaacgtggatagtgggtaactagtttacttttaccttacactatactacgacacgtctcgcgacgtcgtagtagttgtacttttgacttaaacttacgttactacgtaacctaaattaaactaaatttaaagttaaactttcgttaaaccgttaaccctttacgttttaccgggaacgtaaccggggtaaccgtaaggggtaggttaacaacgttaaccggtaaaacgacggttgtaacggttcgtaacggtacccactaccgtcgtttacgtccttaacccg

SEQ ID NO: 47862 - DNA, 704 bp, Homo sapiens
  misc_feature: GYAE6OF02G5CBQ.25.76.G10.1.454.CMB.1.raw
  modified_base (374)..(374): a, c, t, g, unknown or other
  misc_feature (374)..(374): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctatttagaggtgtcctgtgtgaggtgcaacgtggtggagtcgtgggggagccgtggtcaagccgtggggggtccctggacgtactctccgtgtgtacgccgtccggattcacgtccttcagactaaatataggttgtagaacgtcgggtcccgccgagggtcctaccgaagggggtaacggggccgtgggagggtcggggtcgacgtagtttcggngtaggtaggttaaggttaaggttaacttaagtaaaactacgtaacgacgagtagtacgaggtcgggacgggacctagtttcaacgttactcctaccgagtaacgaactaaaccgaaccgaaagtacgcttagtttttacgtcttcggaactaaaacgttcggaaactacggtcctaaggacggtaacggcccggtaaggtacgtacgtccttacgtagtttaattagttggtcgaacgtagaataacggtaaaggaaacgtacgtaagggttcggtacgtacggggttctaacggtaccggtacgggtcgggggacccgtaaacccgggg

SEQ ID NO: 47863 - DNA, 857 bp, Homo sapiens
  misc_feature: GYAE6OF02HKKYW.25.76.G10.1.454.CMB.1.raw
  modified_base (200)..(200): a, c, t, g, unknown or other
  misc_feature (200)..(200): n is a, c, g, or t
tcagactgtacagtcacgaccggtgctcgatttagtcactcatacagggggtaggagtcagtcccaaccaggacacagcatggacatgagggtccctgctcagctcctggggctcctgctgctctggctctcaggtgccagaggtgacatccacatcgacccagtcctccatccctccctgtctgctatcgtggtggganacgagtacgtaccacctatctacgttcgaccgagggccgtaccgtacaacgaacctacttaccttaaaccttaaaacgttttttaaagttacgggttaactaccgtaacgaaacccgtaaaaaccggttggggtaaccgttaccggtaacccccttaaaaccgttccgttacggtaaccttacccgttaacccggtcgtaccgtacgttaccggttaaggttttaaccggggaaaaccggtccgggggttaacccctaacgtaccggttaaacgggttaccgtaagggtaacggggtaaacgggtagggtaaactttagggtaacgggtaacctttaaacgtttttaaccgtttttaacccttacccgtaaccttaacgtaccgtaacgtaccgtaacggtcccgtaacggtaccgggtaaccgggtaaaccggttaagtttacgtttaacggaacctaacgttacgtttaacttacgtacgttaacaaccgttacgtttaccttacttaccttacccgttccgtttacggttacgggtttcccgaccggtaccgggtaccctaccgtacgtaacgtacgtaaccgtaacggtcgttacggtcggtaacgtccgaccttacgtacttccggttacttcccgttcgtaccgttccccg

SEQ ID NO: 47864 - DNA, 738 bp, Homo sapiens
  misc_feature: GYAE6OF02FXHTN.25.76.G10.1.454.CMB.1.raw
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgaccagtctccactcctccctcgtctgcatctgtgggagacagagtcaccactcacttcgccacggcgactcagaaccaatactaactaactttttaaacgttaggttatcagactaaaaacctagggtagtacggtaccccgtaaacctaccgtgatccgtaccgtacgcactactacggtttaggaaacgacggggtacccatacgtaacggttacgagtacgggtaggtaggatagtagggtactaattattttactttaccacctatcagacacgtcctgtacgacgtaccggggaattacgttttcgaccaaaagttaactttaatttaccgtaacgttacgtaaaccctacggtttacgttacccttttaaccctaccctttccccccgttttcgggttttaccggggttttttaccggggaaccccgggtaaacccggggggtaaccccttaacccccgttccgggaaacgtaaaccgtttaccccgaaaaacgggtaacccggttttgggacccgggttaccgttaccgccgttaaacccttaacgttcggttcgtttacccttactaaccccg

SEQ ID NO: 47865 - DNA, 734 bp, Homo sapiens
  misc_feature: GYAE6OF02FKP6N.25.76.G10.1.454.CMB.1.raw
  modified_base (197)..(197): a, c, t, g, unknown or other
  misc_feature (197)..(197): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatcccacatgacccagtctccatccctccctgtctgctatctgtggganacagagtcaccatccacttcggcccgggcgacctcaagaactataccttaacttaaactttttaattaggtactacaagaccaaaaaccgttggggactccggtaccccttaaacgtccgtagtactaccgtaccgtcgacctacttccgtaggtttacgggaaaccgtacggggtaccctaagtacggttaacggttacgtaacgggttaggaacgggttaggtaacgttaagtacggggtaacttaagttttaaccgttttttaccgttacctaaccctaagtttacccaacggtcctaaaccggtcccttagaccggtaaccgggaccggtaaagtttacgtttacgaactaacgtatttacgtacctgtacctaactccttacgttacctttactaccttcccgttcgtttcgggtttccgaccgtaccgggtacccctaaccgtcgtaagtactaaccggtaaacgtcggtcggtaccgtcgttaccgacctaccgtacgttaccgttcgtttaccttcgtaccgttccccg

SEQ ID NO: 47866 - DNA, 762 bp, Homo sapiens
  misc_feature: GYAE6OF02IZMAS.25.76.G10.1.454.CMB.1.raw
  modified_base (161)..(161): a, c, t, g, unknown or other
  misc_feature (161)..(161): n is a, c, g, or t
  modified_base (234)..(234): a, c, t, g, unknown or other
  misc_feature (234)..(234): n is a, c, g, or t
  modified_base (335)..(335): a, c, t, g, unknown or other
  misc_feature (335)..(335): n is a, c, g, or t
tcagactgtacagtcacgaccggtgctcgatttagtcactcatacagggggcaggagtcagtcccaaccaggacacagcatggacatgagggtccctgctcagctccgtggggctcctgctgctctggctctcgaggtcgaccaggacggtgaccatccanatcgacccagtcctccactccctcctgtctgactatcgtggtgggacacagagtccacatctacgtcgaccgnggtacactcaacgaactactactaacttaacttttaagttcggtatacaacgtaactaaaacggtggaacgtaccgtaccctaactctagtactcgtacgnccatacgtaggttacgaacgtacggtacctagtacgtaaggtcgaggtaggtagtaggtataggtacgtacttaattttaacttttacgttactaactacgactaccgtacgtacggccttacggtaccgtacgggtaccggtaaaggttacgtttaaccggaacgttaacggttacgttttacctacggttaacccgtaaactttccgttacggtttaacctttcccctacccgttttacccgtttacgggtttccggggttttaaccggaccccgggttaacggggtaaccccctaccgggtttacgaaccgtaccgttaaaccggtaaacccggttaacggttccgggacccggttaccgtacccgttacggacctttacccgttacgtttacccgtttcgtttacctcccggtttaacccccg

SEQ ID NO: 47867 - DNA, 721 bp, Homo sapiens
  misc_feature: GYAE6OF02H2CN5.25.76.G10.1.454.CMB.1.raw
  modified_base (196)..(196): a, c, t, g, unknown or other
  misc_feature (196)..(196): n is a, c, g, or t
tcagactgtacagtcacgaccggtgctcgatttagtcactcatacagggggagagaggagccttagccctggattccaaggcctatccacttggtgatcagcactgagcaccgaggattcaccatggaacgtgggctccgctgggttttcctgttgctattttagaggtgtcctgtgtgaggtgcaacgtggtggngtcgtggggaggccgtggtcaagccgtgggggtcctggagactctccgtgtgtacgtccgtcggacttcgagtcttccgagactaaagtataggtgtagtaacgtcgggtccgaccgaggtccgtaccggaaggggaacgggcgtaggacggttgggtaccgcgtagtttcgagtagtaaggtagtagtaacttaagtaaactacgtacgacgagacgtacgaaggtgggacggccgtattaccacgtacgtccgtacgaagaaccgaaccaaacgaacccgaaaggacgtaacttagtttttccgttagtacgtaaacctaaaagttcccgtaaacgtaacgccgttagggaaaccgtggaaccggaaggtaccgtaacggggcctttaacgttagtttaacgtttaagttcgggtataccgggtaaataccgtaaagtaaacggaacgtaggtaacgggttaccggcgttacgggtacttaccggtaacgttacccgggtacgggtaacccgtaacccggggg

SEQ ID NO: 47868 - DNA, 923 bp, Homo sapiens
  misc_feature: GYAE6OF02JP6IZ.25.76.G10.1.454.CMB.1.raw
tcagactgtacagtcacgaccggtgctcgatttagtcactcatacaggggagagaggagccttagccctggattccaaggcctatccacttggtgatcagcactgagcaccgaggattcaccatggaactggggctccgctgggttttccttgttgctatttagaggtgtcctgtgtgaggtgcaacgtggtggagtcgtgggggagccgtggtcaaggtccgtggggggtccctggagacctcgtccgtgtcgtagcccgtccggattccgagtccttcgagtacgaaaacgtattacgtggtagtaaaccgttcggggtccccgaccgtaacgggtccttacccggaagggggtaaaccggggtcgttacgggtaagggttcggggtccggaccgtaaggttttccgggtaggtaaggttaacggttaacggttaaggttaacctttaaagttaaaaacgttaccgttaacgaccgtaaggtaacggttacgtaaacgggttgggaaacggggcccgttaacgttaccgtaaaccgttagttacccgtaccgtaacggaacgtaaacccgaaaacccctaaccgaaaacggtaaccgtacgtttaaacgtttttcggtttacccgtaaacggtaaccttaaaaggttacccggtaaaaaccgttaccggtacccgttaaggtaacgggaaacccggttccgggaaacgggttaacgtttaaccccgggggcttttaaaccgggttacgttttaaacggttttaggtttaccggacgggtaacccgtaaggtaaaccgttaacggtaaaacgggtaaaacttacccggggtaagggtttaccgggaaccggttcggggtttactttaacccgggggtaaacctttaccggggtaccggggtaacccccggttaaaccggggg

SEQ ID NO: 47869 - DNA, 666 bp, Homo sapiens
  misc_feature: GYAE6OF02HZAR7.25.76.G10.1.454.CMB.1.raw
tcagactgtacagtcacgaccggtgctcgatttagtcactcatacagggggagagaggagccttagccctggattccaaggcctatccacttggtgatcagcactgagcaccgaggattcaccatggaactgggctccgctgggttttcctgtgctattttagaggtgtcctgtgtgaggtgcaactggtggagtctgggggagcttggacagccaggccggtccctgacactctcctgcacagccttccggactcacctttggtgagcatgctatcgaccgtggtccgccaggctccgaggggtaaggtcgtggagtggcgtttgggttcagttaggaagcgaacgtcctagtgggtcggggacaacgacaaagtaccgccgtacgtacgtagtaaaacggccgtaagtacgtttccgagtcccttacgtacgaaaggagtatcgtaacttaaccaaaacgtctaagttccggaccttagttacctacgtaccaacgtagttcggaacgtacctaacggtcccgtaggaacgaaccggtacggaacgggtacctaccgtacggttcccgtaggtttaaccgtttacgtttacggtttacctttaacgttacccgttacgttacggtaaggttaacggtttacggtttaggtttaacgtttaaccg

SEQ ID NO: 47870 - DNA, 549 bp, Homo sapiens
  misc_feature: GYAE6OF02GWRUY.25.76.G10.1.454.CMB.1.raw
  modified_base (195)..(195): a, c, t, g, unknown or other
  misc_feature (195)..(195): n is a, c, g, or t
  modified_base (375)..(375): a, c, t, g, unknown or other
  misc_feature (375)..(375): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccaggaggtgacatccacatgacccagtctccatcctcctgtctgcatctggtggganacagagtcaccatcacttgccaggcgactcagaacatactactaacttttaatgatcagacaaaacgtggatcgaccctaactcctagactctacgtgctactccgtaggttacgaacgtacgggtccagtcgaagttcagtggagtgatagtggatatttacttttactcactatcgancagtcctagcgagtccgtaagttctttacgactaacgtattactacgtacactactctacgttccttactccgttcccttcggttaggtttccgaccggtacgggccctaccgtgacgactaccgtaaacgacgttggctaccgagtacccacttgtcctcgttactccgtacc

SEQ ID NO: 47871 - DNA, 736 bp, Homo sapiens
  misc_feature: GYAE6OF02IBNN9.25.76.G10.1.454.CMB.1.raw
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (636)..(636): a, c, t, g, unknown or other
  misc_feature (636)..(636): n is a, c, g, or t
tcagactgtacagtcacgaccggtgctcgatttagtcactcatacaggggagagaggagccttagccctggattccaaggcctagtccacttggtgatcagcactgagcaccgaggattcaccatggaactgggctccgctggttttcctgttgctatttagagtgtctgtgtgagtgcacgtggtggagtcgtggggaggccgtggtcagccgtgggggtaccctggagcgtctccgtgtgtacgccgtacggnttccgagtccttcgngtaccaaattntacgtgtagaacgtgggtcccncgtagcctccgaggggaaggcgtaggagtcggcgntacgtttcggagacggttaggtagtacggttacttaagtaaacgtacgttaccgactaagtagtacgaaggtgggacggaccgttagtttccaacgtttaacgtccgtacccgaaaggacgtaaaccgtaaaccgaaaccccgtaaaggaccgtttaacgttaactttttttccgggtacttacggtaaaacccttaaaggtttacgaaacgttaaccgtcccgttaaggaacggttacggaccccgggtaaagaccgttacccggggtaccttgtttaacgttaagtttttaaccgngggttacgacggttaacgaacgtttaggaaaaccgtaggtccaagggttacgcgtttcgggacttacgtaccgttacggcgggggtaccctaaccggggg

SEQ ID NO: 47872 - DNA, 621 bp, Homo sapiens
  misc_feature: GYAE6OF02G73EG.25.76.G10.1.454.CMB.1.raw
  modified_base (342)..(342): a, c, t, g, unknown or other
  misc_feature (342)..(342): n is a, c, g, or t
  modified_base (455)..(455): a, c, t, g, unknown or other
  misc_feature (455)..(455): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtggggggtccctgagactctcctgtgtagcctccggattcagcttcagcaaattatagtgtgaacgtgggtccgccaggcctccgaggggaaggggctgggaggtgggtcgcagttcgngagtagtagtagtacttataaatactacgcagagtcaggtggagggcgtattcactatctccgaagacgaacaaacaccgaagacgcttattttgttcagactaaatgaaacngcctagagacgccggaaggacgtaccggcttcgtagttaatttagttggacggacgtaagaacctaaagtaaacgggaaacgtaaccgtaagggttcgggacccgttagggggtcctttagggaacccgttttaaccgggtacggggggacccctaaaccgggggg

SEQ ID NO: 47873 - DNA, 584 bp, Homo sapiens
  misc_feature: GYAE6OF02G0WG3.25.76.G10.1.454.CMB.1.raw
  modified_base (193)..(193): a, c, t, g, unknown or other
  misc_feature (193)..(193): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctcctgtctgcatctgtggganacagagtcaccatccacttgccaggcactcagacatctaactaacttttaatgtatcagacaaaactggactcggacccctaactcctagactctaccgtgactatcctagtttacgaaacgcggggtaccatcgaaggttcaggtggtagtggatagtggactattatttactcacctatcacgacacgtcctgacacggaccggtaatacgtttacgactaactattacttactacgtactaactacttacgttacttacctccttcccgttcgtttcgggtttccgaccgtacgggtacccctaccgtcggtacgtactaaccggtaaacgtacgttacggtcggtacctacgacctaccgtacttccgtacgttcccttactacccg

SEQ ID NO: 47874 - DNA, 706 bp, Homo sapiens
  misc_feature: GYAE6OF02JCTBR.25.76.G10.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatccctccctgtctgcatctggtggganacagngtcaccanctacttgccaggcactcagaacatctactaacttttaatggtatcagtacaaaaccgtggatcggacccctaaactcctgtataccgtacgtgactactccgtaggtttacggaaaccgtacgggggtacccaagttaccggtaaggttaccgagggttacggaaggttaggtaattaggtaggggtaactaagttttacgtttttaaccttacgtaacctagttacgaagtaccgtaacggttccccgtaggaccacgggtaaccgggtaaagttacgttttacgaaccttaaacgttaactttaatttaccgtagtaacctaaacctcgtttacgtaccctttaaccgttacccttcccgttacccggttttagggttttacccgggtaccggtaccggggtacccctaaccgttccggaacgtacctaaccgaaaccgttacgttggttacggacctacggacctaccgatttcgtcgttaccttccttacccg

SEQ ID NO: 47875 - DNA, 617 bp, Homo sapiens
  misc_feature: GYAE6OF02JI21W.25.76.G10.1.454.CMB.1.raw
  modified_base (195)..(195): a, c, t, g, unknown or other
  misc_feature (195)..(195): n is a, c, g, or t
  modified_base (495)..(495): a, c, t, g, unknown or other
  misc_feature (495)..(495): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatcgaccagtctccatcctccctgtctgcatctggtggganacagagtcaaccatcctacttcgcctaggcgactcaagaacatctaactaactttttaaatgtatcacgactaaaacgtggactacgacccctaaactccgtagtactcctacgtcgactacttctaaggttacggaaacgccggggtccagttacaaggttcaggtacggagtaggtagtagtacggtactaattttactttttaacctacgtacacgttacagtacctacgtccgtacgacgtacggaccggtaaagttatttcgaacctattaagtttattacgtactataaccgtntcgttcttccttactcccgttagtttggttcccgacggacgtacccgtaccgtcgagtactaacgtaaccgttaatcgtagtccgtacgacctcggtaccctttgtaccgttcttacctccg

SEQ ID NO: 47876 - DNA, 819 bp, Homo sapiens
  misc_feature: GYAE6OF02IVXL9.25.76.G10.1.454.CMB.1.raw
  modified_base (138)..(138): a, c, t, g, unknown or other
  misc_feature (138)..(138): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtcnccagaggtgacatccatatgacccagtcctcactcctcctgtctgctatctaggtgggacacagacgtccacatccgacttcgaccgaggcctactacaagtaacatacctaacgttaactttttaaagtggtaactcgaataacctaaaaaaccgttgggtaactaccggtaccccttaaaacgttccgtacgtaaacttccgtaaccgtgactaacgtcttaaggttacggaaacgtacggggtaccctagttaccgaaacggttcaagggttaggaacggttaggtaacttaaggtagggtaaccttagtttaacgtttttaccgtactaaccgtacgtacgtaacggtactaacggtacctacgggtaccgaacggtaacccgggtaagtttaccgtttaacggtaaccttaacttaacggtttaacttaaccgttacggtaaacccttaaacgtacccgttttaacggttaacccgttttacccttaacccgtttccccgtttaccgggtttaccgggttttaccggggacccgttaaacgggggtaccccttaacccgggttacgtaacgggtaccttaacccggtaaaaccggttaaccggttcggttacggacccgttaacgacccgttaccgttaaacgttccggtaccgttttacttcccggtttaacccg

SEQ ID NO: 47877 - DNA, 706 bp, Homo sapiens
  misc_feature: GYAE6OF02G82UY.25.76.G10.1.454.CMB.1.raw
  modified_base (675)..(675): a, c, t, g, unknown or other
  misc_feature (675)..(675): n is a, c, g, or t
  modified_base (683)..(683): a, c, t, g, unknown or other
  misc_feature (683)..(683): n is a, c, g, or t
  modified_base (693)..(693): a, c, t, g, unknown or other
  misc_feature (693)..(693): n is a, c, g, or t
tcagactgtacagtcacgaccggtgctcgatttagtcactcatacagggtcctgggcccagtctgtactgacgcggccgccctcagtgtctggggccccaggcgagagggtcaccatctcctgcactggggacagttccaatatcggggcaccttataatgttcactggtatcaaccaacttccagggtacacgacccccaaactcgtcattcatcgctgaataacaactccggtaccctcaggtcgtcccctgtacctattccgtaccggtctaccaacgtctggccacctcagccctccgtggtcatcacgtggctcagactgagtataggaggtgactttacgacgtcgacctaggtacctagtacgaacctaacgacggccttcgtacgggtttcggtttcgggtaccgtttccggggaccgggtacccggggtaacccgtaaacggggtcgttacccgttcggttaacccgttaacggtacccgaacgtaccccggtaaacgggtcccgttacccgggtcccccgttaccggtcccttaaccgtcccgtttacccgttacccccgtaaccctttccccgtactaccgttacgttaacccgtagttacccgtagggtacgtccgggtcgtacgggaaccgtacgggaccgtacgtagtacgctacgcgtangtctacgntactccggtntacgctatcgtcg

SEQ ID NO: 47878 - DNA, 726 bp, Homo sapiens
  misc_feature: GYAE6OF02HQ2FC.25.76.G10.1.454.CMB.1.raw
  modified_base (194)..(194): a, c, t, g, unknown or other
  misc_feature (194)..(194): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatcgacccagtctccatccctcctgtctgcatctgtgganacagacgtccacatccacttcgccgaggcactcaagaacatcctaacttaacttttaagtgtatacacgaactaaaacgtggaactaccggaccccttaaactcctagtactacgtaccgtgacctacttccgtaaggtttacggaaacgtccggggtaacctagtacgtaacggttcgaaggttacggtaaggtaggtaactacggtagggaacttaagttttaactttttaccttaccaacctaacttacgacgtaccgtacggtaccttaggaccgtacggtaacgggtaaacgtttcttttaacggaaccttaaacttaacgtttaacttaccgttacgtaacctaaaccgtttaccgttcgtttaaccgtttaccttcccgtacccctttcggtttacggtttccggacccggtaacggtacccctaccgttacgacgttaaccgtaaccgaaaccggttacgttacggaccgttacgtaccgtacccttaacggtcctttacgtccgtttaccgttaccgttaccc

SEQ ID NO: 47879 - DNA, 682 bp, Homo sapiens
  misc_feature: GYAE6OF02G8C01.25.76.G10.1.454.CMB.1.raw
tcagactgtacagtcacgaccggtgctcgatttagtcactcatacagggggagagaggagccttagccctggattccaaggcctatccacttggtgatcagcactgagcacccgaggattcaccatggaactggggctccgctgggttttccttgttgctattttagaggtgtcctgtgtgaggtgcaactggtggagtcgtggggggaggcctggtcaaggccgtgggggggtccctggagactctcctgtgtagcctccggattcagcttcagcaaatatagtgtgaactgggtccgccagggtcctccgaggggaaggggctggaggtgggtcgcagttcgtgagtagtagtagtacttataaatactacgctaagagtcaggtggaggggtcccgattccaactatctccagtacgaaccaaccaacccgaaagacgtactaatttttgtttcctacggtactaaaacgtaggtaaaccctggcccgttaggacgacgggaccggaaggggtacttaccggggccttacgttacgtttaactttaagttgggttacgaccgggtaagtaccgtaaagttaaagggaacgaaccggtaagggtcggtaccggtaggggggtttacccttggggtaaaccgtttcggggttaccggggggtacccccgtaaccggggggg

SEQ ID NO: 47880 - DNA, 723 bp, Homo sapiens
  misc_feature: GYAE6OF02FJKLA.25.76.G10.1.454.CMB.1.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatcgacccagtctccatcctcctgtctcgcatcgtgtaggganacagagtacaccatcacttgccaggccactnagaacatactactaaacgtttttaaattggttaatacagtaactaaaaaccgtcggggttacggaccccttaaactccctagtactacctacgtacgcatcctagtttagaaccgtagggtacccatactaaggtactagtaggaagtggtaatagtacgggtaactaagtttaactttttaacgtttacctaaccctaatttacccgaataccgtaactacccgttagaaccgtaacgggtacccggtaaaggttaacgtttacggtaacaaacttaacgttaatttaacccgttagtaacctaaactaacgtttacgtacctttaacttccgttcccgtttacgtttacgggttttacggacccgtaaccgggacccttacccgttacgaacgttacgtaaccgtaaaaccggtaacgttaacggttacggttccgtaccggtaacccaacttcggttaaccgttccgtttaaccttcctacgtttaccccgg

SEQ ID NO: 47881 - DNA, 691 bp, Homo sapiens
  misc_feature: GYAE6OF02JAPY0.25.76.G10.1.454.CMB.1.raw
  modified_base (198)..(198): a, c, t, g, unknown or other
  misc_feature (198)..(198): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatcgaccccagtcctccatccctcctgtctgcatctggtggganacagacgtcacctatccacttcgccgaggccgacctcaagaactacttacttaactaacttttttaaatggttaatacgaagaactaaaaaccggtgggaactcggaaccccttaaacgtcccagtacctacgtaacccggtgacctacgtacctaacggtttacggaaaccgtaccggggtaccctaagtaccggaacggtttacagggtaggtaagtacggtataggtggtaactattttaacgttttactaccgaacttacgtacacggtactacgctagacctacggaccggtaatacgtttcgaactagttataacgttactagtaccacttacgtacgttccttacccgttccttaccgtcgttcgggtttccgaccggtaccgggtacctacccgtagtaccgaattaacccggaacgttaaccggcggttaccgtacgtccgttaacctacccgtacgttacgtttccgttacttaccttacccg

SEQ ID NO: 47882 - DNA, 894 bp, Homo sapiens
  misc_feature: GYAE6OF02INCQB.25.76.G10.1.454.CMB.1.raw
  modified_base (195)..(195): a, c, t, g, unknown or other
  misc_feature (195)..(195): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatcgacccagtctccatccctcctgtctgcatctgtggganacagagtcaccatcacttgaccaggcgtactacaagaacatacttaacttaaactttttaaattggtaactacgaacgtaacctaaaaaccgtgggaactccggtaaccccttaaacctccgtaggtactaccgttaccgtgtacctacttccgtaaggtttaacgggaaaaccgtaccgggggtaccctaacgtacgtaacggttacgaacggttagggtaacggtagggtaacgttaggtacgggtaacttaacgttttaactttttaaccgtttacccgaaccttaacgttaccgtaacggtacccgtaacggtcccgttacggaacccggtaacggtaacccgggttaaaacgtttacgtttttaaccgggaaaccttaaaccgttaacgttttaaaccgttttaacccgttaacggttaaccctaaaacccggttacgttttaccggtttaaccccttttaccgttacccccgtttacccccggtttacccggtttttaccgggggttttacccgggtaaccccggggttaaaccggggttaaccccccgttaacccgggttaacccgtaacgggttaaccttaaccccggtaaaaaccggttaccgtttacggggtaccgttaccggttacccgtacccgtaaccgttaccgtttaccggtttaccgttacccgtttacccgtttaaccccgg

SEQ ID NO: 47883 - DNA, 701 bp, Homo sapiens
  misc_feature: GYAE6OF02FV668.25.76.G10.1.454.CMB.1.raw
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtctgggggaggcctggtcaagccgtggggggtccctgagactctcctgtgtagcctccggattcagcttcagcaaatatagtgtagaacgtgggtccgccgaggtcctacccgaggggaaggggctgggagtggggtcgctagttcgtgagtagtagtagttacttaataaatactacgcagagtcaggtgggagggcccgattcacgttactcgtaccaagacgaacctaaaccaacccgaaaggacgtacttaagttttttcggttcctaggtaacttaaaacgtcgaaaccgacggccgttaagacggacgacccgggaaggtacgttaaccgggccttacgttagggttaaacttttagttcggttacggacgtaagtacctaaaggttaaaacggaaacggtaacgtaagggttccggggaccggttttaacgggggtccttttaacgggaaccgtttacccggggttacgggggggacccccttaaacccggggggg

SEQ ID NO: 47884 - DNA, 794 bp, Homo sapiens
  misc_feature: GYAE6OF02I20FE.25.76.G10.1.454.CMB.1.raw
  modified_base (193)..(193): a, c, t, g, unknown or other
  misc_feature (193)..(193): n is a, c, g, or t
tcagactgtacagtcacgaccggtgctcgatttagtcactcatacagggggcaggagtcagtcccaaccaggacacagcatggacatgagggtccctgctcagctcctgggctcctgctgctctggctctcaggtgccagaggtgacatccacatgacccagtctccatcctcctgtctgcatctggtggganacgagacgtccacatctacttgccaggcactcagaactatctaacttaactttttaatgtatcaacgactaaaacgtggactacgtacccctaactccgtagactccgtacgtcgactactccgtaaggtttacggaacgtacggggtacctaagtaccgtaacggttcgaacgggtaggaacgttagggtaagttacggtacgggtaaacttagttttaacgttttttacctttacaccgttactaccgtacggtccgtaaccggtccttacggaccgtacgggtaaccggtaaacgtttacttttaccggaaccttaaacgttaactttaacgtttaaccggttacttaaacccgtaaaccttaccgtttaccgtttaccctttaacccggtttcccctttacccgggttttacccgtttttacggggttttcccggttaacccggggtaacccgggttaaccccttaccccggttaacgggttaacccgtaacggttaaacccggtaaaccggttaaccggttcgggtaaccgggtaccttaccggtacctaaccggttacctttaccggtaccgttttaccgttaccgttaaccccg

SEQ ID NO: 47885 - DNA, 698 bp, Homo sapiens
  misc_feature: GYAE6OF02IX3WH.25.76.G10.1.454.CMB.1.raw
  modified_base (197)..(197): a, c, t, g, unknown or other
  misc_feature (197)..(197): n is a, c, g, or t
tcagactgtacagtcacgaccggtgctcgatttagtcactcatacagggggtaggagtcagtcccaaccaggacacagcatggacatgagggtccctgctcagctcctggggctcctgctgctctggctctcaggtgccagaggtgacatccacatgacccagtcctccactccctccctgtctgcatctggtgganacagacgtcaccatcacttcgccaggcactcaagaacatcctaacttaacttttaattggtatacgagaaccaaaaccgtggatccggaccctaactcctagactcgtaccgtgactactccgtaggttacggaacggtacgggtccctagtacgtaaggttctagggaggtaaggtggataggtcggtaatatttacgttttacttactaactactcgtacgacgtacgtacctcgacgaggtaacccgggtaaattaggtttaccggaactaaacttacgtttaactttaccgtacgttaacctaaactacgtttacgttccctttacccttcccgtttaccccgtttcgttttacggggttttccgggacccgttaaccggggaccccttaacccggtacgtaccgtaactaacccgtaaacggtaccggttcggtacggtcgtccggaaccttaccctacgtttccgttaccggtttccttaccgtcccttaccccg

SEQ ID NO: 47886 - DNA, 663 bp, Homo sapiens
  misc_feature: GYAE6OF02F8JEE.25.76.G10.1.454.CMB.1.raw
  modified_base (480)..(480): a, c, t, g, unknown or other
  misc_feature (480)..(480): n is a, c, g, or t
tcagactgtacagtcacgaccggtgctcgatttagtcactcatacagggggagagaggagccttagccctggattccaaggcctatccacttggtgatcaacactgagcaccgaggattcaccatggaactggggctccgctgggttttcctgttgcttattttagaaggtgtcctgtgtgaggtgcaacgtggtggagtcgtgggggagcctggtcaagccgtgggggtccctggagactctcctgtgtacgccctccggtattcgagtcttcagacaaatattagtgtagtaaccgtgggtccaccgacggtcctacccggaaggggggtaacgggggccgtagggacgggtggggtccgtctagtttcggtgaaggttaggttacggttaagttaaactttaataaaagttaacctagcaaggtagtaccgaaggtcggggacgggtaccgagtttacaacgttattcccacaaggnaacccaacaaccgaagatcttaattttgttacagactaaatcgaactacgtcctaagagcgggaccgtagggtactcggtatccgttaattagtttattggagaccgtagactaaggtaaacgagtaactggtagtccggtaggtcttagaccgttacggcgggtaccggaacggtaacccgg

SEQ ID NO: 47887 - DNA, 729 bp, Homo sapiens
  misc_feature: GYAE6OF02HNVN5.25.76.G10.1.454.CMB.1.raw
  modified_base (104)..(104): a, c, t, g, unknown or other
  misc_feature (104)..(104): n is a, c, g, or t
  modified_base (195)..(195): a, c, t, g, unknown or other
  misc_feature (195)..(195): n is a, c, g, or t
tcagactgtacagtcacgaccggtgctcgatttagtcactcatacaggggcaggagtcagtcccaaccaggacacagcagtggacatgagggtccctgctcagntcctgggctcctgctgctctggctctcaggtgccagaggtgacatccacatgacccagtctccatcctcctgtctgctatctgtggagacngagtcaccattccacgttggcccgggtcactcgagactatactaactaactttttaatggtaactctagaactaaaacgtggtactcggacccttaaactcgtgtaactctaaccgtcgactagttacctaggtttacggaaacgtaccggggttacccaagttaccgtaacggtttaccgaaggttacgggaaagttacggtaagttaagggtacgggtaacttacgtttttaaacgttttttaaccgttaccctaaccgtaactttaccgtaacggtacctaacggtccctagtaccgtaacggtaccggtaagtttaacgtttcgaactaacgtagttaacgtttaccgtacgtaacctactaacgttgttaccttaccggtccttacccgttcgtttaaccgggttcgttacggaacccgggttaccctaacccggttagcgtaacccgttacgtaaaccgtaaccggttcgtacggtaaccttccgaccgttactaccgttccgtacgttttacctccgtaacctcccg

SEQ ID NO: 47888 - DNA, 628 bp, Homo sapiens
  misc_feature: GYAE6OF02ILE6Q.25.76.G10.1.454.CMB.1.raw
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtgggggtcctgagactctcctgtgtacgcctcggattcagcttcagacaaatagtagtgtgtaacgtcgggtccgccaggcctccggaaggggaaggggcgtgggaggtgggtcgcgtattcgtggagttagtagttagtacttaataaatactacgacagagtcaggtggacgggccgtattcactactctaccagacgaacaacgaaccagatacttagttttcgttacagtactaaagttcgaaactacggcctaaggaacgacggaccggaaggtagtaccgggcttagtagtttaatttgtcgttagacgttagaacgtagtaaaacggagttacggaggttcggaccttagggggtacctttacggaaccgtacgggttcggggaaccctaaccggggg

SEQ ID NO: 47889 - DNA, 646 bp, Homo sapiens
  misc_feature: GYAE6OF02FPD1Q.25.76.G10.1.454.CMB.1.raw
  modified_base (630)..(630): a, c, t, g, unknown or other
  misc_feature (630)..(630): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
  modified_base (644)..(645): a, c, t, g, unknown or other
  misc_feature (644)..(645): n is a, c, g, or t
tcagactgtacagtcacgaccggtgctcgatttagtcactcatacagggtcctgggcccagtctgtactgacgcagccgccctcagtgtctggggccccaggcgagagggtcaccatctcctgcactggggacagttccaatatcgggcaccttataagtgttcactggtatcaacaacttccagggacagcccccaaatcgtcattcatgctagataacaatccgtccctgaggtcgtccctagaccgtattccgtccggacctccgaagttccgtcggcctaccttcaccgtccttcccctggtcaactccacgtgggccttaccgagtctggagtactggaaggtcgtaacttacgtacgtcgccgtagttaccctagtaacaactgaccttggacggttttaggtttcggtacgttccggggcgggacgggtaaccgtaggtccgcgttaccgttccgtaagtccgtacgaccccgtaggtccgtaccgtccccgtcggtccacgttccgttaccgtcccctaaccctccgttccgtacttccgtaacgtcgtaccgtcggaccgggtaccggcgttaccgggaaccgaacggtccgacgtaacgtgacgtctcgatcggctaagnacncgngcncgtcnng

SEQ ID NO: 47890 - DNA, 581 bp, Homo sapiens
  misc_feature: GYAE6OF02FNBDG.25.76.G10.1.454.CMB.1.raw
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccatcctccctgtctgcatctgtgggatacagagtcaccatcacttgccaggcgactcagaacatctactaacttttaatgtatcagacaaaacgtggtatcggacccctaactcctgactctaccgtcgactactacctagtttacggaacgtacggggtacccatacgtaacggttcgaggtaggaagtgatagtggactattattttacttcaacctatcagcagcctgcagaccggtaagtatttcgactaactatattacgtctacaactcttgttccttacttcctcccttccgttggtttccggaccgtaccgggaccctacccgtacgtacgtaaccgtaccgtaaacgtacgttacggtccggtactacggacctaccgtacttaccgtcgttcttaccttacccg

SEQ ID NO: 47891 - DNA, 621 bp, Homo sapiens
  misc_feature: GYAE6OF02HOGO1.25.76.G10.1.454.CMB.1.raw
  modified_base (145)..(145): a, c, t, g, unknown or other
  misc_feature (145)..(145): n is a, c, g, or t
  modified_base (153)..(153): a, c, t, g, unknown or other
  misc_feature (153)..(153): n is a, c, g, or t
  modified_base (191)..(191): a, c, t, g, unknown or other
  misc_feature (191)..(191): n is a, c, g, or t
  modified_base (307)..(307): a, c, t, g, unknown or other
  misc_feature (307)..(307): n is a, c, g, or t
tcagactgtacagtcacgaccggtgctcgatttagtcactcatacagggggcaggagtcagtcccaaccaggacacagcatggacatgaggtccctgctcagctcctggggctcctgctgctctggctctcaggtgccagaggtnacatccanatgacccagtctcatcctcctgtctgcatcgtgtgganacagctccacatcacgttgccgaggcactacacgaactactactaacttaactttttaatggtatcaagacctaaaacgtggactcggtacccctaacgtcctagactctacgtcnctacgtcaggttaggaacgcgggtaccatacgtaggtcgaggtaggaagtgagttacgtcggtactaatttactttacttccaactactacgaacgtccgacgtacttaggaccgtaggtaaccggtaaggtttactttagaccttaaatacttaacgttagtactactaactcttagttaccttaccttcctcccgtttggtttaccggtttccggaccggtacggtaccctaccggtacgactacgtactaaacggcttacggtacgtccgtagaccctacgtacgttcgttaccgttacgttcttaccccg

SEQ ID NO: 47892 - DNA, 854 bp, Homo sapiens
  misc_feature: GYAE6OF02HDKL6.25.76.G10.1.454.CMB.1.raw
  modified_base (143)..(143): a, c, t, g, unknown or other
  misc_feature (143)..(143): n is a, c, g, or t
  modified_base (153)..(153): a, c, t, g, unknown or other
  misc_feature (153)..(153): n is a, c, g, or t
tcagactgtacagtcacgaccggtgctcgatttagtcactcatacagggggcaggagtcagtcccaaccaggacacagcatggacatggagggtccctgctccagctccgtggggcctcctgctgctctggctctcgaggtcnccgagaggtnacatccacatgacccagtcctccactccctcctgtctcgactatctgtagggactaccgagaacggtcccaacctacgttcctaccgttggacccgaacgggtccgtaacctacaacgaaacctaactaccttaaacgttaaaaccttttttaaaacgtaggtaactacctaaggaaaccctaaaaaaccggtcgggtaacttaccggtaaaccccttaaaccgtaccttaggaacttaccgtaccgtacgtctaacgtccgtaaggtttaacggaaacggtaccgggttaacccaattaccgtaaaacggtttcgaaggttagggaagtacggtaattaggtacgggtaaacttacttttaacgtttttaccgttaacctaacccgtaagtttaccgaaggtacccgtacgtacccgttaggacccgtaaacgggaaccgggttaaatttacgttttaaccggacctaaacttactttaaacgtttactacggttaaacctaaccttacgttacgtttacctttaccccttaccgttttccccttacggttttacgggtttacccgggaacggttaaccccgggtaacccttaccccggttacggaagttaccctaacggtaaaacccggttacgttgggaaccggtactaaccgacgttaacctaaccgtttcttaccggtttactaaccccgttcccg

SEQ ID NO: 47893 - DNA, 745 bp, Homo sapiens
  misc_feature: GYAE6OF02GAQ9Q.25.76.G10.1.454.CMB.1.raw
  modified_base (237)..(237): a, c, t, g, unknown or other
  misc_feature (237)..(237): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaggtgtcctgtgtgaggtgcaactggtggagtcgtgggggaggcctggtcaagccgtggggggtccctganactctcctgtgtacgccctccggattccgagtcttcagacaaatatagtgtgaacgtcgggtccgccgaggccgtccggaggggaacggggcgtgggaggtcggggtcgcgtacgttcggtgtagttagtaggtagttacttaataaaatactacgcgagtagtcgaaggtgggacgggccgtagttacactactcttaccgagtaacgaacaaaccaaccgaaagacgtactttatttttacggtttccgttagtaacctaaaagttcggaaaaccgtacggtacccgttaaggaccggaacggtacccggaaggggtaaccgttacggggtaccctttacgttaacgggttttaatttttaaacgtttcgggttacacgggtaacggttaaccgtaaaagttaaaacgggaaacggtaaccggtaaggggttaccggtacgggttacggggttcccgtttaggaacccggtttacccgggtacggggggaccccgtaacccggggg

SEQ ID NO: 47894 - DNA, 782 bp, Homo sapiens
  misc_feature: GYAE6OF02GUH97.25.76.G10.1.454.CMB.1.raw
  modified_base (191)..(191): a, c, t, g, unknown or other
  misc_feature (191)..(191): n is a, c, g, or t
  modified_base (444)..(444): a, c, t, g, unknown or other
  misc_feature (444)..(444): n is a, c, g, or t
tcagactgtacagtcacgaccggtgctcgatttagtcactcatacaggggcaggagtcagtcccaaccaggacacagcatggacatgagggtccctgctcagctcctgggctcctgctgctctggctctcaggtgccagaggtgacatccacatcgacccagtcctccactccctccctgtctgctatcgnggtgggagacgagacgtaccacctatccgtacttcgaccgaggaccgactacgaagaacctattaccttaaaccttaaacgtttttaaagttacggttaactaccgaacgtaaacccaaaaaccggttgggtaaccgtacccggaaccccctttaaaccgtaccgtcgttaactaccgttaccgtacgaccgtacttaccgttaacggttacggaaacggtaccggggtaccctaagtaccgtaacggtttanaggtaacggtagtaggtacgtaggttacggaattaagttttaccttttaacgttaccaaccttgtactacgtacgacgtcgtacgtacgtaccggaccgttaagttacgttttacgacgttaaacttaactttaccttacgtacgtaacgtaacttaccttacgtttacctttaccgttccccgttccgtttacggtttccggtttaccgggtacccggtaacccgggtaaccccttaaccgtcggtaaccgttacgtaaccggtaaacgtaccggtacgtaccggtaccgtacgacccgtacttaccttcgtttaaccgttcccttacgttaccccg

SEQ ID NO: 47895 - DNA, 673 bp, Homo sapiens
  misc_feature: GYAE6OF02GKUM4.25.76.G10.1.454.CMB.1.raw
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtcctccatcctcctgtctgcatcgtgnggganacagagtcacatccacgttcgccgaggccgactacgaagaactatacctaactttaaactttttaaagttaggttaactacaacgtaacctaaaaaccggttgggaacgtccggaaccccttaaacgtccgtagtactcctaccgtgcctatcgtagtttacggaaaccggtacgggtacccaagtacgtaaggttacgaagggtaggtaaggtggtaattaggtacgggtaacttaagtttattttttaaccttcgaaccttatacgtacgacgacgtcctaggaccgacggaccggtaatacgtttagacctaaacgtattacttactagtaacctaacgtaccgtgtttacttacttccgttcccttacggtttcgggtttaccgacgggtaacggaaccgtagggtacgtagtactaaccgaacggtaactggtaccgtgtagacctactacgttcgtacgttcttcgtacccg

SEQ ID NO: 47896 - DNA, 638 bp, Homo sapiens
  misc_feature: GYAE6OF02GGG4U.25.76.G10.1.454.CMB.1.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
  modified_base (612)..(612): a, c, t, g, unknown or other
  misc_feature (612)..(612): n is a, c, g, or t
tcagactgtacagtcacgaccggtgctcgatttagtcactcatacagggggcaggagtcagtcccaaccaggacacagcatggacatgagggtccctgctcagctcctggggctcctgctgctctggctctcaggtgccagaggtgacatccacatgacccagtctccactccctccctgtcctgcatctgtggganacagacgtcaccatcacttgccaggcactcaagacatacctaacttaaactttttaattggtactacacgaacctaaaaccgtgggaactcggacccctaaactcctagactccgtacgtnactactccgtaagtttacggaacgtacgggtacccagtacgtaacgttacgaggtaggtacggtaggtagtagtcgggtaataatttacttttactcacctatacgagtacacgtccgtcgacgtacggacggtaaagttcgtttacgaactaattacttaactttacgtcgtaacctaacctacgtttaccgttacctttacccttccctttcccgtttacgttcgggtttaccggaccgtaccgggtacccctaccgtacgtacgaactaaccgaacgtacgtgtcgactanacctactattcctgttcctcttaccc

SEQ ID NO: 47897 - DNA, 728 bp, Homo sapiens
  misc_feature: GYAE6OF02I6Q85.25.76.G10.1.454.CMB.1.raw
tcagactgtacagtcacgaccggtgctcgatttagtcactcatacagggggagagaggagccttagccctggattccaaggcctatccacttggtgatcagcactgagcaccgaggattcaccatggactgggctcgctggttttctgttgctatttagaaggtgtcctgtgtgaggtgcaacgtggtggagtcgtgggggaggccgtggtcaagccggtgggggtccctgacgactctcctgtgtacgccgtcggattcagtcttacagacaaatatagtgtagaacgtcgggtccgcaggcctaccggaagggggaacgggtcgtggggtaggtgggtccgacgtagtttcggtaggtagttaaggtaagttaagttaacttaaagtaaaactacgtacgacgtagtaagtcgaaggtgggaacgggtccgtaattaccaactacgttcctaccgaagaccgtaaaccaaacaaccgaaaggtacgtactttagtttttcggttacctacggtaaactaaaacgttacggaaaaccttacggacccgtaggtaaacgggaacgaccccgggtaaggtaaccgttaccgggtccttacgtttagttaaactttagtcggtcgtaacgacgtaactaaaggtaaacgtaacggagtaacgggttcggacggttacggtaccgttaacggtaccggtttaaggggccggggtaaccccgtaacccgggg

SEQ ID NO: 47898 - DNA, 796 bp, Homo sapiens
  misc_feature: GYAE6OF02HXIX1.25.76.G10.1.454.CMB.1.raw
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (349)..(349): a, c, t, g, unknown or other
  misc_feature (349)..(349): n is a, c, g, or t
  modified_base (763)..(763): a, c, t, g, unknown or other
  misc_feature (763)..(763): n is a, c, g, or t
tcagactgtacagtcacgaccggtgctcgatttagtcactcatacagggggcaggagtcagtcccaaccaggacacagcatggacatgagggtccctgctcagctccgtggggctcctgctcgctctcggctctcgaggtcgccgaggaggtcgacatccactatcgaccagtcctaccactccctcctgtcctgctatcgtggtacggatacgagtacgtacctacctatcctacttcggaccncgggtacactcgaanaactctacttaaacttaattttaacgtggtatacgaagaaccgtaaacggtggtacctaccggaacccttaacgtctacgactactcgnctacgtacgtaggtaacggacgtaccggtacctagtaccgtaggtactaggtacgggaagttaggtacgtacggtaacggttaacttaacgtttttactttaaacccgttcgaaacctacgttacgaccggtaaccgtacgtttaccggaggtaacccgggaacgttaccgggttaaagttcggttaacctaacctaaagttacctttaacggttacctacggttaaaccttaccctaaggtttccccttaaacccgtttcccgttaaaccccgttttcccggttccgggttttttaccgggttacccgggaacccggtttaacggaaccccttcccgttaggaaccgtttaaacccgttacggtaaacccggtttcggacctccgggtaaaccttccaacccggtttacgttnttaccccggtttattccccgttacttaacccgg

SEQ ID NO: 47899 - DNA, 773 bp, Homo sapiens
  misc_feature: GYAE6OF02GQJOE.25.76.G10.1.454.CMB.1.raw
  modified_base (186)..(186): a, c, t, g, unknown or other
  misc_feature (186)..(186): n is a, c, g, or t
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
  modified_base (644)..(644): a, c, t, g, unknown or other
  misc_feature (644)..(644): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgcttgggttttccttgttgctatttagaaggtgtcctgtgtgaggtncaactggtggagtcgtgggggnggcctggtcagccgtgggggtcccngagactctccgtgtgtacgcctaccggtattcagtcttccagacaaatgtaagttgtagtacgtcggggtcccaccgtaggtcctaccgggaaggggggtaacggggccgtaggggtacgggttcgggggtcctacggttatttcgggtagtaggttaaggtagttaggttaacttaattaaacgtacgtacgacgtacgtaggtacgagggtacggggccgggtacgtaattccgaaactttctaccccgttacgaaacgggtaccgtaaaacccaaaccgaaaccggtaaacgggtacttaccgttttaacgttttttccggttacgttaagtaaccgttaaaagtaccgaaacttaccggtaccgtaaggaacgtacggggaccgtaaaggggacgtttaacccgggnttaaccgtttagtttaacgttttacgtacggtcggacgtaaggtaacctaagggtaacgtaacgtacggtaaggtcgtacggtacgggtctttacggacgggtacgttaccgggggcggtaaccccggg

SEQ ID NO: 47900 - DNA, 649 bp, Homo sapiens
  misc_feature: GYAE6OF02F1AJT.25.76.G10.1.454.CMB.1.raw
  modified_base (153)..(153): a, c, t, g, unknown or other
  misc_feature (153)..(153): n is a, c, g, or t
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
  modified_base (495)..(495): a, c, t, g, unknown or other
  misc_feature (495)..(495): n is a, c, g, or t
tcagactgtacagtcacgaccggtgctcgatttagtcactcatacagggggcaggagtcagtcccaaccaggacacagcatggacatgagggtccctgctcagctcctgggctcctgctgctctggctctcaggtgccagaggtgacatccanatcgacccagtctccatcctccctgtcctgcatctggtgggagacagacgtcacctactcacttcgaccaggtcgacctcgaagaacntacctaacttaacttttaatagtatacagtaacaaaaccgtggtatcggtacccctaactcctagacttacgtacgtnactactctaagttaggaaaccgtacggggtaccctaagtacgtaacgttcgaaggttaggaacggtaggagttaggtagggaacttatttaacgtttttaccttacgaacctactaccgtacgtactacggtctcgacgtaccgacgggtaatactttacgaccgaatatacttanacgttacaacttacttgttactaccttccttcccgttcgtttgggtttaccggccgtaacggtacccgtaccgtacgtacgtagaacctaaacccggagttcggttaggaccttcggacccttacgtaacgttcttacgttcccttactacccg

SEQ ID NO: 47901 - DNA, 152 bp, Homo sapiens
  misc_feature: GYAE6OF02G5CMC.25.76.G10.1.454.CMB.1.raw
  modified_base (115)..(152): a, c, t, g, unknown or other
  misc_feature (115)..(152): n is a, c, g, or t
tcagactgtacagtcacgaccggtgctcgatttagtcactcatacagggggcaggagtcagtcccaaccaggacacagcatggacatgagggtccctgctcagcctccgtcgggnnnnnnnnnnnnnnnnnnnnnnnnnnnnnnnnnnnnnn

SEQ ID NO: 47902 - DNA, 768 bp, Homo sapiens
  misc_feature: GYAE6OF02HF72T.25.76.G10.1.454.CMB.1.raw
  modified_base (229)..(229): a, c, t, g, unknown or other
  misc_feature (229)..(229): n is a, c, g, or t
  modified_base (448)..(448): a, c, t, g, unknown or other
  misc_feature (448)..(448): n is a, c, g, or t
tcagactgtacagtcacgaccggtgctcgatttagtcactcatacgagggggcaggagtcagtcccaaccaggacacagcatggacatgagggtccctgcctcagctccgtggggcctcctgctgctcgtggctcctcgaggtcgaccgaggtaggtacacactcccatagtccgaccctagtcctaccgcctccctccgttgcctacgctactcgtggagggacacgngacgtcctactagtacctacgtcgaccgtaggacctacacgaacgactactacttaacctttaaacgttttagtgtaactagtaaccaaccgtaaacggtggacctaccggtaaccccttaactcccgtagtaccttaccgtaccgtctacctacgtacgttaggttaacgaaccggttcggtacctacgtggtaacgttcgaggtacggagtacggtnaggtacggtattaactttacttttaccgtccagtaccctagtacgtcgaacgtcgtacgacgacgtacggtaacgttagtacgaccgttaattacgttacttagtaccgtactaactcgttaccttcgttaccctttccggttacccgtttggttttaccgggttaccggtaacccgggtacccggtaaccccggttaaccgtcgtaaccggttaccgttaaaccggtaaacccggttaggttaccggtacccgggttcgtaaccccgggtttcaacccggtttcgtttacccgttacggtttaccctacggtttacccc

SEQ ID NO: 47903 - DNA, 887 bp, Homo sapiens
  misc_feature: GYAE6OF02F3TMY.25.76.G10.1.454.CMB.1.raw
  modified_base (149)..(149): a, c, t, g, unknown or other
  misc_feature (149)..(149): n is a, c, g, or t
  modified_base (156)..(156): a, c, t, g, unknown or other
  misc_feature (156)..(156): n is a, c, g, or t
  modified_base (206)..(206): a, c, t, g, unknown or other
  misc_feature (206)..(206): n is a, c, g, or t
tcagactgtacagtcacgaccggtgctcgatttagtcactcatacagggggcaggagtcagtcccaacaggacacagcatggacatgagggtccctgctcagctcctgggctcctgctgctctggctctcgaggtcgccagagtgaacntacccanagtcgaccctagtctccatccctcctgtctagctattcgtggtacggganacgacggtagttccaaccgtaatcctaaccggtttcggacccgggggtctaaccgttacgaacggtaaccctacttaccttaaaccgtttaaaaccgtttttttaaaacggtttcggttaacttacgtaaaccggtaaacctaaaaaccgggttagggtaaccggttacccggaacccccgtttaaaaaccgtcccgtacgttaccgttaccgttaacccggttcggtacctaacgtttacccggtaacggttttaaacggtaaaccggtaaccgggttacctaacgttaaccggttaacggttaccgtaaggtacgggtaaacggttggaaccgtttagggtaacgggtaactttaacgtttaaccgttttttaccgtaaccttaaccgtacttaacgacggtacctaccggtacctacgaccggtacggtaaccggtaaggtttactttaacgtaccctaaacgttacgtttaaacgttaccggttactaaccttaaacgtaccggttactttaacctttaccctaccggttccccgtttttaaccggttcggggttttacccgaaccggggtttacccggtacccgtaccgttaccgtaccgttaccgtaacgtaacgtaacggtcgtacgtacgtaccgacttaccgtcgttacttcggtcttacctgtttaccccg

SEQ ID NO: 47904 - DNA, 247 bp, Homo sapiens
  misc_feature: GYAE6OF02HVQJI.8.14.B03.1.454.CMB.1.raw
  modified_base (245)..(247): a, c, t, g, unknown or other
  misc_feature (245)..(247): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggagcgcttgggtgatcggcggagggaccaagctgaccgtcctaggtcagcccaaggctgccccctcggtcactctgttcccaccctcctcgacacgcgagctgagcgggctggcaaggcgcatagnnn

SEQ ID NO: 47905 - DNA, 249 bp, Homo sapiens
  misc_feature: GYAE6OF02GPQSQ.8.14.B03.1.454.CMB.1.raw
  modified_base (243)..(249): a, c, t, g, unknown or other
  misc_feature (243)..(249): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggagcgcttgggtgatcggcggagggaccaagctgaccgtcctaggtcagcccaaggctgccccctggtcactctgttcccacctcctcgacacgcgagctgagcgggctggcaaggcgcatagnnnnnnn

SEQ ID NO: 47906 - DNA, 219 bp, Homo sapiens
  misc_feature: GYAE6OF01B9I7M.14.87.H10.1.454.CMB.1.raw
  modified_base (217)..(219): a, c, t, g, unknown or other
  misc_feature (217)..(219): n is a, c, g, or t
tcagcgtctagtaccacgaccggtgctcgatttagcagtactgcgttgggtttggggaagaggaagactgacggtcctcccaggagttcaggtgctgggcaccgtgggcatggggaggtgtgtcacaagatttgggctctgggcacagcggccctgggctgcctggtcaaggactacttccgtactagacgctgagcgggctggcaaggcgcatagnnn

SEQ ID NO: 47907 - DNA, 248 bp, Homo sapiens
  misc_feature: GYAE6OF01EJRK7.14.87.H10.1.454.CMB.1.raw
  modified_base (224)..(248): a, c, t, g, unknown or other
  misc_feature (224)..(248): n is a, c, g, or t
tcagcgtctagtaccacgaccggtgctcgatttagcagtactgcgttagggtttggggggaagaggaagactgacggtccctcccaggagttcaggtgcgtgggcaccgtgggcatggggaggtgtgtcgacaagatttgggctctgggcacagcggccctgggctgcctggtcaaggactacgttccgtactagacgctgagcgggctggcaaggcgcatagnnnnnnnnnnnnnnnnnnnnnnnnn

SEQ ID NO: 47908 - DNA, 221 bp, Homo sapiens
  misc_feature: GYAE6OF01AKBMK.14.87.H10.1.454.CMB.1.raw
  modified_base (217)..(221): a, c, t, g, unknown or other
  misc_feature (217)..(221): n is a, c, g, or t
tcagcgtctagtaccacgaccggtgctcgatttagcagtactgcgttgggtttgggggaaggaggaagactgacggtcctcccaggagttcaggtgctgggcaccgtgggcatggggaggtgtgtcacaagatttgggctctgggcacagcggccctgggctgcctggtcaaggctacttccgtactagacgctgagcggctggcaaggcgcatagnnnnn

SEQ ID NO: 47909 - DNA, 220 bp, Homo sapiens
  misc_feature: GYAE6OF01EBR4Y.14.87.H10.1.454.CMB.1.raw
  modified_base (218)..(220): a, c, t, g, unknown or other
  misc_feature (218)..(220): n is a, c, g, or t
tcagcgtctagtaccacgaccggtgctcgatttagcagtactgcgttgggtttgggggaagaggaagactgacggtcctcccaggagttcaggtgctgggcaccgtgggcatggggaggtgtgtcacaagatttgggctctgggcacagcggccctgggctgcctggtcaaggactacttccgtactagacgctgagcgggctggcaaggcgcatagnnn

SEQ ID NO: 47910 - DNA, 589 bp, Homo sapiens
  misc_feature: GYAE6OF01CBCBR.14.87.H10.1.454.CMB.1.raw
  modified_base (183)..(183): a, c, t, g, unknown or other
  misc_feature (183)..(183): n is a, c, g, or t
  modified_base (389)..(389): a, c, t, g, unknown or other
  misc_feature (389)..(389): n is a, c, g, or t
  modified_base (447)..(447): a, c, t, g, unknown or other
  misc_feature (447)..(447): n is a, c, g, or t
  modified_base (536)..(536): a, c, t, g, unknown or other
  misc_feature (536)..(536): n is a, c, g, or t
tcagcgtctagtaccacgaccggtgctcgatttagcagtactgcgttgggtttggggtacgatttgatgttacctgatgcttagaggtcttttcctggaagcagggcatttgttgcttcagcaccgtagtgcctcgtcatcacgcctcagccttgatttttccggatttgcctaggaaaaccngcctacacgcttaaaccgggacaaccgtcgcccggcaacatagccttcctcccgtcccccttgcacgtaacaccaagtacaggaactattaacctgttccatcgactacgctattcggctcgccgttaggggtcactccacctgcccgattacgtgacaggaccttggtctcgcgtagcggtctttcaccgtcttatcgttacttntcgtcacgtctattcgactacttactcgtactacctcagctactcgccttcaacgacnccactaccttacacacgtaccttacgacgacctacctaccccaacaaaccacgacaagtaacgcgtacgcgtcgccgcacgtcgttcgngtctagttcgtactcccgttctactccttcccgctactgtcgacgtacgtacg

SEQ ID NO: 47911 - DNA, 652 bp, Homo sapiens
  misc_feature: GYAE6OF01EPSGJ.14.87.H10.1.454.CMB.1.raw
tcagcgtctagtaccacgaccggtgctcgatttagcagtactgcgttgggtttggggtacgatttgatgttacctgatgcttagaggctttttcctggaagcagggcatttgttgcttcagcaccgtagtgcctcgtcatcacgcctcagccttgattttccggatttgcctggaaaaccagcctacacgacttaaaccgggacaaccgtcgcccggccaacatagccttcctcccgtcccccttcgcagtaacaccaagtacaggaatacttaacctgttcccatcgactacgcctttcggcctcgccttaggggcactcaccctgccccgtattaacgtggacacggaacccttggtctccggcgagcgggtcttttcacccgtctttactcgtttacttatgtacagtcatttccgctactttctagacttaccctcagctatcgcctcacacgctacctacctcacgacggtcttaacacgaaccgccctaccccctaacccaacacgactaagtaacgccgtcgcctacgcccgacacggtcgtttcgggtactccgtacgtttacggtttacccgtccccggtttcacgtttccccttaccccgacctattacccgttggtaaaccgttaccgtaggtaaacccgg

SEQ ID NO: 47912 - DNA, 728 bp, Homo sapiens
  misc_feature: GYAE6OF01A5M00.14.87.H10.1.454.CMB.1.raw
  modified_base (183)..(183): a, c, t, g, unknown or other
  misc_feature (183)..(183): n is a, c, g, or t
  modified_base (416)..(416): a, c, t, g, unknown or other
  misc_feature (416)..(416): n is a, c, g, or t
tcagcgtctagtaccacgaccggtgctcgatttagcagtactgcgttgggtttggggtacgatttgatgttacctgatgcttagaggcttttcctggaagcagggctatttgttgcttcagcaccgtagtgcctcgtcatcacgcctcagtccttgattttccggatttgcctaggaaaaccngcctacacgcttaaaccgggacaaccgtcgcccggacaacatacgccttcctcccgtcccccttcgacagtaacaccaagtacaggaatacttaacctgttcccatccgactaccgtcctttcggccctcgccgttaggggtccacctcctaccctcgaccccgtaattaaccgttggaaccacggtaacccttggtccgttccggcgacggtcggtctttaccgacccgttntttacgtcgttactatcgtacagtctacttccgtactacgttctagtaacctaccgtaccagtacctagtccgtaccctacgaactacgtacctaaccttaccgttacgactaacggtaccttaaccggaacgtaaccccgccctaccccctaaacccaactaacccgacaacgtaacgtcccgtaccgtcgccggtacccgtcaccggttccgtccgtagtacccgtaggttccgggtttaccctccccggtttactccgttacccgttccccaccgttacttcccgaagttacgtacggtaccgtaccgg

SEQ ID NO: 47913 - DNA, 260 bp, Homo sapiens
  misc_feature: GYAE6OF01AVJJA.14.87.H10.1.454.CMB.1.raw
  modified_base (219)..(219): a, c, t, g, unknown or other
  misc_feature (219)..(219): n is a, c, g, or t
  modified_base (226)..(227): a, c, t, g, unknown or other
  misc_feature (226)..(227): n is a, c, g, or t
  modified_base (229)..(229): a, c, t, g, unknown or other
  misc_feature (229)..(229): n is a, c, g, or t
  modified_base (231)..(231): a, c, t, g, unknown or other
  misc_feature (231)..(231): n is a, c, g, or t
  modified_base (235)..(237): a, c, t, g, unknown or other
  misc_feature (235)..(237): n is a, c, g, or t
  modified_base (239)..(260): a, c, t, g, unknown or other
  misc_feature (239)..(260): n is a, c, g, or t
tcagcgtctagtaccacgaccggtgctcgatttagcagtactgcgttgggtttgggggaagaggaagactgacggtcctccaggagttcaggtgcgtgggcaccgtgggcagtggggaggtgtgtcacagagtttgggctctgggcacgagcgccctgggctgccgtggtcaaggctacttccgtactagacgctggacgcgggactggacaacgggcncagtagnngnantgcnnntnnnnnnnnnnnnnnnnnnnnnn

SEQ ID NO: 47914 - DNA, 216 bp, Homo sapiens
  misc_feature: GYAE6OF02HQ12G.14.87.H10.1.454.CMB.1.raw
  modified_base (216)..(216): a, c, t, g, unknown or other
  misc_feature (216)..(216): n is a, c, g, or t
tcagcgtctagtaccacgaccggtgctcgatttagcagtactgcgttgggtttgggaagaggaagactgacggtcctcccaggagttcaggtgctgggcaccgtgggcatggggaggtgtgtcacaagatttgggctctgggcacagcggccctgggctgcctggtcaaggactacttccgtactagacgctgagcgggctggcaaggcgcatagn

SEQ ID NO: 47915 - DNA, 219 bp, Homo sapiens
  misc_feature: GYAE6OF02F86AH.14.87.H10.1.454.CMB.1.raw
  modified_base (218)..(219): a, c, t, g, unknown or other
  misc_feature (218)..(219): n is a, c, g, or t
tcagcgtctagtaccacgaccggtgctcgatttagcagtactgcgttgggtttgggggaagaggaagactgacggtcctcccaggagttcaggtgctgggcaccgtgggcatggggaggtgtgtcacaagatttgggctctgggcacagcggccctgggctgcctggtcaaggactacttccgtactagacgctgagcgggctggcaaggcgcatagnn

SEQ ID NO: 47916 - DNA, 217 bp, Homo sapiens
  misc_feature: GYAE6OF02GJWPR.14.87.H10.1.454.CMB.1.raw
  modified_base (217)..(217): a, c, t, g, unknown or other
  misc_feature (217)..(217): n is a, c, g, or t
tcagcgtctagtaccacgaccggtgctcgatttagcagtactgcgttgggtttgggggaagaggaagactgacggtcctcccaggagttcaggtgctgggcaccgtgggcatggggaggtgtgtcacaagatttgggctctggcacagcggccctgggctgcctggtcaaggactacttccgtactagacgctgagcgggctggcaaggcgcatagn

SEQ ID NO: 47917 - DNA, 279 bp, Homo sapiens
  misc_feature: GYAE6OF02HLC23.14.87.H10.1.454.CMB.1.raw
  modified_base (229)..(231): a, c, t, g, unknown or other
  misc_feature (229)..(231): n is a, c, g, or t
  modified_base (233)..(279): a, c, t, g, unknown or other
  misc_feature (233)..(279): n is a, c, g, or t
tcagcgtctagtaccacgaccggtgctcgatttagcagtactgcgttagggtttgggggaagaggaagactgacggtccctcccagggagttcaggtcgcgtgggcaccgtgggcatgggggaggtgtgtcacaaggatttggggctctgggcacagcggccctgggctgcctggtcaaggactacgttccgtactagacgctgagcgggctggcaagggcgcgatagnnngnnnnnnnnnnnnnnnnnnnnnnnnnnnnnnnnnnnnnnnnnnnnnnn

SEQ ID NO: 47918 - DNA, 606 bp, Homo sapiens
  misc_feature: GYAE6OF02HUFLL.14.87.H10.1.454.CMB.1.raw
tcagcgtctagtaccacgaccggtgctcgatttagcagtactgcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgtttcccatcgactacgcctttcggcctcgccttagggtcactcaccctgccccgattaacgtggacaggaccttggtccttccggcgagcgggtcttttccaccgtctttatcgtttacttatcgtcagtcatttcgctacttctgacttacctccagcatcgcctcacacgcacaccttcacagctacacgaacgcctacccctaacccaacaaccgcaataacgccgtcgctcgccgcacgccgttacggcgtactagttcggtttaacgtccccgttttcactttcccgttccccgacctacttccgtacggtacgttacgtacgaccg

SEQ ID NO: 47919 - DNA, 616 bp, Homo sapiens
  misc_feature: GYAE6OF02J1LHZ.14.87.H10.1.454.CMB.1.raw
  modified_base (468)..(468): a, c, t, g, unknown or other
  misc_feature (468)..(468): n is a, c, g, or t
  modified_base (505)..(505): a, c, t, g, unknown or other
  misc_feature (505)..(505): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
tcagcgtctagtaccacgaccggtgctcgatttagcagtactgcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgccagtaaccaccaagtacaggaactattaacctgtttacccattccgactacgcctttcggcctcgccttaggggtcgactcaccctgccccgataaccgtggacaggaaccccttggtccttaccggtcgacgtcgggccttttcgacccgtctttactcgttactatcgtcagcattcgcacttctgactacctccagcatcgctcatcgcacaccttcacngcttacataaccgctccccacacaacgtcaagttacncgtccgctgcccgcacgtnttccgngccagttcgggttaacgtccccgtttacacgttacctttcccccggactaacgtcccgttacggtaacttacccggtataccccgg

SEQ ID NO: 47920 - DNA, 224 bp, Homo sapiens
  misc_feature: GYAE6OF02HY58U.14.87.H10.1.454.CMB.1.raw
  modified_base (220)..(224): a, c, t, g, unknown or other
  misc_feature (220)..(224): n is a, c, g, or t
tcagcgtctagtaccacgaccggtgctcgatttagcagtactgcgttgggtttggggggaagaggaagactgacggtcctcccaggagttcaggtgctgggcaccgtgggcatgggggaggtgtgtcacaagatttgggctctgggcacagcggccctgggctgcctggtcaaggactacttccgtactagacgctgagcgggctggcaaggcgcatagnnnnn

SEQ ID NO: 47921 - DNA, 589 bp, Homo sapiens
  misc_feature: GYAE6OF02F8VO3.14.87.H10.1.454.CMB.1.raw
  modified_base (491)..(491): a, c, t, g, unknown or other
  misc_feature (491)..(491): n is a, c, g, or t
  modified_base (523)..(523): a, c, t, g, unknown or other
  misc_feature (523)..(523): n is a, c, g, or t
  modified_base (574)..(574): a, c, t, g, unknown or other
  misc_feature (574)..(574): n is a, c, g, or t
tcagcgtctagtaccacgaccggtgctcgatttagcagtactgcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgtctttatcgttacttatgtcagcattcgctacttctgactacctccagcatcgcctcacagccacaccttcacacggcttacacgaaccgcctacccctacccaacacncataacgccgtcgctcgccgcacgcgttcggncgtacgttcggtttaccgccccgtttcacttcccttcccgctacttccgtnacgttactagtaccg

SEQ ID NO: 47922 - DNA, 601 bp, Homo sapiens
  misc_feature: GYAE6OF02GZBNS.14.87.H10.1.454.CMB.1.raw
  modified_base (384)..(384): a, c, t, g, unknown or other
  misc_feature (384)..(384): n is a, c, g, or t
  modified_base (526)..(526): a, c, t, g, unknown or other
  misc_feature (526)..(526): n is a, c, g, or t
tcagcgtctagtaccacgaccggtgctcgatttagcagtactgcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgtttcccatcgactacgcctttcggcctcgccttaggggtcactcaccctgccccgattaacgttggacaggaacccttggtcttccggcgagccgggcttttcgacccgtntttactcgttacttatcgtcacgtcatttcgctacttctgactacctccagcctatcgaccctcacagcacaccttcacagcttacataacgcctccctaccaacaccgacataacgcgtcgctgccgcacgtccttacggntacgtacgtcggtttacgccccgttttacaccttccgttcccgtacctacttcctaggtacgttactaggtaccg

SEQ ID NO: 47923 - DNA, 223 bp, Homo sapiens
  misc_feature: GYAE6OF02HDALY.14.87.H10.1.454.CMB.1.raw
  modified_base (218)..(223): a, c, t, g, unknown or other
  misc_feature (218)..(223): n is a, c, g, or t
tcagcgtctagtaccacgaccggtgctcgatttagcagtactgcgttgggtttgggggaagaggaagactgacggtcctcccaggagttcaggtgctgggcaccgtgggcatggggaggtgtgtcacaagatttgggctctgggcacagcggccctgggctgcttggtcaaggactacttccgtactagacgctgagcgggctggcaaggcgcatagnnnnnn

SEQ ID NO: 47924 - DNA, 139 bp, Homo sapiens
  misc_feature: GYAE6OF02GM2C3.14.87.H10.1.454.CMB.1.raw
  modified_base (137)..(139): a, c, t, g, unknown or other
  misc_feature (137)..(139): n is a, c, g, or t
tcagcgtctagtaccacgaccggtgctcgatttagcagtactgcgttgggtttgggctctgggcacagcggccctgggctgcctggtcaaggactacttccgtactagacgctgagcgggctggcaaggcgcatagnnn

SEQ ID NO: 47925 - DNA, 805 bp, Homo sapiens
  misc_feature: GYAE6OF02IN7QW.14.87.H10.1.454.CMB.1.raw
  modified_base (418)..(418): a, c, t, g, unknown or other
  misc_feature (418)..(418): n is a, c, g, or t
  modified_base (455)..(455): a, c, t, g, unknown or other
  misc_feature (455)..(455): n is a, c, g, or t
  modified_base (461)..(461): a, c, t, g, unknown or other
  misc_feature (461)..(461): n is a, c, g, or t
tcagcgtctagtaccacgaccggtgctcgatttagcagtactgcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtccgcccggccaaacatagccttcctcccgtccccccttacgcagtaaccaccaagtacaaggaatacttaacctgttcccatcactcgcctttcggcctcgccttaggggtccactccaccctgccccgtaattaacggttggaacacgggtaacccttggtccttccggcacggcgggtcttttccacccgtctttactcgttacttntcgtacagtctattcgctacttctgacctacctaccngtactntcgccttaccacgtacgacctacctaacccgtttccaacaccgggtctttaacccgaacggaacccgttacccctaaccccccttaaacccgaaccctaaacccggacctaaacgttaacccggaccgtttacccggcgttacccgggaccccgtaccggttaaaccgggtcccgtttaccggggtttaccgacccgttaacgggtttacccgggtttttaaccccgggtttccccccgtttttaaacccgttaaccccggttcccccgttttcccccggaccccgtttaacgtttcccggtttaacccggacgggttttaaccccgtaacggttaaccccggg

SEQ ID NO: 47926 - DNA, 729 bp, Homo sapiens
  misc_feature: GYAE6OF02G7AH1.14.87.H10.1.454.CMB.1.raw
  modified_base (402)..(402): a, c, t, g, unknown or other
  misc_feature (402)..(402): n is a, c, g, or t
  modified_base (459)..(459): a, c, t, g, unknown or other
  misc_feature (459)..(459): n is a, c, g, or t
tcagcgtctagtaccacgaccggtgctcgatttagcagtactgcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatacgccttcctcccgtccccccttcgcagtaaccaccaagtacagaatattaacctgttcccatcgactacgcctttcgcctcgccttaggggtcactcaccctgccccgtattaacgtggacaggacccttggtcgttccggcgagcgggtcttttcgacccgtctttactcgttacttntgtcagctattccgctacttctcgtacttaccctccagcctatcgtccctcaccacncctaacctacccttacaacgtacgtaccttacgaaccgtaacccgtaccccgttaccccctaaccccgaaacctaaccgacctaaacggtaaccgtcccggttacgtccgtaccggccccgtacgtaccggttcccgttccgggtaccgtacgtacggttttaccgggttttccccggttacccccggtttttactaccccgttttccccgttacccccggtccttaacccgttcgttaaccggtaccgttaaccgttacggtaacccgg

SEQ ID NO: 47927 - DNA, 749 bp, Homo sapiens
  misc_feature: GYAE6OF02G47QC.14.87.H10.1.454.CMB.1.raw
  modified_base (183)..(183): a, c, t, g, unknown or other
  misc_feature (183)..(183): n is a, c, g, or t
  modified_base (548)..(548): a, c, t, g, unknown or other
  misc_feature (548)..(548): n is a, c, g, or t
  modified_base (622)..(622): a, c, t, g, unknown or other
  misc_feature (622)..(622): n is a, c, g, or t
tcagcgtctagtaccacgaccggtgctcgatttagcagtactgcgttgggtttggggtacgatttgatgttacctgatgcttagaggcttttcctggaagcagggcatttgttgcttcagcaccgtagtgcctcgtcatcacgcctcagccttgtatttttccggatttgcctaggaaaaccngcctacacgacttaaaccgggacaaccgtcgcccggaccaacatacgccttcctccccgttccccccttgaccaacgtaaccaccaagtacaaggtaatacttaacctcgtttacccatccgactaccgtccgtttccggaccttcggccgtttagggggtccacctcacccctgaccccgtaatttaacggttcggacctacgggtaaccctttgggtcctttcccgggacgtacggtccggggtcctttttccgacccgtaccgtttacgttaccgtttaacttagtagtcaggtctactttccggaccttacttcgtcgtaactaccctacgacgtacctacgtcgacctacctacgaaccnctacctctaccacgacggtcttacacgtaccctaccctacccctaaccaaccacgtctaagtaacgcgttaccncgtaccgcccgtacgacggttccgttcgggacgtcgtaggtttaaccggtttccggtcccctttacgttaccgttccccgttacccggtacttaccgtcttacgggtaaccgttaccgacgtaccgg

SEQ ID NO: 47928 - DNA, 628 bp, Homo sapiens
  misc_feature: GYAE6OF02JF10G.14.87.H10.1.454.CMB.1.raw
  modified_base (547)..(547): a, c, t, g, unknown or other
  misc_feature (547)..(547): n is a, c, g, or t
  modified_base (561)..(561): a, c, t, g, unknown or other
  misc_feature (561)..(561): n is a, c, g, or t
tcagcgtctagtaccacgaccggtgctcgatttagcagtactgcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatagccttctccgtcccccttcgcagtaacaccaagtacaggaatattaacctgttccatcgactacgcctttcggcctcgccgttagggtcactcaccctgccccgtattaacgtggacaggacccttggtctccggcagccgggcttttcgacccgtctttactcgtttaccttatgtaccagtctactttcgactactttcctgaacttaccctccaagctaactcgtcctacaacacgccacctaccttccacacggtccttaacaccgaaacgtcccctacccctaaccaaacaaccgctatacggccgtcgcctgacccncagtcctacgggtncgtagtcggtttacgcccgttctaacgttcgttccccgacctcgtaccttaggacttaccgtgaccg

SEQ ID NO: 47929 - DNA, 258 bp, Homo sapiens
  misc_feature: GYAE6OF02GJ9M2.14.87.H10.1.454.CMB.1.raw
  modified_base (219)..(219): a, c, t, g, unknown or other
  misc_feature (219)..(219): n is a, c, g, or t
  modified_base (226)..(258): a, c, t, g, unknown or other
  misc_feature (226)..(258): n is a, c, g, or t
tcagcgtctagtaccacgaccggtgctcgatttagcagtactgcgttgggtttggggggaagaggaagactgacggtcctcccaggagttcaggtgctgggcaccgtgggcatgggggaggtgtgtcacaagatttgggctctggggcacagcggccctgggctgcctggtcaaggcctacttccggtactagaccgctgaggcgggctggcaagggcncagtagnnnnnnnnnnnnnnnnnnnnnnnnnnnnnnnnn

SEQ ID NO: 47930 - DNA, 642 bp, Homo sapiens
  misc_feature: GYAE6OF02J0DKF.14.87.H10.1.454.CMB.1.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (301)..(301): a, c, t, g, unknown or other
  misc_feature (301)..(301): n is a, c, g, or t
  modified_base (335)..(335): a, c, t, g, unknown or other
  misc_feature (335)..(335): n is a, c, g, or t
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
  modified_base (557)..(557): a, c, t, g, unknown or other
  misc_feature (557)..(557): n is a, c, g, or t
  modified_base (569)..(569): a, c, t, g, unknown or other
  misc_feature (569)..(569): n is a, c, g, or t
  modified_base (594)..(594): a, c, t, g, unknown or other
  misc_feature (594)..(594): n is a, c, g, or t
tcagcgtctagtaccacgaccggtgctcgatttagcagtactgcgttgggtttggggtacgatttgatgttacctgatgcttagaggcttttcttggaagcagggcatttgtgcttcagcaccgtagtgcctcgtcatcacgcctcagccttgattttccggatttcgcctaggaaaaccagtcctacacgcttaaaccgggaccaaccgtcgcccggaccaacntacgcccttaccncccgtacccccctgaccagtaaccaccagtaccgaggtactacttaacccttgttacccatcnctacgtccttccggcctcgctaggggctacctcnccctgccccgtaataccggttcggacgacgtaacctggttcctcggcgacggtccggtcctttccaccgtntttactcgttatctgtacncgtctcgtcnctctctanacttccnccgagtcctaatcgacctacgtacncgactaccnctacgaccgntaccgtacacgaccgtactcccctaacaccacgtacacgtaacgccgtcgacgtccaccgtcngtcccgtcggtnaccgtcgtacggttcccttacgttntaccgtacccttccgccttacgtccgtaacgccgttactcgtacccgg

SEQ ID NO: 47931 - DNA, 589 bp, Homo sapiens
  misc_feature: GYAE6OF01D7KM6.16.28.C06.1.454.CMB.1.raw
  modified_base (385)..(385): a, c, t, g, unknown or other
  misc_feature (385)..(385): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagccgaggacacggcctatattacngtcgcccgagggtagttttactatgtatattactaggttaacaaaaagggttactactttgactacgtgggccgaggaccctggtcaccgtctcctcacgcctccaccgaacggcccacgtccggtcccttcccccgtcggcccgcccgtcgccgtccgaggacgccacccgtccgacgaaccacaggccggcccgtgggtccg

SEQ ID NO: 47932 - DNA, 573 bp, Homo sapiens
  misc_feature: GYAE6OF01EDY6E.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccagggagggctggagtgggtctcacttattagtggtagtggtagtactacatactacgcagactccgtgaagggccgttcaccatctccagagataatcccaagaacacgctgtatctgcaaatgaacggcctgagagccgaggacacggcgtatattactgtgcccgagggtagttttacatgatattactaggttaacaaaaagggtactaactttgactacgtgggccagggaccctggtcaccgtctcctcacgcctccaccgaacgggcccatccggtccttccccgtggccgcccgtgcctccgaggacgccaccctccgacgaaccacgagcggcccgtgggccg

SEQ ID NO: 47933 - DNA, 553 bp, Homo sapiens
  misc_feature: GYAE6OF01AR3N8.16.28.C06.1.454.CMB.1.raw
tcagtgtactactccacgaccggtgctcgatttagagctcacgtattgggtttgggctgagttggcttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgaggagttttacatgatattactggttacaaaaagggtactactttgactactggggccagggaaccctggtcaccgtctcctcagcctcaccaagggcccatcggtctcccctggcgccctgctccaggacgcacctccgagaacacagcggccctgggcc

SEQ ID NO: 47934 - DNA, 575 bp, Homo sapiens
  misc_feature: GYAE6OF01DO9OB.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaaacggcctgagagccgaggacacggccgtatattactgtgcccgagggagttttacatgatattactaggttaacaaaaagggtactactttagactacgtggggccagggaaccctggtccaccgtctcctcacgcctaccaccgaacggcccatccggtccttcccctcggccgccctgcctccaggcgccacctccgacgaaccacagccggccctgggtcc

SEQ ID NO: 47935 - DNA, 614 bp, Homo sapiens
  misc_feature: GYAE6OF01AIT7Z.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaagggctggagtgggtctcacttattagtggtagtggtagtactacatactacgcagactccgtgaagggccgttcaccatctccagagacaatcccaagaacacgctgtatctgacaaatgaacggcctgagacgccgaggacacggcctatattactgtcgcccggtagggtagttttacagtgtatattacgtaggttaacgtaaaaagggttacttaacgtttagactacgtcggggaccgacgggaccctggtaccaccgtctcctcacgccctccgaccgacggccctacgtcccggtccttccccgtggcccgtccccgtgcccgtccgaggacgcccgtacccgtaccgacgaaccacgacggccggcccgtgggtccg

SEQ ID NO: 47936 - DNA, 587 bp, Homo sapiens
  misc_feature: GYAE6OF01DINDC.16.28.C06.1.454.CMB.1.raw
  modified_base (390)..(390): a, c, t, g, unknown or other
  misc_feature (390)..(390): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccggggggtcctgagactctcctgtgcagcctctggattcccctttaccacatatgccatgggctgggtccgccaggctccgaggggaaggggctggagtgggtctcacttattagtggtagtggtagtactacatactacgcagactccgtgaagggccggttcaccatctccagagacaatcccaagaacacgctgtatctgacaaatgaacggcctgagagccgaggacacggccgtaatattacngtgcccgagggtagttttacatgatattactaggttaacaaaaagggtactacgtttagactacgtgggccaagggaaccctggtccaccgtctcctcacgcctccaccgaacggcccagtccggtccttccccgtggccgccctcgcctccgaggacgccaccctccgaacgaaccacaggccgcccgtgggtccg

SEQ ID NO: 47937 - DNA, 578 bp, Homo sapiens
  misc_feature: GYAE6OF01ACCTU.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggtagttttacatgatattactggttaacaaaagggtactaactttgactacgtgggaccagggaaccctggtccaccgtctcctcacgcctccaccaacggcccagtccggtccttcccccgtggccgccctgcctccgaggacgccacccgtccgacgaaccacagccggcccgtgggccg

SEQ ID NO: 47938 - DNA, 620 bp, Homo sapiens
  misc_feature: GYAE6OF01DMF82.16.28.C06.1.454.CMB.1.raw
  modified_base (369)..(369): a, c, t, g, unknown or other
  misc_feature (369)..(369): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggattccccctttaccacatatgccatgggctggggtcccgccaggctccgaggggaaggggctggagtgggtctcactttattagtggtagtggtagtactacatactacgcagactccgtgaagggccggttcaccatctccagagacaatcccaagaacacgctgtatctgacaaatgaacggctgagngccgagacacggcctatatactgcgccgaggtagttttacatgatattacgtaggttaacaaaaagggtacttacttagactacgtcgggccgacgggaccctggtccaccgtctcctcacgcctacccgaccgacgggcccacgtccggtcccttcccccgtcggcccgtccccgtcgcccgtacccgagggaccgcccgacccgtacccgaacgaacccgaacgacgggcccggcccgtcggggtcccg

SEQ ID NO: 47939 - DNA, 785 bp, Homo sapiens
  misc_feature: GYAE6OF01CZJ43.16.28.C06.1.454.CMB.1.raw
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtcctgagactctcctgtgcagcctctggacttcccctttaccacatatgccatgggctgggtccgccaggctccgaggggaaggggctgggagtgggtctcacttattagtggtagtggtagtactacatactacgcagactccggtgaagggcccgttcacatctccagagacaacncccaagaacncgctgtactctgacaaaagtcggaacggctaggaacgacggccggaagggtaacaccggtccgtaattaacgttacgtggtacggaccccgggtaaggggttacgtttttaacagttagtaactttaagtttaacgttaacgggttaaaacggttaaaaaaacggggttaaccgtttaacgttttacggtaaccgttaaccggtacgggggtacccgaacggggtaaaccccgttcggtacccgtaacccggttcctcccgttaccgaccgtaccccctaccccgaacccggtaaccgggacccctaacggttcccggttaccccgttcccccgtccgggccccgtccccgtcggtcccgtccggaacggaccggtacccgtaacccgtacccggtaaaccgaaacccgaaccgaaccgggccccgggtccccggtcggggtcccgg

SEQ ID NO: 47940 - DNA, 578 bp, Homo sapiens
  misc_feature: GYAE6OF01EOBC5.16.28.C06.1.454.CMB.1.raw
  modified_base (393)..(393): a, c, t, g, unknown or other
  misc_feature (393)..(393): n is a, c, g, or t
  modified_base (523)..(523): a, c, t, g, unknown or other
  misc_feature (523)..(523): n is a, c, g, or t
  modified_base (556)..(556): a, c, t, g, unknown or other
  misc_feature (556)..(556): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccggggggtccctgagactctcctgtgcagcctctggacttcccctttaccacatatgccatgggctgggtccgccaggctccgagggaaggggctggagtgggtctcacttattagtggtagtggtagtactacatactacgcagactccgtgaagggccgttcaccatcctccagagacaatcccaaagaaccacgctgtatctgacaaatgaaacgctagagagccgaggacacggaccgtatattacngtcgcccggtagggtagttttacatgatattactaggttaacaaaaaggtactattagactacgtgggaccgaggtaacctggtcaccgtctctcacgcctccacgaacggccagtccgtccttccccgnggccctcctgccgtcaggacgccacctcccganaaccacgacgccggccgtggcc

SEQ ID NO: 47941 - DNA, 592 bp, Homo sapiens
  misc_feature: GYAE6OF01BR0ER.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttgggagtctgggggagccttggtacaggccgggggggtccctgagactctcctgtgcagcctctggattcccctttaccacatatgccatgggctgggtccgccaggctccaggggaaggggctggagtgggtctcactttattagtggtagtggtagtactacatactacgcagactccgtgaagggccggttcaccatctccagagacaatcccaagaacacgctgtatctgcaaaatgaacggcctgagagccgaggacacggcctatattactgtgcccgagggtagttttacatgatattactggttaacaaaaagggtactactttgactacgtggggccagggaaccctggtcaccgtctcctcacgcctccaccaacgggcccagtccggtccttcccccgtggcccgcccctgcctccgagggacgccaccctcccgaacgaaccacaggccggccccgtggggtcccg

SEQ ID NO: 47942 - DNA, 548 bp, Homo sapiens
  misc_feature: GYAE6OF01AWHEI.16.28.C06.1.454.CMB.1.raw
  modified_base (548)..(548): a, c, t, g, unknown or other
  misc_feature (548)..(548): n is a, c, g, or t
tcagtgtactactccacgaccggtgctcgatttagagctcacgtattgggtttggggggaagaggaagactgacggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttactatgatattactggttacaaaaaagggtactactttgactactggggccagggaaccctggtcaccgtctcctcagcctccaccaagggcccatccggtcttccccctggccgccctgctcccaggagcaccctccgagaacacagcggccctgggctgcctggtcaaggctactccgagtagtacactgagcgggctggcgaacggcgcatgn

SEQ ID NO: 47943 - DNA, 625 bp, Homo sapiens
  misc_feature: GYAE6OF01BZUNZ.16.28.C06.1.454.CMB.1.raw
  modified_base (382)..(382): a, c, t, g, unknown or other
  misc_feature (382)..(382): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccaggggagggctggagtgggtctcacttattagtggtagtggtagtactacatactacgcagactccgtgaaggccgttcacatcctcagacgacaactcccaagaacacgctagtatctgacaaatgaacgcctgagcgcgaggacacggctatatacngtcgaccgtaggtacgttttacagtgattagttacgtaggtaacgtaaaaagggttacttaacgtttagacttacggtgggaccgaacgggtaccctggtcctaccgtctcctcacgtcctaccgaccgaccggccctacgtcccggtcccgttccccgtcggtccgtcccgtcgtcccgtccgacggacgcccgtacccgtaccgaacgaaccaccgacggcccggtcccgtcgggtacccg

SEQ ID NO: 47944 - DNA, 703 bp, Homo sapiens
  misc_feature: GYAE6OF01EBE5C.16.28.C06.1.454.CMB.1.raw
  modified_base (646)..(646): a, c, t, g, unknown or other
  misc_feature (646)..(646): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggcccgggggggtccctgagactctcctgtgcagcctctggactttcccctttacacatatgccatgggctgggtccgccaggctccgaggggaagggctggagtgggtctcacttattagtggtagtggtagtactacatactacgcagactccgtgaagggccgttcaccatctcagagacaatcccaagaaccacgctgtactctagactaaaagtcggaaaccggtcctaggaacgaggacccgtaagggacccacgggtaccgttaattaacgtttacgtggtacgacccggtaaggggttagttttacagtagtattattacgtaggttaacgtaaaaagggttacttacgttacgtacgtacggtacgggtaccgaacgggtaacccgtcggtacctaccgttcctcccgtcgaccgtccctacccgaccgtaacggccctacgttcccggtacccgttccccgtcggtcccgccccgtcggacccgtacccgagggacncccgaacccgtacccgaaacgtaacccgaccgtaccggccggtccccgtgggtcccg

SEQ ID NO: 47945 - DNA, 727 bp, Homo sapiens
  misc_feature: GYAE6OF01AO85M.16.28.C06.1.454.CMB.1.raw
  modified_base (130)..(130): a, c, t, g, unknown or other
  misc_feature (130)..(130): n is a, c, g, or t
  modified_base (218)..(218): a, c, t, g, unknown or other
  misc_feature (218)..(218): n is a, c, g, or t
  modified_base (413)..(413): a, c, t, g, unknown or other
  misc_feature (413)..(413): n is a, c, g, or t
tcagtgtactactccacgaccggtgctcgatttagagctcacgtattggggtttggggctgagttggctttttcttgtggctattttaaaaggtgtcagtgtgaggtgcaactgttggagtctggggganccttggtacaggccgggggggtccctgaggactctcctgtgcagcctctggacttcccctttaccacatatgccatgggctgggtccnccaggctccgagggaaggggctggagtgggtctcactttattaggtggttagtggtagtactacagtactacgcagacctccgtgaacgggccgttcaccatcctccagagacaactcccaaagaaccacggctgtactctgaccaaatggaacggcctaggagacgccggaggacgacggacgtatacttacgnggtacgacccggtagggtacgttttacagtcgtagttacttacgttaggttaaacgtaaaaacgggttacttaacgttttgaacgttacggtacggggacccgtaacgggtaaccccgttgggtaccctacccggttcctacccgtgacccgtcccgtacccaacccggtaacgggccccttaacggtcccgggttccccttcccccggtcgggcccgtccccgtcgacccgttccggaacgggaccgtaccgaccccgttccggaaaccgtaaaccgaccgtaaccgggcccggtcccggttacgggtcccgg

SEQ ID NO: 47946 - DNA, 703 bp, Homo sapiens
  misc_feature: GYAE6OF01A6UEJ.16.28.C06.1.454.CMB.1.raw
  modified_base (130)..(130): a, c, t, g, unknown or other
  misc_feature (130)..(130): n is a, c, g, or t
  modified_base (349)..(349): a, c, t, g, unknown or other
  misc_feature (349)..(349): n is a, c, g, or t
  modified_base (407)..(407): a, c, t, g, unknown or other
  misc_feature (407)..(407): n is a, c, g, or t
tcagtgtactactccacgaccggtgctcgatttagagctcacgtattgggtttgggctggagttggctttttcttgtggctattttaaaaggtgtccagtcgtgaggtgcaactgttggagtctgggganccttggtacaggccggggggtcctgagactctcctgtgcagcctctggacttccccttaccacatatgccatggctgggtccgccaggctcgagggaagggctggagtggtctcgacttatagtggtagtggtagtacctacagtactacgcagactccgtgaagggccgttcaccatctccagacgacaattccccaagtaaccacgctgtaactcgngacaaagtcgaaaccgggcctaggagacgccgaaggaccacggtcctaatacttacgngtcgacccgtagggtacgttttacagtgtactagttactggttaaactaaaagggtctaacgtttagacttacggtcgggtaccgagggtaaccctggtacccgtaccgttctcccgtacacgtccccgtaccgaaccgtaacgggtccccaggttacccgggtaccctttcccccggtaggtccccgtccccgtaggtaccccgtacccggtaggaccggtaccctaacccgttacccggtaacggtaaaccccaccggtaaccggccccgggtaccccgttaggggtaccccgg

SEQ ID NO: 47947 - DNA, 672 bp, Homo sapiens
  misc_feature: GYAE6OF01ENKZ5.16.28.C06.1.454.CMB.1.raw
  modified_base (324)..(324): a, c, t, g, unknown or other
  misc_feature (324)..(324): n is a, c, g, or t
  modified_base (423)..(423): a, c, t, g, unknown or other
  misc_feature (423)..(423): n is a, c, g, or t
tcagtgtactactccacgaccggtgctcgatttagagctcacgtattgggtttgggctgagttggctttttcttgtggctattttaaaaggtgtccagtgtgaggtgcaactgttgggagtctggggggagccttggtacaggccgggggggtccctgagactctcctgtgcagcctctggacttcccctttaccacatatgccatgggctgggtccgccaggctccgagggaaggggctggagtgggtctcacttattagtggtagtggtagtactacatactacgcagactccgtggaacgggccgttcaccatctccaganacaactcccaaagaacacgctgtatctgacaaatgaacggcctgagacgccgaggacacggcctaatactctgtcggcccggtaggtagttttacagtntatattacgttaggttaaactaaaaacgggttacttaacgtttacgtaacgttacgtacgggggaccgtaacgggtaacccgtcggtacctacccggttctcccgtcgacgtaccctaccgacccgtaacggcccgtacgtcccggttacccttcccccgtcggcccgtccccgtcgtccgtcccgaggacgcccgacccgtaccggaacgtaaaccaccgaaccggcccggtccccgtcggggtaccg

SEQ ID NO: 47948 - DNA, 616 bp, Homo sapiens
  misc_feature: GYAE6OF01CDO1F.16.28.C06.1.454.CMB.1.raw
  modified_base (386)..(386): a, c, t, g, unknown or other
  misc_feature (386)..(386): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccggggggtcctgagactctcctgtgcagcctctggacttcccctttaccacatatgccatgggctgggtccgccaggctccgagggagggctggagtgggtctcacttattagtggtagtggtagtactacatactacgcagactccgtgaacgggccgttcaccatctccagagacaatcccaagaacacgctgtatctgacaaatcgaacggcctagagacgccgaggaccacggcctaatnttactggtcgcccggagggttagttttacagtgtattattacgtaggttaaacaaaagggttacttacgttagactacgtcggggaccacgggacccgtggtccaccgtctcctcacgtccctaccgaccgacggccctacgtccgtcccttaccccgtcggcccgtccctcgccgtccgaggaccgccacccgtaccgaacgtaccacgacggccggccggtgggtccg

SEQ ID NO: 47949 - DNA, 597 bp, Homo sapiens
  misc_feature: GYAE6OF01B66Z3.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaagggctggagtgggtctcacttattagtggtagtggtagtactacatactacgcagactccgtgaagggccggttcaccatctccagagacaatcccaagaacacgctgtatctgcaaatgaacgctgagagccgaggacacggccgtatattactgtgcccgagggtacggttttacatgatattactggttaacaaaagggtactaacgtttgactacgtggggccacgggaccctggtccaccgtctccctcacgtccctaccacccgaacgggcccacgtccggtccttccccgtcggccgtcccgtcgcctccgaggacgccacccgtccgaacgaaccacgacggccggcccgtcgggtaccg

SEQ ID NO: 47950 - DNA, 632 bp, Homo sapiens
  misc_feature: GYAE6OF01A4E86.16.28.C06.1.454.CMB.1.raw
  modified_base (326)..(326): a, c, t, g, unknown or other
  misc_feature (326)..(326): n is a, c, g, or t
  modified_base (591)..(591): a, c, t, g, unknown or other
  misc_feature (591)..(591): n is a, c, g, or t
tcagtgtactactccacgaccggtgctcgatttagagctcacgtattgggtttgggctgagttggctttttcttgtggctattttaaaaggtgtccagtgtgaggtgcaactgttggagtcgtgggggagccttggtacaggcccgggggggtccctgagactctcctgtgcagcctctggacttcccctttaccacatatgccagtgggctgggtccgccaggcctccgaggggaagggctggagtggtctcactttattaggtggtagtggtagtactacatactacgcagactccgtgaacgggtccgttcaccatctcaganacaactcccaaagaccacgctagtatctagacaaagtgaaccggctagagacgcgaggacacggctatattacgtggcgccggtaaggttacgtttacagtagtaattattacgttaaggttaaacgtaaaaaggttacttaacgttacgaacgttacggtcgggaccgtacgggtaccgtcggtacctaccgtctcctcgacgtccctaccaccgtacggcctacgtccgtccctcccgcgtccgcccgtcgccgtcgacggcncccgacctaccgaacgaccacgacgccggtcccgtgggccg

SEQ ID NO: 47951 - DNA, 636 bp, Homo sapiens
  misc_feature: GYAE6OF01DQENC.16.28.C06.1.454.CMB.1.raw
  modified_base (592)..(592): a, c, t, g, unknown or other
  misc_feature (592)..(592): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccggggggtccctgagactctcctgtgcagcctctggacttccccctttacacatatgccatgggctgggtccgccaggctccgagggagggctggagtgggtctcacttattagtggtagtggtagtactacatactacgcagactccgtgaacgggccggttcaccatctccagagacaactcccaagaacacgctgtatctgacaaagtcgaaacggcctagagacgccgaggacacggccgtatacttacgtgtcggacccggagggtacgtttttacagttgtaattaattacgttaggttaaacgtaaaaagggttaccttaacgtttacggactacggtcggggaccgacgggaacccgttggtcctaccgtctccctcacgccctaccaccgacggcccacgtccgtcccttccccgtcggcccgccctgccgtccgaggacnccaacccgtccgaacgaaccaccgacgcccggcccgtcgggccg

SEQ ID NO: 47952 - DNA, 623 bp, Homo sapiens
  misc_feature: GYAE6OF01B96YV.16.28.C06.1.454.CMB.1.raw
  modified_base (218)..(218): a, c, t, g, unknown or other
  misc_feature (218)..(218): n is a, c, g, or t
  modified_base (282)..(282): a, c, t, g, unknown or other
  misc_feature (282)..(282): n is a, c, g, or t
  modified_base (414)..(414): a, c, t, g, unknown or other
  misc_feature (414)..(414): n is a, c, g, or t
  modified_base (518)..(518): a, c, t, g, unknown or other
  misc_feature (518)..(518): n is a, c, g, or t
  modified_base (552)..(552): a, c, t, g, unknown or other
  misc_feature (552)..(552): n is a, c, g, or t
tcagtgtactactccacgaccggtgctcgatttagagctcacgtattgggtttgggctgagttggctttttcttgtggctattttaaaaggtgtccagtgtgaggtgcaactgttggagtcgtgggggagccttggtacaggcccgggggggtcctggagactctcctgtgcagcctctggacttcccctttacacatatgccagtgggctgggtccnccgaggctccgaggggaagggtctggagtgggtctcacttagttagtggtagtggtagtactanatactacgcaagactccggtaggaacgggtcccggttcaacctatcctaccgaagaacgaacaactccccaaaagaaccacgtctagtactctagacaaaagtcgaacggtcagagagcgagacacgctatntatgacgccgtaggtacgtttacatagatatagtagtaaacgaaaaggtactagttagaacgtaggtcgggacgaacggacctcggtacaccgtctcctcgacncctacccacgaaccggccacgtccgtcctcccgngacccgccgtcgccgtccgaggacgccacccgtaccgaacgtaaccacgacggcccgtccggtcggtaccg

SEQ ID NO: 47953 - DNA, 617 bp, Homo sapiens
  misc_feature: GYAE6OF01BOMX9.16.28.C06.1.454.CMB.1.raw
tcagtgtactactccacgaccggtgctcgatttagagctcacgtattgggtttgggctgagttggctttttcttgtggctatttttaaaaggtgtccagtgtgaggtgcaactgttggagtctgggggagccttggtacagccgggggggtccctgagactctcctgtgcagcctctggattcccctttacacatatgccatgggctgggtccgccaggctccagggagggctggagtgggtctcacttattagtggtagtggtagtactacatactacgcagactccgtgaagggccgttcaccatctccagagacaatcccaagaacacgctgtatctgacaaatgaacggcctgagagccgaggacacggccgtaatattactgtgcccggagggtacggttttactagtgtatattacgtaggttaaactaaaaaagggttacttaactttagaacttacgtcggggccgaacgggaaccctggtccaccgtctcctcacgccctccaccgaacgggcccacgtccggtcccttcccccgtcggtcccgcccgtcgcctcccgaggacgccacccgtccgaacgaaccacgacgcccgggcccgtcgggtccg

SEQ ID NO: 47954 - DNA, 638 bp, Homo sapiens
  misc_feature: GYAE6OF01BSH89.16.28.C06.1.454.CMB.1.raw
  modified_base (392)..(392): a, c, t, g, unknown or other
  misc_feature (392)..(392): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattccccctttacacatatgccatgggctgggtccgccaggctccgaggggaaggggctgggagtgggtctcacttattagtggtagtggtagtactacatactacgcagactccgtgaacgggccgttcaccatctccagagacaatcccaagaacacgctgtatctgacaaatgaaccggcctagacgagccgaggacacggctatattacngtcgcccgagggtagtttacatgatattacgtaggttaactaaaaagggttacttaacgtttagaacttacggtcggggaccgtaacgggacccgtggtccacccggtctccctcacgcccaccaccgaacggccctacgttccggtcccttcccccgtcggcccgtccccgtcgtcccgtccgacgggacgtcccacccgtacccgaacgtaaccgaccgaccggcccggccccggtgggtcccg

SEQ ID NO: 47955 - DNA, 682 bp, Homo sapiens
  misc_feature: GYAE6OF01DQV13.16.28.C06.1.454.CMB.1.raw
  modified_base (318)..(318): a, c, t, g, unknown or other
  misc_feature (318)..(318): n is a, c, g, or t
  modified_base (390)..(390): a, c, t, g, unknown or other
  misc_feature (390)..(390): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccggggggtccctgagactctcctgtgcagcctctggacttccccctttaccacatatgccatgggctgggtccgccaggctccgagggagggctggagtggtctcacttagttagtggtagtggtatactacatactacgcagactccgtgaacgggccgttcaccatctccaganacaactcccaagaaccacgctgtatctgacaaatcgaacgctagacgacgccgagacacggcctatattacngtcgccggtaggtagttttacagtgtattaacttacgttaggttaaacgtaaaaaagggttacttaactttagaaccttaacggtacggggacccgtaacgggtaacccgtggttaccctacccgtcttccctacgacgtccctacccgaacccgtaacgggacccctacgttcccggttcccttcccccgtcggtacccgtccccgtcgtacccgtcccgagggaccgcccgtacccgtacccggaaaccgaaacccgaacccgaccggccccgggtcccgtcgggtcccg

SEQ ID NO: 47956 - DNA, 718 bp, Homo sapiens
  misc_feature: GYAE6OF01D5JAJ.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccggggggtccctgagactctcctgtgcagcctctggacttcccctttacacatatgccatgggctgggtccgccaggctccgagggaagggctggagtgggtctcactttattagtggtagtggtagtactacatactacgcagactcgtgaacgggccgttcaccatcctccagacgacaactcccaagaaccacgctgtatctagacaaatcgaacggcctaggacgacgccgaaggaccacggtacctatacgttacgtcgtcgacccggtaagggttacgttttacagttagtattacgttacgtaacggttaaacgtaaaaacgggttacttaacgtttacgtaaccgttaaccggtacggggacccgtaacgggtaaccccgttcggtacccgtacccgttcctacccgtacgtaccgtacccgtacccgaacccgtaaccgggtacccctacgttcccggttacccccgttccccgtcggcccgtcccgtcgtacccgtcccgagggaccgtacccgacccgtacccgaacgtaaccgaccgtacggacccggtcccggtcgggtcccg

SEQ ID NO: 47957 - DNA, 704 bp, Homo sapiens
  misc_feature: GYAE6OF01BWI8W.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggagggctggagtgggtctcacttattagtggtagtggtagtactacatactacgcagactccgtgaaggccggttcacatctcagagacaactcccaagaaccacgctgtatctgacaaatgaacgctgagagccgagacacggcctatattactgtcgcccggtagggtaggttttacagtcgtattaagtttacgttagggttaaacgtaaaaacgggttacttaacgtttacgaaccgttaacggtcgggggacccgtaacggggtaaccccgtgggtaccctacccgttccgtaccctcgaccgtacccgttacccaacccgtaaccgggacccctaacggttcccgggttccccttccccccggtcgggtccccgtccccgtcggccccgttacccgagggacccgtcccaaccccgtacccgaacggaaacccacccgaacgggccccgggtccccggtcggggttaccccg

SEQ ID NO: 47958 - DNA, 589 bp, Homo sapiens
  misc_feature: GYAE6OF01DPFHY.16.28.C06.1.454.CMB.1.raw
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
  modified_base (436)..(436): a, c, t, g, unknown or other
  misc_feature (436)..(436): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggattccccctttacacatatgccatgggctgggtccgccaggctccgaggggaaggggctgggagtgggtctcactttattagtggtagtggtagtactacatactacgcagactccgtgaagggccggttcaccatctccagagacaatcccaagaacncgctgtatttgacaaatgaacagtcngagngtcgaggacacggcaatatattacngtgcgaagcgggaattggtggcggtgactgctattgactacgngggccagggaccctggtcaccgtctcctcacgccctaccaccaacggggccctacgtccggttcccttcccccgtggccctacccctcctacccgaacgacgcctaccgtcggtcggggccacgcggaccggcccgtcgggcctggtacccgg

SEQ ID NO: 47959 - DNA, 754 bp, Homo sapiens
  misc_feature: GYAE6OF01DE3OD.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggacttcccctttaccacatatgccagtgggctgggtccgccaggctccgaggggaaggggctgggagtgggtctctacttagttagtggtagtggtagtactacatacacgcagactccggtagaagggtcccggttcaaccatcctaccgaggaacgaaccaaactaccccaaaagaaaccacgtcctagttaactcctagacctaaaagtcggaaacggtcctaggaacggacggaccggaaggaccgacggtaccgttaatacttacgtggtacggacccggtaggggttagtttttacagtacgtattaatttaacgttaaggtaaacgtaaaaagggttacttaacgtttaggaaccgttacggtacggggacccgtaacgggtaacccgttcggtaccgtacccgttctccgtaccaccgtaccctacccgaacccggtaacgggacccctaacgttcccggtaccccgttccccgtcggcccgtccccgtcgacccgtcccggagggacccgtcccgacccgtacccgaaacgaaccaaccgaccggcccgggtcccggtcgggtcccg

SEQ ID NO: 47960 - DNA, 619 bp, Homo sapiens
  misc_feature: GYAE6OF01AT8EJ.16.28.C06.1.454.CMB.1.raw
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (390)..(390): a, c, t, g, unknown or other
  misc_feature (390)..(390): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccgttnaccatctccagagacaatcccaagaacacgctgtatcngacaaagtgaacggcctgacgacgccgaggacacggcgtatatacgngtcgcccgagggtagtttacatagtatattacgtagttaacgaaaaagggtacttaacgtttagaactacgtcgggaccgagggtaacccgtcggtccgtaccgtctcctcgacgccctacccaccgaaccgggccctacgtccggtaccttcccccgtcggcccgtccctcgccgtccgacggacgccacccgtaccgaacgaaccacacgccggcccgtcgggcccg

SEQ ID NO: 47961 - DNA, 660 bp, Homo sapiens
  misc_feature: GYAE6OF01E5BHZ.16.28.C06.1.454.CMB.1.raw
  modified_base (538)..(538): a, c, t, g, unknown or other
  misc_feature (538)..(538): n is a, c, g, or t
  modified_base (548)..(548): a, c, t, g, unknown or other
  misc_feature (548)..(548): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctggggggagccttgggtacaggccgggggggtccctgagactctcctgtgcagcctctggacttcccctttaccacatatgccagtgggctgggtccgccaggctccgaggggagggctggagtgggtctcactttagttaggtggtagtggtagtactacatactacgcagactccgtagaagggccgttacaccatctcagacgacaactacccaaagaacacgctagtactctagacaaagtcgaacggcctaggaacggacgccggaaggaccacggtaccttaatacttacgtggtacggtaccccggtaggggttacgttttactatagtaatagttaacgttaaggtaaacgtaaaaggttacttacttagacgttacggacgggacgacggtacccgtgtccaccgtcncctcacgccnccgaaccgacggccctacgtcccggttaccctcccgcggcctcccgtcgtacccgtcgacggacgtcccaccgtaccgacgaaccaccggacggcccggtccgtcgggtccg

SEQ ID NO: 47962 - DNA, 685 bp, Homo sapiens
  misc_feature: GYAE6OF01BQI8G.16.28.C06.1.454.CMB.1.raw
  modified_base (401)..(401): a, c, t, g, unknown or other
  misc_feature (401)..(401): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggacttcccctttaccacatatgccatgggctgggtccgccaggctccgaggggacggggctggagtgggtctcacttattagtggtagtggttagtactacatactacgcagactccgtggaacgggccgttcaccatctccagacgacaactcccaaagacacgctgtactctgacaaatcgaaacggcctggacgacgccgaggacacggctatattacgngtacgccggtagggttacgtttacagtgtaatagtttacgtaagggttaaacgtaaaaacgggttaacttaacgtttacggtaacgttaccggtcggggtaccgtaacgggtaaacccgtcggtaccgtacccgttcctcccgtacacgcccttacccgaaccgtaaccggccctacgtcccggtcccttccccgtcggcccgtcccgtcgcccgtccggacggtaccgacccgacccgttacccgaacgtaaccgaccgaccggcccggcccgtcgggacccg

SEQ ID NO: 47963 - DNA, 806 bp, Homo sapiens
  misc_feature: GYAE6OF01BHIBQ.16.28.C06.1.454.CMB.1.raw
  modified_base (278)..(278): a, c, t, g, unknown or other
  misc_feature (278)..(278): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggattcccctttacacatatgccagtgggctgggtccgccaggcctccgaggggagggctgggagtgggtctctacttattagtggtagtggtagtactanatactacgcagtactccggtaggaacgggtcccgttacacctattcctaccaggagaaccaactccccaaagaaccacgtctagtatctagacctaaaagtcggaaaccggtcctaggaacggacggaccggaaggaccgaccgggtaccttaattaacgttacgtcggtaccggacccggggtaagggttacgtttttaacagttacgtaattagtttaacggttaagggttaaacgtaaaaaggggtttaccttaacgtttacgaaccgttacggtacggggtacccgtaacgggtaacccgttcgggtacccgtacccgttcccgtccttaccgaccgtccccgtacccaacccgggtaaccgggtccccttaacgttccccgggttccccttaccccccggtgggtccccctaccccggtcggtcccgtacccgggtaaccgggaccgtccccgtaacccgtacccgggaaaccgtaacccgtaacccggacccgggaccccgggtcccgggtcggggtccccg

SEQ ID NO: 47964 - DNA, 645 bp, Homo sapiens
  misc_feature: GYAE6OF01DK1OZ.16.28.C06.1.454.CMB.1.raw
  modified_base (214)..(214): a, c, t, g, unknown or other
  misc_feature (214)..(214): n is a, c, g, or t
  modified_base (597)..(597): a, c, t, g, unknown or other
  misc_feature (597)..(597): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggattcccctttacacatatgccatgggctgggtccnccaggctccaggggaagggctggagtgggtctcactttattagtggtagtggtagtactacatactacgcagactccgtgaagggccggttcaccatctccagagacaatcccaagaacaccgctgtatctgacaaatcgaacggcctgaagcgccgaggacacggccgttatattactggtcgcccggtagggtagttttactagtgtattaattacgttaagggttaacgtaaaaagggtacttaacgtttagtacgtacgtcggggtaccgacgggtacccgtaggtccaccgtcctcctcgacgccgtacccaccgtaacgggccccacgttccggttcccttcccccgtcggccgtccccgtcgccgtccgacggacncccgacccgtaccgacgtaaaccaccgacggccggcccgtgggtcccg

SEQ ID NO: 47965 - DNA, 729 bp, Homo sapiens
  misc_feature: GYAE6OF01D599R.16.28.C06.1.454.CMB.1.raw
  modified_base (666)..(666): a, c, t, g, unknown or other
  misc_feature (666)..(666): n is a, c, g, or t
tcagtgtactactccacgaccggtgctcgatttagagctcacgtattgggtttgggctgagttggctttttcttgtggctatttttaaaaggtgtccagtgtgaggtgcaactgttggagtctgggggagccttggtacaggccggggggtccctgagactctcctgtgcagcctctggacttcccctttaccacatatgccagtgggctgggtccgccaggctccgagggagggctggagtgggtctcacttattagtggtagtggtagtactacatactacgcagacctccgtaggaacgggtccgttcacctatcctcaggacgacaactccccgaaagaaccacgtctgtactcgtagactaaaagtcggaaccggctaggaacgacggcccggtaagggacccgaacggcccgttaaattaccgttacgcgggtaccggacccggttaggggttaacgttttaactagttacgtaagttaacgtttaacgttacggttaaacgtaaaaacgggttacttacgtttagtacgttaccggtcgggaccgtaacgggacccgtggtacctaccgtcctcctcgacgtaccctccgaaccgtaccggccctacgtcccgtacccttccccgtcggtcccgtcccgtagcccgtaccgacggtacnccccgtacccggtacccgaaaccgaacctaaccgaccggtaccccggcccgttcgggtacccg

SEQ ID NO: 47966 - DNA, 711 bp, Homo sapiens
  misc_feature: GYAE6OF01CVZFW.16.28.C06.1.454.CMB.1.raw
  modified_base (366)..(366): a, c, t, g, unknown or other
  misc_feature (366)..(366): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctggggggagccttggtacaggccgggggggtccctgagacctctcctgtgcagccctcgtggtacttccccctttacacatatgccagtgggctgggtccgccaggcctccgaggggaaggggctgggaggtgggtctcgtaactttagttaggtggtagttggtagtactacatactacgcaacgactccggtaggaacgggccgttacaccgatcctaccagacgaacaactacccaagaacncgtctagtatcagacaaagtcgaacggcctaggacgacgcggaaggacaccggtactaattacttacgtgtcggaccggtaggggttagtttacatgtattagttacgttaaggtaaaacgtaaaaggttactttaacgttacgaacgttacggtacgggccgtaacgggtacccgtaggtacccgaccgttctacccgtcgaccgtccctaacccggaccgtaaccggcccctacgttccccggttcccttaccccggtcggaccccgtcccgtcggccgtaccgaggaccgcccgaccctaccggaacgaaccaccgaccggtacccggcccggtcgggtccg

SEQ ID NO: 47967 - DNA, 688 bp, Homo sapiens
  misc_feature: GYAE6OF01ENJ94.16.28.C06.1.454.CMB.1.raw
  modified_base (343)..(343): a, c, t, g, unknown or other
  misc_feature (343)..(343): n is a, c, g, or t
  modified_base (401)..(401): a, c, t, g, unknown or other
  misc_feature (401)..(401): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctggggggagccttggtacaggccgggggggtccctgagactctcctgtgcagcctctggacttcccctttaccacatatgccatgggctgggtccgccaggctccgaggggagggctggagtgggtctctacttatagtggtagtggtatactacatactacgcagactccggaggaacgggcccgttcaccatcctccagacgacaactcccaaagaaccncgctgtatctgacaaagtgaacgcctaggacgacgccgaggacacggtctatattcgngtcgccggtaggtagttttacagttgtattattacgttaggttaaacgtaaaaagggttacttaacgtttacgtaacgttacggtcggggaccgtaacgggtaacccgtcggtacctaccgtcctcctccacgccctacccgaaccgaccgggtaccctacgtcccggttcccgttcccccgtcggtccccgtccccgtccggtcccgtcccgacgggaccgacccgtaccccgtacccggaaccgtaaacccgaccgaaccggcccgggtccccgtcggggtcccg

SEQ ID NO: 47968 - DNA, 724 bp, Homo sapiens
  misc_feature: GYAE6OF01EFRSJ.16.28.C06.1.454.CMB.1.raw
  modified_base (428)..(428): a, c, t, g, unknown or other
  misc_feature (428)..(428): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggacttccccctttaccacatatgccatgggctgggtccgccaggctccgaggggagggctggagtgggtctctacttattagtggtagtggtagtactacatacctacgcagtacctccgtaggaacgggtcccgttacaccatcctaccagaacgaccaactccccgaaagaaccacgtctagtactctagacaaatcggaaccggtctaggacgacggaccgaaggaccaccggcttaatacgttacnggtcgaccggtagggttacgtttacagtgtattacttaacgtaacgttaaacgtaaaaacggttacttaacgtttacgtaacgttaccggtcggggtaacccgaaccgggtaacccgttggtaccctacccgttcctaccgtaccgaccgacccctacccgaacccgtaccggacccctacgttcccgttcccgttcccccgtacggtcccgtcccgtcgaccgttcccgagggaccacccgtaacccgtacccggaaacaacccgtaacgaccggacccggtcccggtgggcccg

SEQ ID NO: 47969 - DNA, 896 bp, Homo sapiens
  misc_feature: GYAE6OF01CE0US.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtcgtgggggagccttggtacgaggcccgggggggtccctgagacctctcctgtcgcacgcctcgtggtactttaccccctttacactatatcgaccagtcgggcgttcgggtcccgaccgacggccgtaccggaagggggtaacggggcgtagggtacgggtcgggttacttaccgtaacgtttagttaagggtgggttaagtcggttaacgttactacgtaagttaaccgtaccgacctaacgtaccgttaccgggtagggaaaccggggtccccgtttaccaacccaacgttcccgtaccgaaggaaccgtaaaaccctaaccgttaccccgaaaagaaccgaaccgttcgttaacgtacctttacgacgtaaaccgtaaacgtccggaaaccggtcgtaacggaacggacggaccggaacggaaccgtccggtaccgttaagttaaccgttacggtacggtaccggtacccgggtaagggtttaccgttttaaacgacgttagtaagttaccgtttaacggttaacggttaaacggtaaaacgtttacgtttaacgttacggtaaccgtacgggtaccgggaccgtaaccggtacgtccgtaccgtaccgtcctacccgtacgaccgtacccgtacccgacccgtaaccggtcccgtaccgttcccggttccccgtcccgttaccgcccgtcccgtactccccggaccgtacgaccgtacccgacccgtaacgaaccgaccgacccggtaggccccggtccggtcggtacccgg

SEQ ID NO: 47970 - DNA, 692 bp, Homo sapiens
  misc_feature: GYAE6OF01CHFBJ.16.28.C06.1.454.CMB.1.raw
  modified_base (614)..(614): a, c, t, g, unknown or other
  misc_feature (614)..(614): n is a, c, g, or t
tcagtgtactactccacgaccggtgctcgatttagagctcacgtattgggtttgggctgagttggctttttcttgtggctattttaaaaaggtgtccagtgtgaggtgcaactgttggagtctgggggagccttggtacaggccgggggggtccctgagactctcctgtgcagcctctggactttcccctttacacatatgccagtgggcgtcggggtccgccgaggctccgaagggggaaggggctgggaggttgggtctcgtacttagttagtggtaggtggtagtactacatactacgcagactccggtagaacgggtcccgttcaccatctcagacacaactacccaagaacacgctagtatctgactaaagcggaacgctgaagacgccggaggacgacggacgtattattacgtggtaccgaccggtagggttacgttttacgtatggtaactttaagtttaacgtaaggttaaaacgtaaaaagggttcttaacgtttacggaactacggtcggggacctaacggggaccctggtacctaccgtccttccacgacgtaccctaccgaaccggacggtaccctacgttccggttaccccgttccccgnggtcccgcccgtcgaccgtccgaagggcacccgacccgtaccgaacgtaacccgacgccggcccggccggtggtcccg

SEQ ID NO: 47971 - DNA, 682 bp, Homo sapiens
  misc_feature: GYAE6OF01ENU0C.16.28.C06.1.454.CMB.1.raw
  modified_base (213)..(213): a, c, t, g, unknown or other
  misc_feature (213)..(213): n is a, c, g, or t
  modified_base (331)..(331): a, c, t, g, unknown or other
  misc_feature (331)..(331): n is a, c, g, or t
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
tcagtgtactactccacgaccggtgctcgatttagagctcacgtattgggtttgggctgagttggctttttcttgtggctattttaaaggtgtccagtgtgaggtgcaactgttggagtctgggggagccttggtacagccggggggtccctgagactctctgtgcagcctctggatttcccctttacacagtatgccatcgggctgggtccnccaggctaccgagggaacgggctggagttggggtctacgtactttagttaggtggtagtggtacgttactaactattactacgcagacgtccggtgaacgggtccggttcaccagtcnccgaagagacaaatcccaagacacgctagtactctgcaaactgaaccggctagagacgccgaggacctacgcgtataacgtntgtcggaccgtagggtacttttaacgntgtagtattaacgttacgtaaactaaaagggtacttaacgttgtacctacgtacgggtaccaacgggtaacctggtccgaacgttccgtccgtaacacgtacctccccgtaaccaaacggggccctaccgtcgttccccgttaccccgtcgtcccgtacccctccgtacccgtacgacggacccgccttaacccggtccggtaccgaaccgtaccggaccgtcccggtacggtcgtaaccgg

SEQ ID NO: 47972 - DNA, 573 bp, Homo sapiens
  misc_feature: GYAE6OF01EXLKM.16.28.C06.1.454.CMB.1.raw
  modified_base (304)..(304): a, c, t, g, unknown or other
  misc_feature (304)..(304): n is a, c, g, or t
  modified_base (382)..(382): a, c, t, g, unknown or other
  misc_feature (382)..(382): n is a, c, g, or t
  modified_base (508)..(508): a, c, t, g, unknown or other
  misc_feature (508)..(508): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccggggggtccctgagactctcctgtgcagcctctggattcccctttacacatatgccatgggctgggtccgccaggctccaggggaaggggctggagtgggtctcacttattagtggtagtggtagtactacatactacgcagactccgtgaagggccgttnaccatctcagagacaatcccaagacacgctgtatctgcaaatgaacggcctagagagccgaggacacggctatatacngtcgccgtagggtgttttacatgatattactggtaacaaaagggttctacttgactacgtggggccagggacctggtccacgtctctcacgcctccacgaacgggcccagtccggtccttccccgnggcccgtccctgccgtccgagggactccaccgtacgaacgtaaccacacggccgcccgtggggcc

SEQ ID NO: 47973 - DNA, 1002 bp, Homo sapiens
  misc_feature: GYAE6OF01DB7VL.16.28.C06.1.454.CMB.1.raw
  modified_base (184)..(184): a, c, t, g, unknown or other
  misc_feature (184)..(184): n is a, c, g, or t
  modified_base (404)..(404): a, c, t, g, unknown or other
  misc_feature (404)..(404): n is a, c, g, or t
tcagtgtactactccacgaccggtgctcgatttagagctcacgtattgggtttgggctgagttggtctttttcttgtggctaattttaaaaggtgtccagtgtgaggtgcaactgttggagtcgtgggggactccgttggtaccgacgggcccgggggggtccctggagaccttcctcctgtcncacgtcctcgtcggtacctttccccttaaccactatatcgcctagtcgggcgtcgggcccgccgacggtccgtaccggaggggaacgggcgtagggtaggtcgggtctactagtttagtaggtggtaggttaggtactaacctcgtaacttaaccaccggactaacgtaccggttaccggttacgggaaccgggttccccgtacaacccgtcttaacccnccgaagaaccgaactaacctaaccccgaaaacggtaaccaccggtcttacgttaacgttaccaaggtaaaccctaaaggtaccggaaccgggcctaggaccggacgtaaccgggaacgaacccgggtaccggtactttaacgtttagtttaccgtacgggttacccggtacccggggtttaaaggggtttttacgtttaaccgtttaagtaaggtttaacgttttaaccggttaaaacggttttaacgggttaaaaaaccggttttaaaaacggtttacccttttaaacgggtttaccggttaaacggtaccgggtaccgggggtaaaccccggtaccggggtaaaccccgtttcgggtttaacccgtacccccgtttacgtttaccccgaaccccgttaacccgtccccccggttaacccgtaaccccggggtaaacccccgggtccccgttttaaaccccggtttccccggttcccccccgtttacccggccccgggtaccccgtccccgttacgaccccggtcccggaaacgtccccgtaccgtacccgtaaccggacgtacccgacggtcccgacccgggtccgtcgggtcccg

SEQ ID NO: 47974 - DNA, 596 bp, Homo sapiens
  misc_feature: GYAE6OF01A8OHE.16.28.C06.1.454.CMB.1.raw
  modified_base (414)..(414): a, c, t, g, unknown or other
  misc_feature (414)..(414): n is a, c, g, or t
  modified_base (533)..(533): a, c, t, g, unknown or other
  misc_feature (533)..(533): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggcctccagggaaggggctgggagtgggtctcacttattagtggtagtggtagtactacatactacgcagactccgtgaagggccgttcaccatctccagagacaatcccaaagaaccacgctgtatctgacaaatgaacggcctgagagccgaggacacggcgtaatattactgtgcccggaagggtagttttaacngtagtatattacgtaggttaacgaaaaagggttactaatttgactacgtggggaccacgggaccctggtccaccgtctcctcacgtcctcccgaccgacggcccactcgtcccttcccnggccgccctgcctccgagacgccacccgtccgacgaaccacacggcccggtcccgtgggtccg

SEQ ID NO: 47975 - DNA, 638 bp, Homo sapiens
  misc_feature: GYAE6OF01DCW1V.16.28.C06.1.454.CMB.1.raw
  modified_base (387)..(387): a, c, t, g, unknown or other
  misc_feature (387)..(387): n is a, c, g, or t
  modified_base (584)..(584): a, c, t, g, unknown or other
  misc_feature (584)..(584): n is a, c, g, or t
tcagtgtactactccacgaccggtgctcgatttagagctcacgtattgggtttgggctgagttggctttttcttgtggctattttaaaaggtgtccagtgtgaggtgcaactgttggagtcgtgggggagcctttggtacaggccgggggggtccctgagactctcctgtgcagcctctggacttcccctttacacatatgccagtgggctgggtccgccaggctcgagggaaggggctggagtgggtctctacttattagtggtagtggtagtactacatactacgcagactccgtgaaggccgttcaccatcctcagagacaactcccaagaacacgctagtatctagacaaagtcgaacgctagagacgccgaggacacgctanattactgtcgccggaggtacgttttcagttcgattattacgtaggttaaagaaaacggtacttaagtttagacgtacgtcgggtaccgacgggtaaccctcggtaccacgttcctcctacgacgccctacccgaccgtacggccctactccggttccttaccccgtggtccgtccctagcccgtaccgacgggaccnccgtaccccgaccggtaacaaccggaccgacggtcccggcccgtcgggtacccg

SEQ ID NO: 47976 - DNA, 712 bp, Homo sapiens
  misc_feature: GYAE6OF01EYQP1.16.28.C06.1.454.CMB.1.raw
  modified_base (215)..(215): a, c, t, g, unknown or other
  misc_feature (215)..(215): n is a, c, g, or t
  modified_base (426)..(426): a, c, t, g, unknown or other
  misc_feature (426)..(426): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggcccgggggggtccctgagactctcctgtgcagcctctggattcccctttacacatatgccatgggctgggtccnccaggctccgagggaagggctggagtggtctcacttagttagtggtagtggtagtactacatactacgcagactccgtgaacgggccgttacacatcctccaagacgacaactcccaagaccacgctagtatctagactaaagtcgaacgctagagacgcgaagacgacggtctatacttacgtgtacgacccgaagggttcgttttaacngttagtaatatttaacgtacggttaaacgaaaaacgggttacttaacgtttacgtaacttaacggtcggggtaaccgtaaccggggtaacccttcggtaccgtacccgttcgtacccctacgtaccgaccccgttacccgaacccgtaacgggtacccctaagttcccggttaccccttacccccggtcggtccctacccggtcgtacccgtccggaacggaccgtacccgtacccgtacccgaacgtaaacccacggaaccggccccggtcccgtcgggtacccg

SEQ ID NO: 47977 - DNA, 699 bp, Homo sapiens
  misc_feature: GYAE6OF01AXMC2.16.28.C06.1.454.CMB.1.raw
  modified_base (342)..(342): a, c, t, g, unknown or other
  misc_feature (342)..(342): n is a, c, g, or t
  modified_base (407)..(407): a, c, t, g, unknown or other
  misc_feature (407)..(407): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggacttcccctttacacatatgccagtgggctcgggtccgccaggcctccgaggggaagggctggagtgggtctcactttattaggtggtagtggtagtactacatacctacgcagactccggtagaacgggccgttcaccatcctcagagacaactccaagacncgtctagatctagacaaagtgaaccgctaggagacgccggagacgacggtaccgtatacttacgnggtcggacccggtaaggggtttacgttttaaccagtacgtaatttaacgtttaacgttaagggttaaaccgtaaaaagggttacttaacgtttagtaaccgtacggtcggggtaccgtaacgggtacccgttggtacctacccgttcctcccgtacgtaccgtccctacccgaccgtaaccggcccgtacgtcccggtaccccttcccgtccggccgtcccgtcgcccgttccgagaccgtccacccgtaccgtaacgaaaccgccgacggcccggtcccggtgggtacccg

SEQ ID NO: 47978 - DNA, 770 bp, Homo sapiens
  misc_feature: GYAE6OF01A48AI.16.28.C06.1.454.CMB.1.raw
  modified_base (216)..(216): a, c, t, g, unknown or other
  misc_feature (216)..(216): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccggggggtccctgagactctcctgtgcagcctctggacttcccctttaccacatatgccagtgggctgggtccnccaggctccgagggaagggctggagtgggtctcactttattagtggtagtggtagtactacatactacgcagtacctccgtaggaacgggtcccggttcaacctattccctaccgaagaacgaccaaactacccaaagaaccacggctagtatctagacctaaatcgaacggtcctaggacgacggccggtaaggaccgtacggtaccgttaattacgttacgtggtaccggacccggtaggggttacggttttacagttagtattaacgtttaacgttaggttaaacgtaaaagggttaccttacgtttacgtaacgtcggtacggggtaccgaaccgggtacccgttacggtacctacccgttcctacccgtcgacccgtccctaccgaacccggtaaccggccccttacgttcccggttccccgtcccccgttaccggtcccgtaccccgttcgtaccccgtaccggtaacggacccgtaccctaacccggtacccggtaaaccgaacccaacccgggaccggtaccccgggtccgggttacgggtcccgg

SEQ ID NO: 47979 - DNA, 711 bp, Homo sapiens
  misc_feature: GYAE6OF01ANSO7.16.28.C06.1.454.CMB.1.raw
  modified_base (655)..(655): a, c, t, g, unknown or other
  misc_feature (655)..(655): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggacttcccctttaccacatactgccatgggctgggtccgccaggctccgagggaaggggctggagtgggtctcacttatagtggtagtggtagtactacatactacgcagactccgtgaagggtccggttcaccatcctccagacgaacaactcccaaagaaccacgctgtatctgccaaatggaaccggcctgagacggccgaggaccacggccgtaatacttactggtacgtcccggagggttacgttttactagtagtattaacgttacgttaggttaaaacgtaaaaacggggttaacttaacgtttaggtaaccttacggtacggggaccgtaaccggggaacccgttcggtaccgtaacccgtcctcccgtacgaccgtaccccttccccgaacccgtaaccgggcccctaagttccccggttacccttcccccgtcgggcccgtccccgtcgtcccgtacccgacgggacncccgacccgacccgggaacgaaacccgacgaccgggcccggcccgtcggggtcccg

SEQ ID NO: 47980 - DNA, 829 bp, Homo sapiens
  misc_feature: GYAE6OF01DTMEI.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtcgtgggggagccttggtacaggccgggggggtccctgagactctcctgtgcagcctctggtacttccccctttacacatatgccagtgggctgggtcccgccaggctccgaggggaagggctgggagtgggtctcatttattaggtggtagtggtagtactacatactacgcagactccggtaggaacgggtcccgttcaccatcctaccagacgaacaactcccaaagaccacgctagtatctagacaaaagtcggaaccggcctaggaacggacggacccgggaagggaaccaaccggggtaccgtttaaattaacgtttaccgtgggttaccggaccccggggtaagggggtttaacggtttttttaaccaaggttagtaagtttaacgtttaacggttaacgggtttaaaacggtaaaaaaacgggtttacctttaaacgttttacgtaaaccgttacgggtaccgggggtaaccgtaaccggggtaaaccccgttcgggttacctaccccggttcccttacccgtaccgtaccgtacccctaccccgaacccggtaacccgggtacccctacgtttcccggttccccgtttacccccggtcgggtaccccgtccccgtcggtacccgtcccggaaggtaccgacccgtaaccccgtaccgaaaccgtaaccgaccgaccgggtcccggcccgggtcggtcccgg

SEQ ID NO: 47981 - DNA, 799 bp, Homo sapiens
  misc_feature: GYAE6OF01A65Q2.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggacttcccctttacacatatgccagtgggctgggtccgccaggctcgaggggaagggctggagtgggtctctactttagttaggtggtagtggtagtactacatactacgcagacctcggtaggaacggggtccgtacacctatcctccgaagacgaaccaactaccccgaaaagaaccacggtcttagtaactcgtagaactaaagtcggaaaccggcgtaggaacgacggaccggtaacggaaccgaccgggtaccgttaattagttaccgtcggtaccggacccgggtaggggttaacgttttacctagtagtaactttaacgttaacgttaacggttaaaacgtaaaaacgggttacttaacgttacgtaacgtacgggtacgggaccgtaaccgggtacccgttacgggtaccctacccgttccgtacccgtacgaccgtaccccgtaacccggaacccggtaacccgggacccgttacggttacccggttccccgttaccccggtccgggtcccgtacccctcggcccgtaccggtacgggacccgtaccctaccccggtaaccgaaccgaacccgtaccggaacccgggtcccggccccggttcgggtacccgg

SEQ ID NO: 47982 - DNA, 699 bp, Homo sapiens
  misc_feature: GYAE6OF01DZFYH.16.28.C06.1.454.CMB.1.raw
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
tcagtgtactactccacgaccggtgctcgatttagagctcacgtattgggtttgggctgagttggctttttcttgtggctattttaaaaaggtgtccagtgtgaggtgcaactgttggagtctgggggagccttggtacaggccgggggggtccctgagactctcctgtgcagcctctggacttcccctttaccacatatgccatgggctgggtccgcaggctccgagggaaggggctggagtgggtctcactttatagtggtagtggtagtactanatactacgnagactccgtgaagggccggttcaccatctccagagacaactcccaagaacacgctgtatctagacaaatgaaaccggctggaacgacgccgaggacacgggtccgtattattactgtcgcccggagggtagttttactagtgtaattacttacgttaggttaaacgtaaaaacgggttacttaacgtttagaactaccgtacggggccgaacgggtaacccgtggtacctaccgtccttccctacgaccgtccctacccgaacccgaaccgggtcccaacgttcccggttacccttcccccgtaccgggcccgtccccgttcggcccgttacccgagggaccgtcccgaccccgttacccggaaccgtaaaccgtaaccgaccgggcccgggtcccccggtggggttaccccg

SEQ ID NO: 47983 - DNA, 784 bp, Homo sapiens
  misc_feature: GYAE6OF01ED5ZU.16.28.C06.1.454.CMB.1.raw
  modified_base (260)..(260): a, c, t, g, unknown or other
  misc_feature (260)..(260): n is a, c, g, or t
  modified_base (370)..(370): a, c, t, g, unknown or other
  misc_feature (370)..(370): n is a, c, g, or t
tcagtgtactactccacgaccggtgctcgatttagagctcacgtattgggtttgggctgagttggctttttcttgtggcttattttaaaaggtgtccagtgtgaggtgcaactgttggagtcgtgggggagtccttggtaccaggcccgggggggtccctgagactctcctgtgcagcctctggtactttcccctttaccacatatcgccagtgggctcgggcccgcgaggctaccgaggggagggcgtggagtggtctnacttattaggtggtagtggtagtactacataccgtacgcaagtaccgttccggaggaacgggtcccgttacacctactccgccaagacgaactaccacccgaaagaaccncgtctgttactcgtagaacaaagttcggaaccggctaggacggaccgccggaaggaccgacggtccttaattacgttccgtggtaccgacccgggttagggtttacgtttttacagtagttaagttaacgtttacgttaaacggttaaacgtaaaaggttacctttaagttacgtacgtacggtacgggacccggtaaccgggttacccgtaggttacccgtaccgttccttacctaccgacccgtacccgtaacccgtacccggtaaccggtaccccttaccgggttccccggttaccccgttccccggccggcccgtccccgtaccggtccgtacccgtacgggacccacccgggtacccgtacccgaacgtaaccgaccggtacccggcccgggttcccggtcgggtcccg

SEQ ID NO: 47984 - DNA, 784 bp, Homo sapiens
  misc_feature: GYAE6OF01DBX4N.16.28.C06.1.454.CMB.1.raw
  modified_base (288)..(288): a, c, t, g, unknown or other
  misc_feature (288)..(288): n is a, c, g, or t
  modified_base (376)..(376): a, c, t, g, unknown or other
  misc_feature (376)..(376): n is a, c, g, or t
tcagtgtactactccacgaccggtgctcgatttagagctcacgtattgggtttgggctgagttggctttttcttgtggctattttaaaaggtgtccagtgtgaggtgcaactgttggagtcgtggggggagccgttggtacaggcccgggggggtcctgagactctcctgtgcagcctctggtacttccccttacacatatgccagtgggcgtgggtccgccgaggctccgaggggaaggggctgggaggtcgggtctctacttagttaggtggtagtgtagtactanattactacgcaaggtacctccggtaggaacgggtcccgttacaacctatccctacgaagaacgaacctaacgtaccccaaagaaaccncgacgtttagtaactcgtaagaccgtaaaagtcggaaaccggtccaggaacggacggaccggtaaaggacccgacgggtactttaagtacttaccggttggacccggtaccgggtaagggttacgttttacagtacggtaattacgttaacgttaaggttaaacgtaaaaggttactttaacgttagtaaccggttacggtacggggacccaacgggtacccgtacgtccgtaccgtcctccgaccgtacgaccctacccgaccgaaccggtacccgaccgttacccgtcccgttcccccgtggcccccgtacccgtcgtaccccgtacggtaacccggaccgcccgtacccgtaacccgaaacggtacccaaccggacccggccccggtacccggtcgggtccccgg

SEQ ID NO: 47985 - DNA, 729 bp, Homo sapiens
  misc_feature: GYAE6OF01BGK4G.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggacttccccctttaccacatatgccatgggctgggtccgccaggctccgaggggaaggggctggagtgggtctcacttattagtggtagtggtagtactacatactacgcagacctccgtggaagggcccggttcaccatcctccagacgacaactccccaaagaaccacgctgtatctgacaaatggaaccggcctaggacgacgccggaggacgaccggccgtatacttacgtgtcgacccggtagggttacgttttactagttgtattaacgttacgttagggtttaaacgtaaaaagggtttacttaacgttttacggaacgttaccggtacgggggtacccgtaacggggtaaccccgttcgggtacccgtacccggtttccctcccgtaccgaccgtacccctaccccgaacccggtaaccgggcccctaacgttcccggttcccttccccccgtcggcccctacccctaccctaccgaacgaccgaccctacccgtccggtcgggggaccaccggacggcccgggtcccggtcgggccgtccgg

SEQ ID NO: 47986 - DNA, 668 bp, Homo sapiens
  misc_feature: GYAE6OF01AJZ7N.16.28.C06.1.454.CMB.1.raw
  modified_base (129)..(129): a, c, t, g, unknown or other
  misc_feature (129)..(129): n is a, c, g, or t
  modified_base (403)..(403): a, c, t, g, unknown or other
  misc_feature (403)..(403): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctggggganccttggtacaggccgggggggtccctgagactctcctgtgcagcctctggatttcccctttacacatatgccatgggctgggccgccaggctccgaggggagggctggagtgggtctcacttatagtggtagtggtagtactacatactacgcagactccgtgaagggccgttcaccatctccagagacaatcccaagaacacgctgtactctgacaaagtgaaccggctaggacgacgccggaagaccgaccggtccgttaatacgtttacgnggttacgccccgggtaaggggttacgtttttaacagtagtattacttacgtaggttaaacgtaaaaacgggttacttaacgtttagaaccttacggtacggggaccgtaacgggtaacccgtcggtaccacccgttctccctacgaccgtccctacccgaccgtaaccgggccctacgttccggtccccttaccccgtggcccgtaccctcgtcctccgaggcgccacccgtccgaacaaccacgacgcccggtccgtgggtccg

SEQ ID NO: 47987 - DNA, 652 bp, Homo sapiens
  misc_feature: GYAE6OF01CPB5V.16.28.C06.1.454.CMB.1.raw
  modified_base (562)..(562): a, c, t, g, unknown or other
  misc_feature (562)..(562): n is a, c, g, or t
  modified_base (616)..(616): a, c, t, g, unknown or other
  misc_feature (616)..(616): n is a, c, g, or t
tcagtgtactactccacgaccggtgctcgatttagagctcacgtattgggtttgggctgagttggctttttcttgtggctattttaaaaggtgtccagtgtgaggtgcaactgttgggagtctgggggagccttggtacaggccggggggggtccctgagactctcctgtgcagcctctggacttccccctttaccacatatgccagtgggctcgggtccgccaggctccgaggggaaggggctggaggtgggtctcactttagttaggtggtaggtggtagtactacataactacgcagtacctccgtaggaacggggtcccggttacaccatcctccgaagacgaacaactacccaagaaccacgctgtaactctagactaaagtcggaaccggctagaagacggaccggaaggtaccgacggtaccgtattacgttacgtgtcggaccggtaagggttagttttacagtgtattattacgtaacggttaaacgtaaaacggttacttacgttacgtaacgtcggcgggacgacggaccgtcgtaccacgtctcctcacncctaccgaccgacgcctacgtccgtcctcccgcgccgcctcgcgtccgaggacnccacctaccgacgacacgacgcccgccgtcggtccg

SEQ ID NO: 47988 - DNA, 720 bp, Homo sapiens
  misc_feature: GYAE6OF01A64SB.16.28.C06.1.454.CMB.1.raw
  modified_base (130)..(130): a, c, t, g, unknown or other
  misc_feature (130)..(130): n is a, c, g, or t
  modified_base (640)..(640): a, c, t, g, unknown or other
  misc_feature (640)..(640): n is a, c, g, or t
  modified_base (713)..(713): a, c, t, g, unknown or other
  misc_feature (713)..(713): n is a, c, g, or t
tcagtgtactactccacgaccggtgctcgatttagagctcacgtattgggtttgggctgagttggctttttcttgtggctattttaaaaggtgtccagtgtgaggtgcaactgttggagtcgtggggganccttggtacaggccggggggtcctgagactctctgtgcagcctctggtacttcccctttaccactatatcgcctagtcgggcgtcgggtcccgccgacggtctaccgaaggggggaacgggcgtagggtaggttcgggtccttacgtaacttttaagttaggttagggtaggttaggtaacgttaacgtaacaacttaccgtaacgcaacggtacttccggtacgggaacggggtcccgtttaccacctaactccgtaccgaggaacgtaaccaacctacccgtaaaggaaacctaggtcttgtaactcgtacgaataaacgtggaaccgtacgtacggacgaacggccgaacggtacgaccgtacgttagtattacggtgtaccgccgggtaaggttacgtttactagtagtattacgttaaggtagttaaacgaaaaggttctagttatacgtacggtggacgacgtaccgtcgactctctacgtcacgcctaaccgacgtaccgccncgtccgtaccctcccgtcgccgtacctcgcctagtccggactcgaaccctccgaagacctcgccggccgccgnggtcccg

SEQ ID NO: 47989 - DNA, 812 bp, Homo sapiens
  misc_feature: GYAE6OF01CHTZG.16.28.C06.1.454.CMB.1.raw
  modified_base (763)..(763): a, c, t, g, unknown or other
  misc_feature (763)..(763): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggcccgggggggtcctgagactctcctgtgcagcctctggacttcccctttaccacatatgccatgggcgtcgggtccgccaggcctccgagggggaacggggctgggaggtggggtctcgtacttagttaggtaggtagttggtagtactacatactacgcagacctcggtggaagggtccgtcaccatcctcagacgaacaactacccaagtaaccacgtcctagtaacttcagtacaaaagtcggaaccggcctaggaacggacggaccggaagggaacccacgggtacctaagttactttacggtacggttcgaccccggggttaaagggtttacggtttacctaagttagtaacgtttaagtttaaacggttaacgggtttaaaaaccggtaaaaaacggggtttactttaaaccgttttacggtaaaccgttaaccgggtaccggggtaacccggtaaccgggggtaaccccgtttaccggtacccggtaaccccggtttctaccccttaccgcggtacccccgtaccccgaacccgggtaaccgggtacccctaacggttccccgggttacccttccccggacggtccccgccgttcgtcccgtaccgacggtaccnccgaccctacccggaacaacccgacgaccggccgtcccggtcgggtccg

SEQ ID NO: 47990 - DNA, 953 bp, Homo sapiens
  misc_feature: GYAE6OF01A5ED7.16.28.C06.1.454.CMB.1.raw
  modified_base (130)..(130): a, c, t, g, unknown or other
  misc_feature (130)..(130): n is a, c, g, or t
tcagtgtactactccacgaccggtgctcgatttagagctcacgtattgggtttgggctgagttggctttttcttgtggctattttaaaaggtgtccagtgtgaggtgcaactgttggagtcgtggggganccttggtacacggcccggggggtccctgacgacctctccgtgtgcagccctcgtggtacttccccctttaccactattactcgcctagtgggccgttcggggtcccgaccgacggtccgtaccggaagggggtaacggggcgttagggtacgggttcggggttacccttaccgtacgttttagtttagggttgggttaaggttgggttaagttaaccttaacgactttaaccgtacgaccgaaggtacccgtttcccggtagggaaaccggggttccccgttaaccaacccgtacttacccgtaccgaaaggtacgaaaccaaacccgttaacccgaaaacgtaaaccgtaccgtcgttaacgtacgttaccgtgtaaacaaacggttacggaacccggtacgtacgggaacgaaccggaccggtaaccggaacggtacccgggtactttaagttaaccgtttacggtacggtcccgggtacccgggttaagggtttttaacgttttacgtaacgttacgtaagtttaacgtttaacgttaaggttaaacgtaaaacggtttacttacgttacgtaccgtacggtaccgggaccgtaaccggtacccgtcgtacccgtacgttccctaccgtccgtaccgtaccccgacccgtaacccgggtacccggtacccgttaccgttccccgggttaccccgtttcccccggaccggtccccgtacccctcccggtaccgtacccggaaccggtacccgtaccccgaccccgtaacccgaaccgtaacccgacccggaccgggtccccggtcccggtccgggtacccg

SEQ ID NO: 47991 - DNA, 908 bp, Homo sapiens
  misc_feature: GYAE6OF01BIJKO.16.28.C06.1.454.CMB.1.raw
  modified_base (441)..(441): a, c, t, g, unknown or other
  misc_feature (441)..(441): n is a, c, g, or t
tcagtgtactactccacgaccggtgctcgatttagagctcacgtattgggtttgggctgagttggcttttctgtggctatttaaaaggtgtccagtgtgaggtgcaactgttggagtcgtgggggagtccttggtacagggcccggggggtccctggagactctccgtgtgcacgtcccttcgtggtacctttccccctttaccaatatatcgaccagtcgggccgtgggtccgtcgacggtcctacggaagggggacgggcgtggtacggtcgggtctacgtaacgtttaagttaggtagggttaggtaggttaacgtacttaacgtaattaaccgtcgactaacgtaccgttccggtaggaacggggtcccgttaccaccgacttaccgtaccgaaggaacgtaaaccaaccgtaacccgaaacggaaacctaccggtnttacggttactaccgtacgaactaaaaccggtacggaccggtaccgacggaacggtaaccggaccgaaaggacccggaaaccggttaccgttaagttacgttacggtacggtaccggtacccggggttaaaggtttaccggtttaatacgtagtaacgtttaacgttaacgttaaacggttaaaacggtaaaacggtttactttaacgttaacggtaaaccggttaccgggtacggggacccgttaaaccgggtccgtaccgtccgttaaccccgtcttacccgccgtacctacccgtacccgaaaccggtaccccggttacccgtagtttaccccccggttacccggtccccgtaccggggtaccccctaccgtccgtaacccgggccctagggaaccccgccccggttacccgtaaacgaccccggtacgtacccgaccgggtcccgggccggttaccgtcccgg

SEQ ID NO: 47992 - DNA, 837 bp, Homo sapiens
  misc_feature: GYAE6OF01EWDLT.16.28.C06.1.454.CMB.1.raw
  modified_base (216)..(216): a, c, t, g, unknown or other
  misc_feature (216)..(216): n is a, c, g, or t
  modified_base (396)..(396): a, c, t, g, unknown or other
  misc_feature (396)..(396): n is a, c, g, or t
  modified_base (428)..(428): a, c, t, g, unknown or other
  misc_feature (428)..(428): n is a, c, g, or t
  modified_base (562)..(562): a, c, t, g, unknown or other
  misc_feature (562)..(562): n is a, c, g, or t
  modified_base (624)..(624): a, c, t, g, unknown or other
  misc_feature (624)..(624): n is a, c, g, or t
tcagtgtactactccacgaccggtgctcgatttagagctcacgtattgggtttgggctgagttggctttttcttgtggctatttttaaaaaggtgtccagtgtgaggtgcaactgttggagtcgtgggggagccgtttggtacaggcccgggggggtccctgagactcttcctgtgcagcctcgtggtactttacccctttaccactactattacnccagtcgggcgttcgggtcccgccgacgggtctacccgaaggggaacggggccgtaggtacggtgggttcctcgtaacgtttagtttaggtagggttaggttaggtacgttactaacgtactaaccgtaacgccgagtaccgtaccggttaggaacggggtcccttacaacccgattccnccgaaagtagaacctaacgtaacccaaaacgntaacgtacgacgtagtactacgtcgaacgtaacgtagacgtaccgacggacgacgaccggtaacgtaacgtaaccgtacgttaacgttacgttacgttacggtacggttacggtaggtttaacggttttaacgntttaagttaacgttacgttaaacgttaaacgggtttaaacgttaaaacggttaaaacggttnaacgtttaacgttacggtaaccgtacggtacccggtaccgggtaaccgtacggtaccgtaccgtaccgtaccgtacccgtaccgtaccgtacccgtacccgtaaccgtacccgtaccgtacccggtcccgttccccgacgtacccgtacccgtcggacccgtccgtaccgtaccgaccgaccgacgaccgtaccggaccggtaccggacccgg

SEQ ID NO: 47993 - DNA, 784 bp, Homo sapiens
  misc_feature: GYAE6OF01B03I4.16.28.C06.1.454.CMB.1.raw
  modified_base (128)..(128): a, c, t, g, unknown or other
  misc_feature (128)..(128): n is a, c, g, or t
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
  modified_base (390)..(390): a, c, t, g, unknown or other
  misc_feature (390)..(390): n is a, c, g, or t
tcagtgtactactccacgaccggtgctcgatttagagctcacgtattgggtttgggctgagttggctttttcttgtgctattttaaaaggtgtccagtgtgaggtgcaactgttggagtcgtgggganccttggtacagggccgggggggtcctgagactctcctgtcgcagcctctggtactttccccttacactatacgtcgccagtcgggtccgtgggtcccgcaggctaccggaaggggagggcgtaggaggttcggtactctactttagtagtggttagtggtagttacctagtactacgtaccnctaggtacctccggttagggaacgggttcccgttacaccncgttccgtccaaggacgtaaccaacttacccgaaagaacncgtctagtactccgtagaacaagtcgaaccgtctaggacgacgaccggaacggaccgtacggtacgttatacgtttaccgtcggtacggaccggtaaggtttagtttactagtacgttattacgttacgtttaaggttaaaccgtaaaacgttaccgtttaagttacgacggttaccggtacgggtacccggtaaccgggtaacccgtcgtaacccgtccgtttcccgttacctccgtaccgtacccacccgaaaccgggtaccgtaccctcgttccccggttacccgtttcccccgacggtcccgtccccgtggtaccccgtcggaccgttaccggcccttaacccggaccgacggtaaacccgcgaacccggtcccggtcccgcggttcccg

SEQ ID NO: 47994 - DNA, 764 bp, Homo sapiens
  misc_feature: GYAE6OF01CMAY0.16.28.C06.1.454.CMB.1.raw
  modified_base (372)..(372): a, c, t, g, unknown or other
  misc_feature (372)..(372): n is a, c, g, or t
tcagtgtactactccacgaccggtgctcgatttagagctcacgtattgggtttgggctgagttggctttttcttgtggctattttaaaaggtgtccagtgtgaggtgcaactgttggagtcgtgggggagccttggtacaggccgggggggtcctgagactctcctgtgcagcctctggacttcccctttacacatatgccagtgggctgggtccgccaggctcgaggggaaggggctgggagtgggtctcacttattaggtggtagtggtagtactacatactacgcaagactccgtaggaacgggtccggttcaacctatcctaccaagagaacaactacccaaagaacacgctagtatctagacaaagnggaacggcctaggagacgccgaagggactacggccgttaaatacgttactaggtcgacccggaaggggttacgttttaactagtagtaatacgtttaaacgttacgggttaaaacgtaaaaaaacggggttaacttaaccgttttaaggtaaaccgttaaccgggttacgggggacccgtaaacggggtaaacccgttacgggttaccacccggttacctccctacgaaccgtaccccgtacccgaacccgaaacgggtaccccgtaagttcccggtaccccttccccccgtcgggtaccccgccccgtccgacccgtccgaacgggacggcccaaccccgttaaccggaaccgaaaccgacgtaaccggcccgggtccccggtgggtcccg

SEQ ID NO: 47995 - DNA, 867 bp, Homo sapiens
  misc_feature: GYAE6OF01CLSK1.16.28.C06.1.454.CMB.1.raw
  modified_base (248)..(248): a, c, t, g, unknown or other
  misc_feature (248)..(248): n is a, c, g, or t
  modified_base (426)..(426): a, c, t, g, unknown or other
  misc_feature (426)..(426): n is a, c, g, or t
  modified_base (467)..(467): a, c, t, g, unknown or other
  misc_feature (467)..(467): n is a, c, g, or t
  modified_base (677)..(677): a, c, t, g, unknown or other
  misc_feature (677)..(677): n is a, c, g, or t
  modified_base (843)..(843): a, c, t, g, unknown or other
  misc_feature (843)..(843): n is a, c, g, or t
tcagtgtactactccacgaccggtgctcgatttagagctcacgtattgggtttgggctgagttggctttttcttgtggctattttaaaaggtgtcagtgtgaggtgcactgttggagtcgtgggggaagtccgtttggacagggcccggggggggttccctggacggtacctccttccgtgtgccgacggtcctctaggtactttcccccctttaacactatatcgccattcggggcgtcggggtccncccgaaggcctccggaagggggaacgggcgtaggacggttggtctacgtattagttagtgggtagttgggtaactactagtactaacgttacgccgaacgaccgtccggtaagggtaaccggggtccccggttacaccactccgtaccgaagaacgaacaacctacccgaaagaaccnggactttacgtaatccgtaagataaacggtcggaacgtcgngaaccgaggccgtaacggacctcggtagtttaataacggttccgtaacggccggtaacgggtttaaacggggtattttttaccaaggttattaacgttaacgtttaacggttaaccggttaaaaggttaaaacggttacgtttaaccttagggtaaacccgtacgggtacgggtaacccgggtaccgggtaaaccgtccgggttaacccncccgggttccttaacccgtccgtaacgtcccctaccgaaacccggacgtacccgttccggtacccgggttacccttcccggtaccgggtcccgtaccggttccgaccggaaccggaagggttacccaccggggtaacctacccggaagggtaaccctcgggacccnccggggtacccggtggtacccggg

SEQ ID NO: 47996 - DNA, 701 bp, Homo sapiens
  misc_feature: GYAE6OF01AP8XW.16.28.C06.1.454.CMB.1.raw
  modified_base (224)..(224): a, c, t, g, unknown or other
  misc_feature (224)..(224): n is a, c, g, or t
  modified_base (258)..(258): a, c, t, g, unknown or other
  misc_feature (258)..(258): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (425)..(425): a, c, t, g, unknown or other
  misc_feature (425)..(425): n is a, c, g, or t
  modified_base (457)..(457): a, c, t, g, unknown or other
  misc_feature (457)..(457): n is a, c, g, or t
  modified_base (578)..(578): a, c, t, g, unknown or other
  misc_feature (578)..(578): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacgaggcccgggggggtccctggagacctctcctggtgcaggcctctggactttcccctttaccacatatgccagtgggctgggtccnccaggctccgaggggaagggtctggagtgggtcnctactttatagtggtagttggtggtcaccgcctatacggcagacgttcccgtaggaacggggccaattccaccgattccaccaggtacgacctacctttcccgaaggaaaaccnccgtntacgtagtctgacggtaaatggaccaggcctgagtagcggaaggtacncggcaattatagttactggcgtaacgaaactntcccgagcggtacctacgtaccaacttcgaacgtcgacgtccgttacgggttcccgaccccgtacggggacccgtacgggaacccgttcggtaccgtcccgttctcccgctaccgtacccnccgtaaccgacgggccctacggtcccggttcccccttccccccggacggtcccttaccccctcccggtacgacccgaacgtcccgtaacccgttccgggagggccctacgcggtaccccgggg

SEQ ID NO: 47997 - DNA, 587 bp, Homo sapiens
  misc_feature: GYAE6OF02H3RZG.16.28.C06.1.454.CMB.1.raw
tcagtgtactactccacgaccggtgctcgatttagagctcacgtattgggtttgggctgagttgtctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccagggaagggctggagtgggtctcacttattagtggtagtggtagtactacatactacgcagactccgtgaagggccggttcaccatctccagagacaatcccaagaacacgctgtatctgcaaatgaacggctgagagccgaggacacggccgtatattactgtgcccgagggtagttttacatgatattactggttaacaaaaagggtactactttgactacgtgggaccagggaccctggtcaccgtctcctcacgcctccaccgaacgggcccagtccggtccttccccgtggcccgtcccgtcgcctccgaggacgccaccctccggaacgaaccaccgacggaccggccccgtgggtccg

SEQ ID NO: 47998 - DNA, 549 bp, Homo sapiens
  misc_feature: GYAE6OF02IGITD.16.28.C06.1.454.CMB.1.raw
  modified_base (524)..(524): a, c, t, g, unknown or other
  misc_feature (524)..(524): n is a, c, g, or t
  modified_base (548)..(549): a, c, t, g, unknown or other
  misc_feature (548)..(549): n is a, c, g, or t
tcagtgtactactccacgaccggtgctcgatttagagctcacgtattgggtttgggggggaagaggaagactgacggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaaatgaacggcctgagagccgaggacacggccgtatattactgtgccccgagggaggttttactatgatattactggttaacaaaaagggtactaactttgactactggggccagggaaccctggtcaccgtctcctcagcctccaccaagggcccatcggtcttcccctggccgccctgctccaggacgcacctccgagaacacagcggccctgggctgcctggtcaaggactacttccgagtagtacnctgagcggctggcaggcgcatagnn

SEQ ID NO: 47999 - DNA, 574 bp, Homo sapiens
  misc_feature: GYAE6OF02GGB9N.16.28.C06.1.454.CMB.1.raw
tcagtgtactactccacgaccggtgctcgatttagagctcacgtattgggtttgggctgagttggcttttcttgtggctattttaaaaggtgtccagtgtgaggtgcaactgttggagtctggggagccttggtacagccggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggctgagagccgaggacacggccgtatattactgtgcccgagggtagttttacatgatattactaggttaacaaaaagggtactatttgactacgtgggccagggaaccctggtcaccgtctcctcacgcctccaccaacgggcccagtccggtccttccccgtggccgccctgcctccgacggacgccacctccgacgaaccaccgacgccggccctggtacg

SEQ ID NO: 48000 - DNA, 567 bp, Homo sapiens
  misc_feature: GYAE6OF02I1W6S.16.28.C06.1.454.CMB.1.raw
tcagtgtactactccacgaccggtgctcgatttagagctcacgtattgggtttgggctgagttggcttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttacatgatattactggttaacaaaaagggtactactttgactacgtgggccagggaccctggtcaccgtctcctcacgcctccaccaagggcccatccggtcttccccgtggccgccctgcctccgaggacgccacctccgagaaccacacgccggccctgggcc

SEQ ID NO: 48001 - DNA, 579 bp, Homo sapiens
  misc_feature: GYAE6OF02GE4G6.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggtaggttttacatgatattactggttaacaaaaagggtactatttgactactgggcacggacctggtcaccgtctcctcagcctccaccgaaggcccatcggtccttccccgtggccgccctcgccgttccgacggacgccaccctcccgacgaaccaccgacggccggccccgtgggtccg

SEQ ID NO: 48002 - DNA, 606 bp, Homo sapiens
  misc_feature: GYAE6OF02IXJXD.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaaagaaccacgctgtatctgacaaatgaacggcctgagagccgaggacacggccgtatattactgtcgcccggagggtacggttttactatgatattactaggttaaactaaaaagggtacttactttagactacgtgggaccgacggacccgtggtccaccgtctcctcacgcctccaccgaacgggcccacgtccggttcccttccccgtcgccgccctcgtcctccgacggacgcctaccgtaccgacgaaccaccgacggccggtcccgtggtccg

SEQ ID NO: 48003 - DNA, 601 bp, Homo sapiens
  misc_feature: GYAE6OF02HMM5S.16.28.C06.1.454.CMB.1.raw
  modified_base (317)..(317): a, c, t, g, unknown or other
  misc_feature (317)..(317): n is a, c, g, or t
tcagtgtactactccacgaccggtgctcgatttagagctcacgtattgggtttgggctgagttggcttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccaggggaaggggctggagtgggtctcacttattagtggtagtggtagtactacatactacgcagactccgtgaagggccggttcaccatctccaganacaatcccaagaacacgctgtatctgcaaatgaacggctgagagccgagacacggccgtatattactgtgcccgagggtagttttacatgatattactggttaacaaaaaggtactatttagactacgtgggccagggtaaccctgtcaccgtctcctcacgcctccaccgaacggcccatccggtctccccgtggcccgtccccgtggccctccgacgggacgtcccgaacccgttcccggaacgaaccgaccgtaccggacccggtccccgtagggtacccg

SEQ ID NO: 48004 - DNA, 593 bp, Homo sapiens
  misc_feature: GYAE6OF02IKPK2.16.28.C06.1.454.CMB.1.raw
  modified_base (384)..(384): a, c, t, g, unknown or other
  misc_feature (384)..(384): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccgttcaccatctccagagacaatcccaagaacacgctgtatctgacaaatgaacggctgagagccgaggacacggctatattacngtgcccgagggtagttttacatgatattactaggttaacaaaaagggtacttactttgacttacgtcgggaccacgggtaaccctggtaccaccgtctcctcacgcctaccaccaacgggcccagtccggtccttcccccgtgccgccctcgccgtccgacggacgccacccgtccgacgaaccaccgacggcccggcccgtgggtccg

SEQ ID NO: 48005 - DNA, 600 bp, Homo sapiens
  misc_feature: GYAE6OF02GY31F.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaaccacgctgtatctgcaaaatgaaccggcctgagagccgaggacacggccgtatattactgtcgcccgagggtaggttttacatgatattacgtaggttaaacaaaaaagggttactaactttagacttacgtggggaccaagggaaccctggtccaccgtctcctcacgcctaccaccgaacggcccagtccggtccttccccgtggccgtccctgcctccgaggacgccacccgtccgacgaaccacgacggccggtacccgtggccg

SEQ ID NO: 48006 - DNA, 600 bp, Homo sapiens
  misc_feature: GYAE6OF02I79MF.16.28.C06.1.454.CMB.1.raw
  modified_base (536)..(536): a, c, t, g, unknown or other
  misc_feature (536)..(536): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccgagggaaggggctggagtgggtctcacttattagtggtagtggtagtactacatactacgcagactccgtgaagggccgttcaccatctccagagacaatcccaagaacacgctgtatctgcaaatgaacggcctagagacgccgaggacacggccgtatattactgtcgcccgagggtagttttactatgattattactaggttaacgtaaaaaggtactactttagactacgtgggaccgaacgggacccgtggtccaccgtctcctcacgccctccaccgaacggccacgtccggtccttccccgtcgccncccgtcgccgtccacggacgccacccgtccgacgaaccgacgacggacccggcccgtgggtccg

SEQ ID NO: 48007 - DNA, 581 bp, Homo sapiens
  misc_feature: GYAE6OF02G7XXI.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattccccctttaccacatatgccatgggctgggtccgccaggctccagggagggctggagtgggtctcacttatagtggtagtggtagtactacatactacgcagactccgtgaagggccggttcaccatctccagagacaatcccaagaacacgctgtatctgacaaatgaacggcctgagagccgaggacacggccgtatattactgtgcccgagggtagttttactatgatattactggttaacaaaaaggtactaactttgactacgtgggccagggacctggtcacgtctcctcacgcctccaccgaacggcccagtccggtccttccccgtcggcccgccctgcctccgacggacgcctaccctccggacgaaccaccacggccggcccgtgggccg

SEQ ID NO: 48008 - DNA, 602 bp, Homo sapiens
  misc_feature: GYAE6OF02HO15T.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaaggggctggagtgggtctcacttattagtggtagtggtagtactacatactacgcagactccgtgaaggccggttcaccatctcagagacaatcccaagaacacgctgtatctgacaaatgaacggcctgagagccgagacacggcgtatattactgcgcccgagggtacgttttactagtgatattactaggttaaacaaaaagggtactactttagactacgtgggccgaacgggaccctggtccaccgtctccctcacgcctacccaaccgaacggcccacgttccggttcccttcccccgtggccgccctcgtccgtccgacggacgccacccgtccgaacgaacaccgacggcccggcccgtgggtccg

SEQ ID NO: 48009 - DNA, 627 bp, Homo sapiens
  misc_feature: GYAE6OF02HZ1FK.16.28.C06.1.454.CMB.1.raw
  modified_base (395)..(395): a, c, t, g, unknown or other
  misc_feature (395)..(395): n is a, c, g, or t
  modified_base (518)..(518): a, c, t, g, unknown or other
  misc_feature (518)..(518): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccaggggaaggggctgggagtgggtctcacttattagtggtagtggtagtactacatactacgcagactccgtgaaggccgttcaccatctccagagacaaactccccaagaaccacgctagtatctgacaaatcgaacggcctagagagccgaggacacggccgtatattacnggtgcccggtagggtaggttttacagtgtattattacgtaggttaaacgaaaaagggtacttaacgtttgactacgtcgggaccgaacgggaccctggtccaccgtcctccgtcacgtacccnccgaaccgaacgggcccaacgttccggtcccttcccccgtcggcccgcctccgcctccgacggacgccaaccgtccgaacgaacaccgacggcccggcccgtcggtccg

SEQ ID NO: 48010 - DNA, 587 bp, Homo sapiens
  misc_feature: GYAE6OF02G6SI0.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggctgagagccgaggacacggcgtatattactgcgcccgagggtacgttttacagtgatattactaggttaaacaaaaagggttactaatttgactacgtcgggcagggaaccgtggcgtaccgtctcctcacgcctaccaccgaacggccacgtccggtccttccccgtgcccgccctcgccgtccgacggacgccacccgtccgacgaccacgacggccggccgtgggtccg

SEQ ID NO: 48011 - DNA, 610 bp, Homo sapiens
  misc_feature: GYAE6OF02HS0WE.16.28.C06.1.454.CMB.1.raw
  modified_base (472)..(472): a, c, t, g, unknown or other
  misc_feature (472)..(472): n is a, c, g, or t
tcagtgtactactccacgaccggtgctcgatttagagctcacgtattgggtttggggggaagaggaagactgacggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccgatctcccagagacaatcccaagaacacgctgtatctgcaaatgaacggcctgagagccgaggacacggccgtatattactgtgccgagggtgttttacatgatattactggttaacaaaaagggtctactttgactactggggccagggaaccctggtcaccgtctcctcagcctccaccaagggccccagttccgggtcccttcccccgtggccgtccccgtgcctccagggacnccacccgtccgaagaaccaccaggccggcccgtaggggcctcgccgttgggtaccaaaggaccttaccgttccggtagttacgtaccgaacgttcggacggcggtaccgtggaccgaagggccgacgacgtaggctag

SEQ ID NO: 48012 - DNA, 626 bp, Homo sapiens
  misc_feature: GYAE6OF02G4KJC.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccaggggaagggctggagtgggtctcacttattagtggtagtggtagtactacatactacgcagactccgtgaagggccgttcaccatctccagagacaatccccaagaaccacgctgtatctgacaaatgaacgcctgagacgcgagacacggcctatattactgtcgcccgaagggtagttttacagtgattattactaggttaaacgtaaaaagggtacttaactttagaacttacgtcgggaccgaacgggtaacccgttggtaccaccgtcctcctcacgtccctacccaccgaacgggccctacgtcccggttccttcccccgtcggcccgtcccgtcgccgtcccgaggacgccgtaccgtaccggaacgaaccgacgacggccggtcccgtgggtccg

SEQ ID NO: 48013 - DNA, 574 bp, Homo sapiens
  misc_feature: GYAE6OF02GMK2V.16.28.C06.1.454.CMB.1.raw
  modified_base (345)..(345): a, c, t, g, unknown or other
  misc_feature (345)..(345): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (568)..(568): a, c, t, g, unknown or other
  misc_feature (568)..(568): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggattccccctttaccacatatgccatgggctgggtccgccaggctccagggaagggctggagtgggtctcacttattagtggtagtggtagtactacatactacgcagactccgtgaacgggccggttcaccatctccagagacaatcccaagaacacgctgtatcngcaaatgaacgctgagagcgagacacggctatatactgtgccgaggtagttttacatgatattatagtaacgtaaaaggtactacttagactacgtgggacgacggacctggtcaccgtctcctcgcnccnccaccgacggccacgtccgtcctccccgtcgccgtcccgtcgccgtccgaggacgccacccgtccgaacgaaccaccgacggccggtcccgnggtccg

SEQ ID NO: 48014 - DNA, 567 bp, Homo sapiens
  misc_feature: GYAE6OF02HS11W.16.28.C06.1.454.CMB.1.raw
  modified_base (389)..(389): a, c, t, g, unknown or other
  misc_feature (389)..(389): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (549)..(549): a, c, t, g, unknown or other
  misc_feature (549)..(549): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtcctgagactctcctgtgcagcctctggattcccctttaccacatatgccatgggctgggtccgccaggctccgaggggaaggggctgggagtgggtctcacttattagtggtagtggtagtactacatactacgcagactccgtgaagggccggttcaccatctccagagacaatcccaaagaacacgctgtatctgcaaatgaacgctgagagccgaggacacggccgtatattacngtgcccgagggtgttttacatgatattactaggttaacaaaaaggtactactttagactacgtgggcagggaccctggtacaccgtctcctcacgcctccgaccaaggcccatccggtccttccccgnggccnccctcgcgtccaggcgccacctccganaacacaggccgccgtggc

SEQ ID NO: 48015 - DNA, 629 bp, Homo sapiens
  misc_feature: GYAE6OF02GDS3E.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccgagggaaggggctggagtgggtctcacttattagtggtagtggtagtactacatactacgcagactccgtgaagggccggttcaccatctccagagacaatcccaagaaccacgctgtatctgacaaatgaacggcctgagagccgaggacacggcctatattactgtcgccgagggtagttttacatgattattacgtaggttaaacgtaaaaaagggttacttaacgtttagaaccttacgtcggggaccgtaacgggaacccttggtaccaccgtcctcctcacgtccctaccgacccgaacgggccccagttcccggttcccttccccgtcggcccgtccctcgtccgtccgacggacgccacccgtccgaacgaaccaccgacggccggtcccgtgggtcc

SEQ ID NO: 48016 - DNA, 577 bp, Homo sapiens
  misc_feature: GYAE6OF02FKRQ1.16.28.C06.1.454.CMB.1.raw
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
  modified_base (540)..(540): a, c, t, g, unknown or other
  misc_feature (540)..(540): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattccccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagcccgaggacncggccgtatattacngtgcccgagggtagttttacagtgatattactggttaactaaaaagggtactactttgaactactggggccagggaccctggtcaccgtctcctcacgcctccaccgaaggcccatccggtcttcccctggccgccctgccctccgaggacnccaccgtccgacgaaccacacggccggccctgggtcc

SEQ ID NO: 48017 - DNA, 595 bp, Homo sapiens
  misc_feature: GYAE6OF02IJNMD.16.28.C06.1.454.CMB.1.raw
  modified_base (361)..(361): a, c, t, g, unknown or other
  misc_feature (361)..(361): n is a, c, g, or t
  modified_base (559)..(559): a, c, t, g, unknown or other
  misc_feature (559)..(559): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccgagggaaggggctggagtgggtctcacttattagtggtagtggtagtactacatactacgcagactccgtgaaggccggttcacatctccagagacaactcccaagaacacgctgtatctgacaaatgaacgctgagngccgagacacggctatatactgtcgcccggagggtacgttttacattgattattacttaggttaaacgtaaaaagggttacttaacgtttagtacttacgtcgggaccgtaacggtaccgtggtaccaccgtcctccgtcacgcctaccaccgaacggccctagtccgtctccccgcgccgccctcgccgtcgacgcnccgacctccgacgacgacgacggccgccgtggtccg

SEQ ID NO: 48018 - DNA, 623 bp, Homo sapiens
  misc_feature: GYAE6OF02GPPVF.16.28.C06.1.454.CMB.1.raw
  modified_base (386)..(386): a, c, t, g, unknown or other
  misc_feature (386)..(386): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaagggctggagtgggtctcaactattagtggtagtggtggtaccacatacttcgctgactccgtgaacgggccggttctccatctccagagacacttccaagaacacggtgtatctgcaagtgcacagcctgagacgccgaggcacggcatatattacngtgacgaaagatccgacttccccctcgtagagagtggactaactaaaattccttttacctaccgtaatttcgtaacgtttcggtcggggacccgaacggggtaacccgttcgggtaccacccgttcctccctccacgtccctacccgaacccgaaccgggccctacgtcccggtcccttccccggtcgccctacccctccctaccgaacgccgccaccgtcggtcggggaccaccgg

SEQ ID NO: 48019 - DNA, 674 bp, Homo sapiens
  misc_feature: GYAE6OF02F1UAF.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattccccctttaccacatatgccatgggctgggtccgccaggctccgagggagggctggagtgggtctcacttattagtggtagtggtagtactacatactacgcagactccgtgaagggtccgttcaccatctccagagacaatcccaagaacacgctgtactctgacaaatcggaaccggcctgaggacgcccggaaggacacggccgttaatacgttacgtgtcgcccggtagggtacgttttacagtgattattactaggttaaactaaaaggttacttaactttgtaacgtacgtacgggtaccgacgggtaacccgttcggtaccgtaccgtcctacccgtaccgacgtacctacccgaaccgaaccgggtccctaacgttcccggtcccgttcccccgtcggcccgtccccgtcgcccgtacccgaacggacgacccgtacccgtacccgaacgaacccgaccgaccggcccggtacccgtcgggtccg

SEQ ID NO: 48020 - DNA, 591 bp, Homo sapiens
  misc_feature: GYAE6OF02G65YI.16.28.C06.1.454.CMB.1.raw
  modified_base (386)..(386): a, c, t, g, unknown or other
  misc_feature (386)..(386): n is a, c, g, or t
  modified_base (550)..(550): a, c, t, g, unknown or other
  misc_feature (550)..(550): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattccccctttaccacatatgccatgggctgggtccgccaggctccgagggaaggggctggagtgggtctcactcattagtggtagtggtagtactacatactacgcagactccgtgaagggccgttcaccatctccagagacaatcccaagacacgctgtatctgcaaatgaacggcctgagagccgaggccacggcgtatattacngtgcccggagggtacgttttacagtgatattactaggttaacaaaaaggtactacttgtactacgtgggaccagggaaccctggtacaccgtctcctcacgcctaccacgtaacggcccagtccggtccttccccgtggcccgtccctcgtcctccgacggacnccgaccctccgacgaaccgaccgacgaccggcccgtacggg

SEQ ID NO: 48021 - DNA, 630 bp, Homo sapiens
  misc_feature: GYAE6OF02HHIPY.16.28.C06.1.454.CMB.1.raw
  modified_base (318)..(318): a, c, t, g, unknown or other
  misc_feature (318)..(318): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (503)..(503): a, c, t, g, unknown or other
  misc_feature (503)..(503): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattccccctttaccacatatgccatgggctgggtccgccaggctccaggggaagggctggagtgggtctcacttattagtggtagtggtagtactacatactacgcagactccgtgaagggccggttcaccatctcaganacaactcccaagaaccacgctgtatctgacaaatgaacggcctgagagccgaggacncggcgtatattacngtgcccgagggtagttttacatgattattacttaggttaaacgtaaaaagggttacttaactttagtacttacggtcgggccgaacgggtaacccgtggtccaccgtctcctcncgaccctccgaccgaacggccccacgtcccggttcccttcccccgtcgggcccgtcccgtcgtccgtacccgacggacgccgaccctaccggacgaaccaccgaccgcccggtacccgtgggtcccg

SEQ ID NO: 48022 - DNA, 610 bp, Homo sapiens
  misc_feature: GYAE6OF02HY464.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccagggaagggctggagtgggtctcacttattagtggtagtggtagtactacatactacgcagactccgtgaaggccggttcaccatctccagagacaatcccaagaacacgctgtatctgcaaatgaacggcctgagagcgaggacacggcgtatattactgtgccgagggtagttttactatgattatactaggttaacaaaaaggtactactttagactacgtgggccacgggtaaccgtcggtcctaccgtcctccctcacgccctaccaccgaacgggcccacgttccggttccttccccccgtcggtcccgtcccgtcgacccgtcccgacggacggtcccacccgaccgaacgaaccgaccacggcccggtcccgtgggtccg

SEQ ID NO: 48023 - DNA, 645 bp, Homo sapiens
  misc_feature: GYAE6OF02F8FRA.16.28.C06.1.454.CMB.1.raw
  modified_base (399)..(399): a, c, t, g, unknown or other
  misc_feature (399)..(399): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattccccctttaccacatatgccatgggctgggtccgccaggctccgaggggaagggctggagtgggtctcacttatagtggtagtggtagtactacatactacgcagactccgtaggaagggtccggttcaccatcctccagacgaacaactccccaaagaaccacgctagtatctgacaaatcgaacgctgagacgccgaggacacggctatattacgngtcgaccgagggtagttttacagtgtattattacgtaggttaaacgtaaaaagggttacttaacgtttagtaactacggtcggggtaccgtaacgggtacccttggtacctaccgttcctccctcgacgccctaccgaacccgaacgggtccctacgttccggttcccttccccgtcgcccgtccctcgccgtccgacggccgtcccacccgtaccgacgaacaccgacggcccggccgtcggtcg

SEQ ID NO: 48024 - DNA, 616 bp, Homo sapiens
  misc_feature: GYAE6OF02JDYRY.16.28.C06.1.454.CMB.1.raw
  modified_base (466)..(466): a, c, t, g, unknown or other
  misc_feature (466)..(466): n is a, c, g, or t
  modified_base (605)..(605): a, c, t, g, unknown or other
  misc_feature (605)..(605): n is a, c, g, or t
  modified_base (613)..(613): a, c, t, g, unknown or other
  misc_feature (613)..(613): n is a, c, g, or t
tcagtgtactactccacgaccggtgctcgatttagagctcacgtattgggtttggggggaagaggaagactgacggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccgttcaccatctcagagacaatcccaagaacacgctgtatctgcaaatgaacggcctgagagccgaggacacggccgtatattaactgtgcccggagggaggttttactatgatattactggttaacaaaaagggtactacttgactacgtgggcagggaacctggtcaccgtctcctcacgcctaccacgaacgggcccatcggtaccttcccccgtggccgccctgcctccgaggacnccacctccgaagaaaccacgaacggccggacccgtcggggccttcggcccgttacgggttaccgaaacggtacctaccgtttcccgagttaacggtacctaacgttggaacggccgggacgtcggacgtacgggaccgnaagtacgnacg

SEQ ID NO: 48025 - DNA, 577 bp, Homo sapiens
  misc_feature: GYAE6OF02HF99E.16.28.C06.1.454.CMB.1.raw
  modified_base (455)..(455): a, c, t, g, unknown or other
  misc_feature (455)..(455): n is a, c, g, or t
  modified_base (485)..(485): a, c, t, g, unknown or other
  misc_feature (485)..(485): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccaggggaaggggctgggagtgggtctcacttattagtggtagtggtagtactacatactacgcagactccgtgaagggccggttcaccatctccagagacaatccccaaagaaccacgctagtatctgacaaatgaacggcctgagagccgaggacacggcctatattactgtgcccgagggtagttttacatgatattactggttaaacaaaaaggtactatttagactacgngggccagggaccctggtccacgtctcctcncgcctccaccgacggccctacgtccgtcctccccgtcgccgccctgcctccgaggcgccacctaccgacgaaccacacgccggtcctggtcc

SEQ ID NO: 48026 - DNA, 631 bp, Homo sapiens
  misc_feature: GYAE6OF02H8AC6.16.28.C06.1.454.CMB.1.raw
  modified_base (215)..(215): a, c, t, g, unknown or other
  misc_feature (215)..(215): n is a, c, g, or t
  modified_base (319)..(319): a, c, t, g, unknown or other
  misc_feature (319)..(319): n is a, c, g, or t
  modified_base (391)..(391): a, c, t, g, unknown or other
  misc_feature (391)..(391): n is a, c, g, or t
  modified_base (583)..(583): a, c, t, g, unknown or other
  misc_feature (583)..(583): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctccgtgtgcagcctctggattcccctttacacatatgccatgggctgggtccnccaggctccgagggaggggctgggagtgggtctacacgttattaggtggtagtggtagtactacatactacgcagactcgtgaagggccggttcacatctccanagacaatcccaagaacacgctgatctgacaaatcgaacgcctgacgagccgagacacggccgtaatattacngtagcccggtagggtagtttacatgatacttataggttaaacaaaaaggttactaacgtttagacgtacgtacgggtacacgggtaaccctggtaccaccgtcctacctcaacgtccctacccgaaccgaacgggcccctagttaccggttccctcccccgttggcccgtcccgtacgcctccgaaggtacncctaacccgtcccgaacgaacaccgacggtccggcccgtaggtcccgg

SEQ ID NO: 48027 - DNA, 660 bp, Homo sapiens
  misc_feature: GYAE6OF02FUJXJ.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttacacatatgccatgggctgggtccgccaggctccagtgggaaggggctgggagtgggtctcacttattagtggtagtggtagtactacatactacgcagactccgtgaaggccggttcacatcctcagagacaatcccaagaaccacgctgtatctgacaaatggaacgcctggagacgccgaggacacgggcctatattacgtgtcggccccggtaaggggttacggtttttaactagttgtaattatttaacgtagggtttaaaacgaaaaagggttaccttaacgtttggaaccttacggtacggggacccgacgggtaacccgttcgggtcctaacccgtctccgtccacgtaccctccgaaccgaaccgggtcccctaagtcccggttcccttccccgtggtcccgcccgtcgcctaccgacgggcgccacccgtcgacgtaaccacgaccggcccggacccgtcggg

SEQ ID NO: 48028 - DNA, 719 bp, Homo sapiens
  misc_feature: GYAE6OF02HT64X.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtcctgagactctcctgtgcagcctctggattcccctttacacatatgccatgggctgggtccgccaggctccgagggaagggctggagtgggtctcgacttattagtggtagtggtagtactacatactacgcagactcgtgaagggccgttcacgatctccagacgacaatcccaagaaccacgctgtatcgtgacaaaagtcgaaccggctagagacggccgaaggaccaacggccgttaatacgttacgttcgtacggcccggtaaggggttacggtttttaacagttagtaattagtttaactagggttaaacgtaaaaacgggttacttaacgtttaggtaaccttaacggtcggggaccgaacgggtaacccgttcggtaccctaccgtaccttaccgtaccgaccgtacccttacccgaacccgaacgggtacccctacgttacccggtcccttacccccgtggccccgtaccccgttcgcccgttaccggaccggtaccgacccgtaacccgttacccggaacgtaacccgaccgtaccggaccccggttcccgtggtacccg

SEQ ID NO: 48029 - DNA, 598 bp, Homo sapiens
  misc_feature: GYAE6OF02GAX9D.16.28.C06.1.454.CMB.1.raw
  modified_base (361)..(361): a, c, t, g, unknown or other
  misc_feature (361)..(361): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggattcccctttaccacatatgccatgggctgggtccgccaggctccagggaggggctggagtgggtctcacttatagtggtagtggtatactacatactacgcagactccgtgaagggccggttcaccatctccagagacaatcccaagaacacgctgtatctgacaaaatgaacggctaganacgccgaggacacggccgtatattactgtcgcccgagggtagttttacatgatattactgttaacaaaaagggtactattgactacgtgggccacgggaccctggtcaccgtctcctcacgcctaccaaccgaacgggccctagtccggttcccttccccgtcggccgtccccgtcgcccgtccgaacggacgcccacccgtccgaacgaacaccgacgccgggtcccgtgggtccg

SEQ ID NO: 48030 - DNA, 622 bp, Homo sapiens
  misc_feature: GYAE6OF02ISHOL.16.28.C06.1.454.CMB.1.raw
  modified_base (554)..(554): a, c, t, g, unknown or other
  misc_feature (554)..(554): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggactttcccctttaccacatatgccagtgggctgggtcccgccaggctccgaggggaagggctgggagtgggtctcacttattagtggtagtggtagtactacatactacgcagacctccgtggaagggccggttcacctatctccagagaacaactcccaagaacacgctgtatctgacaaagtgaacggcctgagacgccgaggacacggcgtatagttactgtcgaccggtagggtagttttacatgattatacgtagttaaacaaaaggttactattgtactacgcgggcgacggtacccgtgtccacgtctcctcgcgcctcccaccgacggccctacgttcgtcccgttccccgtcggcccgtcccgtcncccgtccgacggcgaccctaccgtacccgaacgtaccaccgaacgggtcccggtacccgtagtcccgg

SEQ ID NO: 48031 - DNA, 612 bp, Homo sapiens
  misc_feature: GYAE6OF02FZH3C.16.28.C06.1.454.CMB.1.raw
  modified_base (496)..(496): a, c, t, g, unknown or other
  misc_feature (496)..(496): n is a, c, g, or t
tcagtgtactactccacgaccggtgctcgatttagagctcacgtattgggtttgggctgagttggctttttcttgtggctatttttaaaaggtgtccagtgtgaggtgcaactgttggagtctgggggagccttggtacagccgggggggtccctgagactctcctgtgcagcctctggattccccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgacaaatgaacgcctgagacgccgaggacacggcctatattactgtcgcccgagggtaggttttactagtgtattaattactaggttaaacaaaaagggttacttaactttagactacgtgggccgaacgggaccctggtccacgtctccncgacgcctccaccgacggccctactccggtccttccccgtcggccgtcccgtcgtcccgtccgacggacgccgacccgtaccggacgaaccaccgacggcccggcccgtgggtccg

SEQ ID NO: 48032 - DNA, 913 bp, Homo sapiens
  misc_feature: GYAE6OF02GB5VZ.16.28.C06.1.454.CMB.1.raw
  modified_base (466)..(466): a, c, t, g, unknown or other
  misc_feature (466)..(466): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggactccgtgagactcctccgtgtcgacacgtcctcgtgtacctttcccccttaccactatagtcgacctaggtgggtcggttccgggtccccgaccgacggtcctaccgggaagggggaacgggtcgtagggtagggttcgggtcctaccgttaactttaagttaggttagggtaggttagggttaacgtaacctaactacttaaccgtacgacgaacggtaccgtccggtaagggaaccggggttcccggttaccaacctctccctaccgaaggaacgaacctaacctacccgaaaacgaaccaccgtcttagtactntacgaactaagacggaaccgtctaggaacgacgacggaacggaccgaccggtacgttaattacgttacgtcgtaccggaccgggtaagggttttacgttttaacgagttagtaatttaacttaacggttaaacggttaaaaacgtaaaaacggttctttaaacgttacgaaccgttacgggtaccggggaccgtaaacccgggttaccgttccggtaccctacccgtttcctccgtaccgtacccgtacccctacccgaaacccgggtaacccggtacccgttaccggtttccccggttccccccttacccgggtccgggccccctttaccccggcggttaccccctaaccgggaccggtaaccccgtaccccctaacccgggttacccggaaacccggtaaacccaccggggtaccccggggtaccccggttaccccgggtccggg

SEQ ID NO: 48033 - DNA, 743 bp, Homo sapiens
  misc_feature: GYAE6OF02JT9VU.16.28.C06.1.454.CMB.1.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
  modified_base (609)..(609): a, c, t, g, unknown or other
  misc_feature (609)..(609): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctggagactctcctgtgcagcctctggacttcccctttaccacattatgccatgggctgggtccnccaggctccaggggagggctaggnggtgtctctattagtagtggtagtggtactacatatacacgcagtacctcgtaggacgggtccgtacactntcctacgagacgtaacaacctaacccaaacgaaccacgtaccgttaggtacttccggaagacctaaaagttaccgggaccggtaccagggtaaccggacggaacccggaggaaccctacgggaccctttaattaaacgtttcgtacggtccggtacccgggaaggggtttatttaaccgtagtagtaattaacgtttaccgtaaaggttaaaacggtaaaacggttactttattacgtactacggtcgggaacggtaaccgggtcctaaggtcccgtaactccctacgtcctaccnccgtacccaacggtcccggaaccggttcctcccgtttacccgcccgttaccggacccgtccgtaccggtaccgtacgaacgccggtccctaacccgaccgtaacacccggtagacccggcggtccggaggtccg

SEQ ID NO: 48034 - DNA, 651 bp, Homo sapiens
  misc_feature: GYAE6OF02GU1LH.16.28.C06.1.454.CMB.1.raw
  modified_base (362)..(362): a, c, t, g, unknown or other
  misc_feature (362)..(362): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaaagaacacgctgtatctgcaaatgaacgcctgagngccgaggacacggccgtatattactgtcgccggagggtaggttttactagtgattattactaggttaacaaaaagggttacttacgtttagaactacgtaggggccgaagggaacccgttggtcaccgttctcctcacgtccctaccgaccaacgggccctaacgttccggtcccttaccccgtcggtcccgtcccgttacgcccgttaccggacggtaccgtcccgtaacccgttacccggaacgtaacccgacccgaacggtcccgggtaccccggtcgggtacccg

SEQ ID NO: 48035 - DNA, 723 bp, Homo sapiens
  misc_feature: GYAE6OF02IF605.16.28.C06.1.454.CMB.1.raw
  modified_base (420)..(420): a, c, t, g, unknown or other
  misc_feature (420)..(420): n is a, c, g, or t
  modified_base (444)..(444): a, c, t, g, unknown or other
  misc_feature (444)..(444): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggacccttggtacaggccggggggggtccctggagactctcctggtgcagcctctggacttcccctttaccactatatgccatgggctgggtccgccaggctccgaggggaggggctggagtgggtctcactttattagtgggtagtggtagtactaacatactacgcagactccgtaggacggggtccgttcaccgatcctccagaagaacaacctacccgaaagaaccacgcttaggtatctagacaaaagtggaaccgtctagagacgccgaggacacgggcctaatatcgngtcgaccggaagggttcgttttanaatgaattacgttacgtaacggtttaaaacgaaaaaggttacctttacgtttacgaacgttacggtcggggaccgtaaccggggtaaccgttcggtacccaaccggttccttccgtaccgacgtcccgtaaccaacccggaacgggtaccctacggtttcccgttaccccgtttaccccgtcgggcccctacccgtcggtacctccggaacggacgacccgtaaccgacccggtaacgaaccgtaccgaccggtccggacccgttacgggacctccggg

SEQ ID NO: 48036 - DNA, 758 bp, Homo sapiens
  misc_feature: GYAE6OF02HOHEO.16.28.C06.1.454.CMB.1.raw
  modified_base (612)..(612): a, c, t, g, unknown or other
  misc_feature (612)..(612): n is a, c, g, or t
tcagtgtactactccacgaccggtgctcgatttagagctcacgtattgggtttgggctgagttggctttttcttgtggctattttaaaaggtgtccagtgtgaggtgcaactgttggagtcgtgggggagccttggtacaggccgggggggtccctgagactctcctgtgcagcctctggtacttcccccttttaaccacatatcgccagtgggctcggggtcccgccgaggcctccggagggggaaggggcgtgggaggtgggtctctacttattaggtggtagttggtagtactacatactacgcagtactcggaggaacgggtccgttaccacactcacagacgacaacctaccaagaaccaccgtctagttactcgtacgaacaaaggttacggaaccggtctaggaacggaccggacccggaagggaccgtacggggtacccgtttaataacgtttaccgtggtaccggacccgggttaaggggtttacgttttacagttagtattttaagtttaacgttaagggttaaaacgtaaaagggttacttacgttagtacgttacggtacgggaccggtaacgggtacccgtcgttaccgtaccgttccncccttcgacccgtaccctacccgaaccggaccggtccctaccgttccccggttcccgttccccgccggtcccgtcccgtcgccgtcggacggccgtacccgcccgtaacggaacgtaccgaccggccggcccgtccggcggtaccg

SEQ ID NO: 48037 - DNA, 593 bp, Homo sapiens
  misc_feature: GYAE6OF02H6CDA.16.28.C06.1.454.CMB.1.raw
  modified_base (295)..(295): a, c, t, g, unknown or other
  misc_feature (295)..(295): n is a, c, g, or t
  modified_base (334)..(334): a, c, t, g, unknown or other
  misc_feature (334)..(334): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagcctttggtacaggccggggggtcctgagactctcctgtgcagcctctggacttcccctttaccacatatgccagtgggctcgggtccgccaggctccgagggagggctggagtgggtctcacttattaggtggtagtggtagtactacatactacgcagacctcgngaacgggccgttcacatctcagagacactcccaagaacncgctgtactctgacaaagtcgaacgctgagngccgagacacggctatactacngtcgccgtagggttagtttacatgatattactaggttaaacgtaaaaggtacttacttagactacgcgggacgacggtaccgtggtcctacgtcctccgcaccgtcctaccaccgacggcctacgttccgtcccttcccgcgcctcccgtcgtccgtcgacggacgcctaccgccgacgaaccgaccgacgccggcccgtggtccg

SEQ ID NO: 48038 - DNA, 782 bp, Homo sapiens
  misc_feature: GYAE6OF02FGCGS.16.28.C06.1.454.CMB.1.raw
  modified_base (213)..(213): a, c, t, g, unknown or other
  misc_feature (213)..(213): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccnccaggctccgagggaagggctggagtggtctcacttattagtggtagtggtagtactacatactacgcagctccgtgaacgggtccgttcacatctccagacgacaactcccaaagaacacgctgttactctgactaaagtcgaaccggtctaggagtacggaccggtacggaccgacggtaccttaagttaactttacgtcgtacggaccccgggtaaaggggttaccgttttttaacacgtagtaactttacgttaacgttaacggtttaaaacggtaaaaaacggggttaccttaacgttttacggaaccgttaacggtacgggggtaccgtaaacgggtaccccgttaggttacccgtaaccgttccttacccgtaccgtaccgaccccttacccgaaccggtaaccggtcccctaacggtttccccgttcccgtttcccccggtcggtacccgtcccgttacggtcccgtaacccggtaccggtaaccggtacccctaaccggttaaccccgaacggtaacccgtacccggaaccggtccccgggtacccggttcggtacccgg

SEQ ID NO: 48039 - DNA, 752 bp, Homo sapiens
  misc_feature: GYAE6OF02JSAF3.16.28.C06.1.454.CMB.1.raw
  modified_base (419)..(419): a, c, t, g, unknown or other
  misc_feature (419)..(419): n is a, c, g, or t
  modified_base (469)..(469): a, c, t, g, unknown or other
  misc_feature (469)..(469): n is a, c, g, or t
  modified_base (483)..(483): a, c, t, g, unknown or other
  misc_feature (483)..(483): n is a, c, g, or t
  modified_base (749)..(749): a, c, t, g, unknown or other
  misc_feature (749)..(749): n is a, c, g, or t
tcagtgtactactccacgaccggtgctcgatttagagctcacgtattgggtttgggggtaaggaggaagacgtgacggtccctgagactctcctgtgcagcctctggattcccctttaccacatatgccatgggctgggtccgaccgaggcctccgaggggagggctgggagtgggtctcgacttattgtaggtagtcggtagtactactaatacgtacgcagacgtccgtaggaacggggccgttacaccgtatcctccgacgagtaccaaactcccaaaggtacaaccggcttgtattccgtgaacctaaaagtcgaaccggctaggaacgacggccgaagggtaacccgaggtccccgttaaatacgtttacgtaggttccgacccgggtaagggggtttaactttttaaaccgtntacggattaaaccttttacggtaacggttaaaaacggaaaaacgggtttnttaaccgggtttanaccggtttacggacggggaccctagggtaaaccccgttcggtacacccgttttccaagttcccgaacgtccctaccgaacgacgaccgtacgtcgttacccgtcccgtcgccgtccgtcgtcctcgtaccgacgccgtacctacgacgaaccgacgacgccggtaccgcggtccgtcggtaccgtggtaccgaggtaccttacgtaccgtacgtagtaacgtgttaacgcggtcgggacgtcggacgtacgggacctagacgtagntcg

SEQ ID NO: 48040 - DNA, 693 bp, Homo sapiens
  misc_feature: GYAE6OF02HKS8A.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccggggggtccctgagactctcctgtgcagcctctggacttcccctttaccacatatgccagtgggcgtcgggtcccgccaggctccgaggggaagggctggagtgggtctctacttattaggtggtagtggtagtactacatactacgcagtacctccgtggaacgggccgttcactatctaccgagacgacaactacccaaagaaccacgctgtactctagactaaatcgaaccggtcctagagacgccggaagcgaccggctatacttcgtgtcggccggagggttacgttttactgtagtattattacgttagttaaacgtaaaaggttacttacgttagtacgttacggtacgggtaccgaacgggtaccgtacggtaccaccgttcctccgtcgacgccctaccaacccggtacggccctacgttcccggttccccttcccccggtcgggtacccctcccgtaccgtcccgtaccgacggtacccgtaacccgacccggtaccgaaccgaaccgaaccgaccgggcccggtcccggtcggtcccgg

SEQ ID NO: 48041 - DNA, 644 bp, Homo sapiens
  misc_feature: GYAE6OF02I3032.16.28.C06.1.454.CMB.1.raw
  modified_base (213)..(213): a, c, t, g, unknown or other
  misc_feature (213)..(213): n is a, c, g, or t
  modified_base (390)..(390): a, c, t, g, unknown or other
  misc_feature (390)..(390): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttacacatatgccatgggctgggtccnccaggctccgagggagggctggagtggtctcacttatagtggtagtggtagtactacatactacgcagactcgtgaagggccgttcaccatctccagacacaactcccaagacacgctgtactctagacaaatgaacacgcctagacgacgccgaacgacacggccatactattacngtgacgaaagcgaccgacgacgttagccaaccctatacttacttagacttacgtggtcgccgacgggtacccgtcggtacctaccgtctcctcgacgtccctacccaaccgaccggtacccacgttcccggtacccttccccgtcggtacccctaccccttacccgtaccctaaccggaccgtaccgtaccccgttaccgggtcgggggtacccaacccggtacgggaccccgggtcccggtacgggtccccgg

SEQ ID NO: 48042 - DNA, 960 bp, Homo sapiens
  misc_feature: GYAE6OF02H6Y7H.16.28.C06.1.454.CMB.1.raw
  modified_base (130)..(130): a, c, t, g, unknown or other
  misc_feature (130)..(130): n is a, c, g, or t
tcagtgtactactccacgaccggtgctcgatttagagctcacgtattgggtttgggctgagttggctttttcttgtggcttattttaaaaggtgtccagtgtgaggtgcaactgttggagtctggggganccttggtacaggcccggggggtcctgagactctcctgtgcagcctctggtacttcccctttaccactatatcgcctagtcgggcgttcggggtcccgaccgtaggcctaccggaaggggggaacggggtccttaggggtacggttacgggggttcccttaccgtaacgttttaacggtttaagggttacggggtttaagggttagggttaaacggttaaccttaaccgtaagttaaccccgttaacggccgaaacggtaaccccgttcccgggtaagggtaaaccgggggtcccggtttacccaacccgaacttccgtacccgaagtaacgaacctaaaccgttaccccgaaaagaaccgaccgtacgttacggtaatcacggtacgtaaacggtcggtaaccggcctaaggacggacggacccgggaaggacccgtaccgggtacctaagtttacttacgtacggaccggttaccggtagggttacgttttaccgtagtaaggtactttaacgtttaacgttaacggtttaaaacgtaaaaacggttacctttacgttacgtaccgttaaccgggtacgggtaccggtaacgggtaacccgttcgggtacccttaacccggttccttacccgttaccgaaccgtaacccccttaccggtaaaccccggtaaaccgggtccccgttaaaccgttccccgggttaccccgttccccggttcgggtcccgtacccgttacggacccgttcccggaacggtacccgtacccgtacccgtaccggaacgtaacccggtacccgacgggtccccggtacccggtccggtacccgg

SEQ ID NO: 48043 - DNA, 633 bp, Homo sapiens
  misc_feature: GYAE6OF02FIGHH.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaagggctggagtgggtctcacttatagtggtagtggtagtactacatactacgcagactccgtgaagggtccggttcaccatctccagacgacaatcccaagaacacgctgtatctgacaaatgaacggctgagagccgaggacacggccgtatacttactgtgcccggtagggtagttttacagtgtattattacgtaggttaaacaaaaagggttactaactttagaactacgtcgggaccgaacgggacccgttggtaccaccgtcctccgtccacgcccttccgaccaacgggccctacgtccggttcccttccccgtcggcccgtccctcgtccgtaccgacggtaccgccgtacccgtaccggaacgaaccgaccgacggcccggtacccgtcgggtccg

SEQ ID NO: 48044 - DNA, 552 bp, Homo sapiens
  misc_feature: GYAE6OF02FS02H.16.28.C06.1.454.CMB.1.raw
  modified_base (215)..(215): a, c, t, g, unknown or other
  misc_feature (215)..(215): n is a, c, g, or t
  modified_base (449)..(449): a, c, t, g, unknown or other
  misc_feature (449)..(449): n is a, c, g, or t
  modified_base (482)..(482): a, c, t, g, unknown or other
  misc_feature (482)..(482): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggatttccccctttacacatatgccatgggctgggtccnccaggctccaggggaagggctggagtgggtctcacttattagtggtagtggtagtactacatactacgcagactccgtgaagggccggttcaccatctccagagacaatacccaaagaacacgctagtatctgacaaagtgaacggcctgagacgccgaggacacggcgtatattactgtcgcccgagggtagttttacatgatattataggtaaactaaaaggtactaatttnactactgggcgacggacctgtcaccgtctctcncgcctccacacggccatccgtcctccctgcctcctcnctcgagcgcacctcganacacacgcgccgtgtc

SEQ ID NO: 48045 - DNA, 652 bp, Homo sapiens
  misc_feature: GYAE6OF02GILW4.16.28.C06.1.454.CMB.1.raw
  modified_base (283)..(283): a, c, t, g, unknown or other
  misc_feature (283)..(283): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggcccgggggggtcctggagactctcctgtgcagcctctggacttccccctttacacatatgccagtggctgggtccgccaggctccgaggggaagggctggagtgggtctcattagtgtgtagtgtagtactacatactacgnagactccgtaggaacggtccgtacacatcacagagacaatccaagaacncgctagtactntacgacaaatgaaccggtctagacgacgcgaggacacggacgtatatacgtgtcgccgtagggttaacgttttacatagtatagttacgtaaggttaaacgtaaaacgttactactttacgaactacggtcggacgaccgggtaacctcgtacacccgtctcccgtacgaccgtccctaccgaaccgaccggtacctaccgttaccgtacccgttcccgtcgtacccgtccctcggtacccgtcggaacgggtactcccgtaaccgtaccgtaacgaccgacgtaccggcccggtacccgtggtacccg

SEQ ID NO: 48046 - DNA, 798 bp, Homo sapiens
  misc_feature: GYAE6OF02JVF9B.16.28.C06.1.454.CMB.1.raw
  modified_base (149)..(149): a, c, t, g, unknown or other
  misc_feature (149)..(149): n is a, c, g, or t
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (524)..(524): a, c, t, g, unknown or other
  misc_feature (524)..(524): n is a, c, g, or t
tcagtgtactactccacgaccggtgctcgatttagagctcacgtattgggtttgggctgagttgacttttttcttgtggctatttttaaaaaggtgtccagtgtgaggtcgacaacttgttggagtcggtgggggactccgttggtacncggggtcccggggggtcctgacgtactctccgtgtcgcacgcctgtgtaccttttaccccttaccatattncgctgtcgggcgtcggtccgacncggtcctacggaagggggacgggcgtgggaggtcggttctacctagtttagttaggtcggtggttaggttaactactacacttacgtacgacgacgtacgtccggtaggaacgggttcccgtacaacctctcctacgaggaacacaacctaccgaaacgacacgtcgtatactcgtacgacaaagtcggaaccggtcaggtacggacgaccgggacgaccggtaccggactttagtaacgttcgtacgggtccggaaccgggttagggtttacgtttaacngtaacgtattaacgtttaacggttaacggttaaaacggtaaaacggttacgtttagttactaacggtacgggtaccggtaccggtaaccggtacccggttcgtacccgtccgttcgtccctacgaacccgtccgtacccgacggaaccggtcccttacgttcccggttacccgtttccggacccggtacccgttccgccgtaccgaccggacggtaccgacccgtaccgaacgtaacggaaccgtccgaaccgggtcccggccggtacggtccg

SEQ ID NO: 48047 - DNA, 746 bp, Homo sapiens
  misc_feature: GYAE6OF02HU683.16.28.C06.1.454.CMB.1.raw
tcagtgtactactccacgaccggtgctcgatttagagctcacgtattgggtttgggctgagttggctttttcttgtggctattttaaaaaggtgtccagtgtgaggtgcaactgttggagtctgggggagccttggtacaggccgggggggtcctgagactctcctgtgcagcctctggacttccccctttaccacatatgccagtgggctgggtcccgccgaggcctccgaaggggaaggggctgggagtgggtctcacttattagtggtagtggtagtactacatactacgcagactccgtggaacgggtccggttcacctatcctaccagacgaacaactacccgaaagaaccacgctagtactctgacaaagtgaaccgctgagacgccgacgacgacggccgtatattactgtcgacccggtagggttacgttttactagtagtattatttacgttaagggtttaaaacgtaaaaacgggttaacttaacgtttacggtacgttacggtacggggtaccggaaccgggtaacccgttcggttaccgacccgttacccttaccctaccgtaccgtccccgtacccgaacccggtaaccgggcccctaaccgttcccggttaccccttcccccggtacgggccccgtccccgttcggtaccccgtccggaacggaccgacccgtaaccccgtaccgaaccgaacctacccgaccgggtccccgggtccccggttcgggtcccg

SEQ ID NO: 48048 - DNA, 746 bp, Homo sapiens
  misc_feature: GYAE6OF02HQAN7.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggacttcccctttaccacatatgccatgggctgggtccgccaggctccgagggaaggggctggagtggtctcacttattagtggtagtggtagtactacatactacgcagactccgtggaacgggccggttcacctatctccagacgaccaactcccaaagaacaccgctgtactcgtgacaaaagtcggaaaccggcctggacgagccggaaggacacggccgtatacttactggtcgacccggtaggggttacgtttttacagttgaagttaacgtttacgttaacggtttaaaacgtaaaaaacggggttacttacgtttacgaacgttacggtacggggtaccgtaacgggtaacccgtcgggttaccgaccggttcctccgtaccgaccgtccctaaccgacccgtaaccgggtccccgtacggttccccggttccccgttacccccgttcgggtccccgtacccgtaccggttccgtacccggacggaaccgtacccgtacccgtacccggtaaccgaacccgaaccggaacccgggtccccgggacccggttcgggtcccgg

SEQ ID NO: 48049 - DNA, 650 bp, Homo sapiens
  misc_feature: GYAE6OF02FUNQ3.16.28.C06.1.454.CMB.1.raw
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (543)..(543): a, c, t, g, unknown or other
  misc_feature (543)..(543): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggatttccccctttaccacatatgccatgggctgggtccgccaggctccgaggggaagggctggagtgggtctctacttattagtggtaggtggtagtactacatactacgnagactccgtgaacggtccggttcaccntctccagagacaactcccaaagaacncgctgtactctgactaaangaacggcctaggagacggccggaaggacgaccggccgtaagtactttacgtgtacggcccgtaagggtacgtttttacagtgtaattattacgttagttaaacgtaaaaaggttacttacttgtaaccttacgacggggtaccgtaacgggacccttggtaccgaccgttcctccgtcgtacncctacccgaccgaaccggccgtacgttccggtcccttccccgtcggccgcccgtcgccgtccgacgcgcccaccgtccgaacgaccgacacggccggccgtcggtcg

SEQ ID NO: 48050 - DNA, 690 bp, Homo sapiens
  misc_feature: GYAE6OF02F18G9.16.28.C06.1.454.CMB.1.raw
  modified_base (313)..(313): a, c, t, g, unknown or other
  misc_feature (313)..(313): n is a, c, g, or t
  modified_base (368)..(368): a, c, t, g, unknown or other
  misc_feature (368)..(368): n is a, c, g, or t
tcagtgtactactccacgaccggtgctcgatttagagctcacgtattgggtttgggctgagttggctttttcttgtggctatttttaaaaggtgtccagtgtgaggtgcaactgttggagtctggggagccttggtacagccgggggggtccctgagactctcctgtgcagcctctggacttcccctttacacatatgccatggctgggtccgccaggctccgagggaagggctggagttgggtctcgtacttattagtggtagtggtagtactacatactacgcagactccgtgaacgggtccggttcaccntcctccagagacaactccaagacacgctgtatctgacaatgaacggtctggacgngacgagacaccggaccgttatacttactggtgacggaagggccgggtaaatttcggggtagggtcggtaggacgtcgcttagttgaccgttcggtacggggaccgtaccgggtaaccgttcggtaccctaccgtccgttaccctcgaccgtaccgtcccgtaacccggacgggacccctaacgttcccgggtttcccgttacccccgtcggtacccctaccccgttacccgtaccaacggtccgacccgtacccgtccgggttccgggaccgttaccggaccggcccggtcccgtcgggttcctccggtcccgttaaccggg

SEQ ID NO: 48051 - DNA, 667 bp, Homo sapiens
  misc_feature: GYAE6OF02I01ED.16.28.C06.1.454.CMB.1.raw
  modified_base (320)..(320): a, c, t, g, unknown or other
  misc_feature (320)..(320): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtcgcagcctcgtggacttcccccgtttaaccacatatgccagtgggctgggtccgccaggctccgagggagggctggagtggtctcacttattagtggtagtggtatactacatactacgcagactcgtagaacgggtccgtcacatctcaganacactacccaagaaccacgctagtactctgacaaagtcggaaccgtctggaacgacgaccggaggaccaccgggaccgttattattacgtgtcggaccccgggtaagggttacgttttacagtagtacttagttacgtaggttaaaacgaaaacgggttcttaacgttagaactacggtcgggaccggacggtacccttggtccctaccgtcctccgtacgacgtccctacccaaccgacggtccctacgttcccggtcccttccccgtcggcccgtacccttgcccgtaccgacggactcccgtaccgtaccgaacgaccaccggacggcccggtccgtcggtccg

SEQ ID NO: 48052 - DNA, 598 bp, Homo sapiens
  misc_feature: GYAE6OF02GSB1T.16.28.C06.1.454.CMB.1.raw
  modified_base (213)..(213): a, c, t, g, unknown or other
  misc_feature (213)..(213): n is a, c, g, or t
  modified_base (387)..(387): a, c, t, g, unknown or other
  misc_feature (387)..(387): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccggggggtccctgagactctcctgtgcagcctctggattcccctttaccacatatgccatgggctgggtccnccaggctccgagggaagggctggagtgggtctcacttattagtggtagtggtagtactacatactacgcagactccgtgaagggccggttcaccatcctccagagacaatcccaaagacacgctgtatctgcaaatgaacggcctgagacgccgagacacggccgtatattacngtgcccgagggtacgttttacatgatatactagttaacgaaaaaggtactacgtttagactacgtgggaccacggaccctggtacaccgtctcctcacgccctaccaccgaacgggccctaacgtccgtccttccccgtggcccgtcccgtgccgtccgaggacgccacccgtaccgacgaaccgtaccgacggccggtcccgtgggtccg

SEQ ID NO: 48053 - DNA, 767 bp, Homo sapiens
  misc_feature: GYAE6OF02FXEQV.16.28.C06.1.454.CMB.1.raw
  modified_base (216)..(216): a, c, t, g, unknown or other
  misc_feature (216)..(216): n is a, c, g, or t
  modified_base (282)..(282): a, c, t, g, unknown or other
  misc_feature (282)..(282): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaaccgggggggtccctgagactctcctgtgcagcctctggacttccccctttaccacatatgccatgggctgggtccnccaggctccgaggggaagggctgggagtgggtctcgactttattaagtggtagttggtagtactanatactacgcagactccgtgaacggccgttcaccatctccagagacaaactcccaaagaaccacggtctacgtattcctaggactaaacgtaggaccggtacctggacggacgtaccgaacggacgaccggtaccttagtaacgttacgtgtccggacccgggtaaggggtacggtttttacattacgtaattagttaacgttaggttaaacgtaaaaagggtacttaactttaggtaactacggtcggggacccgtaacgggtaacccttcgggtaccctacccggttccgttcccgttaccaccggtaccccttaccccgaaccggaaaacccgggtacccctccggttaccccggtttcccctttacccccggtccgtccccggtaccctcccgaccgtacccggaacggtccgtacccgtaacccgttaccggaacgaacccgaccggtaccgggcccggtccccggtagggtccctaccgg

SEQ ID NO: 48054 - DNA, 675 bp, Homo sapiens
  misc_feature: GYAE6OF02JK9V5.16.28.C06.1.454.CMB.1.raw
  modified_base (389)..(389): a, c, t, g, unknown or other
  misc_feature (389)..(389): n is a, c, g, or t
  modified_base (492)..(492): a, c, t, g, unknown or other
  misc_feature (492)..(492): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttacacatatgccatggctggtccgccaggctccgagggaagggctggagtgggtctcacttatagtgtagtggtagtactacatactacgcagactccgtagaagggccgttcaccatcctcagagacaactcccaagaacacgctgtactctgacaaatgaaccggcctagagacgccgaggacacgggtcctatattacngtcgcccgagggtacgtttaactagtgtatagttactaggttaaaactaaaacgggtacttacttagactaacgtcgggtaccaagggtaccctagggtaccncccgtactccctacacgaccctaccgaacccgaaacgggtccccaacgttcccggttacccgtttcccccgtcgggccccgtcccgttccggacccgtacccgtaacggaccgacccgtaaccccgttaacccggaaccgtaaaccgaacctaccgggaccccgggcccgttacggggtcccg

SEQ ID NO: 48055 - DNA, 595 bp, Homo sapiens
  misc_feature: GYAE6OF02G5JSX.16.28.C06.1.454.CMB.1.raw
  modified_base (468)..(468): a, c, t, g, unknown or other
  misc_feature (468)..(468): n is a, c, g, or t
  modified_base (593)..(593): a, c, t, g, unknown or other
  misc_feature (593)..(593): n is a, c, g, or t
tcagtgtactactccacgaccggtgctcgatttagagctcacgtattgggtttggggggaagaggaagactgacggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccgttcaccatctccagagacaatcccaagaaccacgctgtatctgcaaatgaacggcctgagagcccgaggacacggccgtatattactgtgcccgagggaggttttactatgatattactggttaacaaaaaagggtactactttagactacgtgggccagggaaccctggtcaccgtctcctcacgcctccaccaacgggcccatccggtccttccccctggccgccctgcctccaggcnccgaccctccgagaaccacacgccggtcccgtgggcctgccgtcggtaccgaacggtaccttaccgttccgtagttacgtaccacgtcggaacggccggacgtgggacacgggcctacgagtagnac

SEQ ID NO: 48056 - DNA, 726 bp, Homo sapiens
  misc_feature: GYAE6OF02IC51A.16.28.C06.1.454.CMB.1.raw
  modified_base (658)..(658): a, c, t, g, unknown or other
  misc_feature (658)..(658): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggacttcccctttacacatatgccagtgggctgggtccgccaggcctcgaggggaagggctgggagtgggtcctctacttagttagtggtagtggtagtactacatacgtacgacagtactcgaggacgggtccgttacacatcctaccagacgaacaactaccgaaagaacacgtctgtactctagacaaagtcgaacgctagacgagccgaggaccacggtactaattacttacgtgtcgaccggtagggttacgtttatgtagtaatattacgtaagttaaaacgtaaaaggttctttaagtacgtaactacgggtaccgggaacgaacgggtacccgttggtacccgtaacgtcctaccgtacaccggtaccctacccgaaccggtaaccggaccccgttaacgttccccggttacccgttcccccgtcgggtaccccgtccccgttaccggtaccccgtaacggaacccgggtaccnccccggttaaacccgccggtaaaccgaaccgaccggtacccgggtacccggtcccggtacgggtcccg

SEQ ID NO: 48057 - DNA, 881 bp, Homo sapiens
  misc_feature: GYAE6OF02G92NX.16.28.C06.1.454.CMB.1.raw
  modified_base (210)..(210): a, c, t, g, unknown or other
  misc_feature (210)..(210): n is a, c, g, or t
  modified_base (288)..(288): a, c, t, g, unknown or other
  misc_feature (288)..(288): n is a, c, g, or t
  modified_base (344)..(344): a, c, t, g, unknown or other
  misc_feature (344)..(344): n is a, c, g, or t
tcagtgtactactccacgaccggtgctcgatttagagctcacgtattgggtttggggggaagaggaagactgacggtccctgagactctcctgtgcagcctctggtactttcccctttaccacatatcgccagtgggcgtcgggtccgccaggcctccgagggaagggctggagtggtctctacttattaggtggtagtggtagtactanatactacgcagaccgtcgtggaacgggtccgttcaccatcctcaagagaacaactccaaagaaccacgctgtattcgngtaacaatacggaacgcgtagagacgcgaaggtacgacggtacctattacttacgnggtaccgaccggaggggttagtttttacgagtgtaatacgttacgttaaggttaaaacgaaaaagggttacttaacgtttacgaacgttcggtacggggaccttaaccggggaaccctcgggttacctacccggttacttaccccgtacgtaccggtacccccttacggaaacccggtaaccgggtaccccgtaaggttcccccgtttacccccggttttccccccggtaacgggttccccgtcccggttacccggtcccgtaaccggtaacgggtacccggtacccgttaaccccgttaacccggaaaccggaaccttaaacccgggtaccggaccccggggttacccggtaccgggtcccggtaccgggttcccggttttacggaaccgttaaaccgggtacccgtttaaccggttaccgggttaacgtttacgggtaaccccgtttagggaacccggtacggggttaccccgggaccggtttaacgggaccgggtaaacgggtaccccggtacctttaaagggcgttaccggcg

SEQ ID NO: 48058 - DNA, 775 bp, Homo sapiens
  misc_feature: GYAE6OF02FRZYS.16.28.C06.1.454.CMB.1.raw
tcagtgtactactccacgaccggtgctcgatttagagctcacgtattgggtttgggctgagttggcttttcttgtggctattttaaaaggtgtccagtgtgaggtgtacttggtggagtctggaggaggcttgacccaggccggggggtccctgagactctcctgtgcagccttcgtgggttcagcgtcagtaacaaccacgtgattggtgggtcccgcacgccgtaccgaggggaaggggctgggaagtgggtctcgaagtttatagaaaatgattggcgtacatatctaccggaccgacctccggtaggaacggccgtacttccgactacgtcctaccgaggaacgtaaccaacgtttaccgaaaacgaaccgtaacgggtagtaaacttacgtaacctaaaagtaccgtaacacgtaccgttaaggaaccgtaaaccggagggaacgtaccggtacggttaactttagtttaacgtttagttaacgtttaggtttagttacgggttaacgggtttaacgttcccggggaccggtcggggtaacccgtaacggggtaaccgggtcgtaccgtaccgttccgtaccgtacgaccgtccctaccgtaccgaccggtaccaccgttccgtcccgttaccccgcggtccgccggttaccgccgttaccgacgaccgtaccgtacccgttacggaccgtacggaccaccgacggcccggtaccggtacggtccgtaccgcgttacgcgtaaaccggccgtacgtacggtacgtaccgg

SEQ ID NO: 48059 - DNA, 894 bp, Homo sapiens
  misc_feature: GYAE6OF02F3B1Z.16.28.C06.1.454.CMB.1.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (334)..(334): a, c, t, g, unknown or other
  misc_feature (334)..(334): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggcccgggggggtccctgagactctcctgtgcagcctcgtaggacttccccctttacacatatgccagtgggctgggtccncaggctcgaggggagggctggngtggtctctacgttattagtggtagtggtacgtactagactactacgcagactccggtaggacgggtccgttaccacctatcctaccagganaacctaactaccccgaaagaacccacggtacttacgtatcgtcgtaacaaaagttcgggaaacccggtccgtaaggacggtaaccggaccggaagggtaacccgtaccggggtacctttaagttacttaccgtaggggtttcccgggaccccggggttaagggggttttaccgttttaacgtagttaacggtaatttaacggtttaccgtttaaagggttaaaaccggttaaaaaacggggttacctttaaacggttttacggtaacgttaccggggtacggggtaccggtaaaccggggtaaccccgttaggttacccctaacccgggtttaccttaccccgtacccggtacccgtaccccgtacccgtaaaccccgggaaccccggtaaccccggttaacccgtttccccgggttacccccgtttacccccggtccgggtaccccggttacccccgccggttacccgttaccccggaacggggtacccgtccccggtaaccccgtaccggaacccgaccgaacggtaccccgggcccggtcccggttacccggtcccg

SEQ ID NO: 48060 - DNA, 756 bp, Homo sapiens
  misc_feature: GYAE6OF02IDUDM.16.28.C06.1.454.CMB.1.raw
  modified_base (335)..(335): a, c, t, g, unknown or other
  misc_feature (335)..(335): n is a, c, g, or t
tcagtgtactactccacgaccggtgctcgatttagagctcacgtattgggtttgggctgagttggctttttcttgtggctattttaaaaggtgtccagtgtgaggtgcaactgttgggagtctgggggagccttggtacaggcccgggggggtccctgagactctcctgtgcagcctctggacttcccctttaccacatatgccagtggggctcggggtccgccaggctccgaagggggaggggctgggagtgggtctcacttattaggtggtagtggtagtactacatactacgcagactccgtaggaacggtccggttcaacatctccagganaacaactacccaaagacacgtctgtatctgactaaatcggaaccggtctaggaagacgaccggaaggtacccgaacgggtccgttaaatacgtttaacgtcgggtacgacccgggtaagggttaacggttttacagtacgtaatttactaacgttaaggttaaaaccgtaaaaaggttacttacgtttagtaaccgttacggtcgggtaaccgtaaccgggaaccgttcggaaccgttacccgttccgtcctccgaccgtccctacccgaaccgaaccgggtccctacgttcccggttacccttccccggtacggtccccgacccgttcggtacccgtacccggaacggtacccggaccctaacccggtaccgtaaccgaaccgtaaccggacccggtcccggtacccggttaccgggtcg

SEQ ID NO: 48061 - DNA, 711 bp, Homo sapiens
  misc_feature: GYAE6OF02G9NJS.16.28.C06.1.454.CMB.1.raw
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctgagactctcctgtgcagcctctggacttccccctttaccacatatgccagtgggctgggtcccgccaggcctccgaggggagggctggaggtcgggtctctacttattagtggtagtggtagtactacatactacgcagacctcgtaggaacgggtccggttacaccatcctaccgagacgacaactacccaaagaaccacgtctgtactcgtagactaagtcggaaccgctaggacgacggaccgagggaccgaccggtacctaagtcttaacgtcgtaccgacccggggtagggttacgttttactagtagtacttattacgttaggttaaacgtaaaagggttacttaacgtttacgaacgttacgtacggggaccgtaacgggtacccgttacggtaccgtacccgttcctacccgtacgtaccgtcccgtacccgtaaccgaacccgggaccctaccgttcccgttacccgttccccgtcggcccgtcccgtcgccgtccggacggacgcccgttaccacggaacaccgcggaccgcccggcgtcggtccg

SEQ ID NO: 48062 - DNA, 1077 bp, Homo sapiens
  misc_feature: GYAE6OF02ILAH8.16.28.C06.1.454.CMB.1.raw
tcagtgtactactccacgaccggtgctcgattttagagctcacgtattgggttttgggctgagttggctttttcttgtggctattttaaaaggtgtccagtgtgaggtgcaactgttgggagtcgtgggggagccttggtaccaggcccgggggggtccctgagacctctcctgtgcacgtcctcttggtactttccccccttttaacccacattactgaccctagttggggcgttcggggtcccgaccacgggtcctacccgaagggggaacggggtcgtagggtagggttcgggtacctttaccgtaaccgtttagtttaggttacggggttacggttagggttaacgtttaaccgtaaactacttaaacccttaaccggtaccaaacggaccgtttcccccgggttaagggggtaaaaccggggttccccggttaacctaaccccctacgtttccccctttaccccgggaaagtaacccggaaacctaaacccgttaaacccccggaaaaccggaacccacccgggttaccgtttaggtttaacgtaccggtttacgaaacttaaaacgtacggtaaccggggtacccttaacgggacggaacggacccggtaacggggtaaaccggaccccggttaaccggtttaacgtttaacgttttaccggttcggtacccgggtacccccgggttaagggggtttaaccgttttttaaccgttaacggtttaggtaactttaaccgttttaaccggtttaacgggtttaaaaaccggtaaaaaacgggtttacccgttttaacgtttaagtaacccgggttaccgttaccgggggtaccggtaacccggggttaaacccttaccgggtaccggttccccgttacctacccgttcgtaaccccgtacccgtacccgtaacccggtaaccgggttccctacccggttaccggtccccttttaccccgggtccgtcccgtacccgttccgtacccgtaccgtaaccgggacccggtacccgtacccgaccgttaccgaaccgtaccggtacccggtacccggtcccgggtaccggttcccgg

SEQ ID NO: 48063 - DNA, 774 bp, Homo sapiens
  misc_feature: GYAE6OF02JZ3VW.16.28.C06.1.454.CMB.1.raw
  modified_base (265)..(265): a, c, t, g, unknown or other
  misc_feature (265)..(265): n is a, c, g, or t
  modified_base (359)..(359): a, c, t, g, unknown or other
  misc_feature (359)..(359): n is a, c, g, or t
  modified_base (412)..(412): a, c, t, g, unknown or other
  misc_feature (412)..(412): n is a, c, g, or t
tcagtgtactactccacgaccggtgctcgatttagagctcacgtattgggtttgggctgagttggctttttcttgtggtctattttaaaaggtgtccagtgtgaggtgcaactgttggagtctggggagccttggtacagccggggggtccctgagactctcctgtgcagcctcgtggattcaccttttagtgtcctatcgccgatgagcgtgggtcccgccaggcctcgaagggaaggggctaagagtcgggtctacaacgtancaacgaagcaggtagtacggtaccgcagtggtaacgctaggaccgttccggaggtaaccgggtccgtttaccaaccctagtccgtaccaagtanaaccgttactaccgaaacgacaccgtcttaagttactttgaactaaacggtanaacctagtactaggaacgtaggtcgaacggtacgaacggactaattattacgttaacgtgggtaagaccggtaagtacggggtaagttggttacggggcggttagtaccgttgttaacttaggttacgacggttaggtccggggtaccgaaccggtaccgttcggtcccgtacgttcccttaaccgaccgacctacccgtaccggtaaccccggtaaccggtccccgttaaccgggtttcccgttaccccccggtttcccgtcgggtcccccggttcccgtaccgttcccgacccggtaacggttacccggaccgttaccccggaacggtaaccggaacccttacgcccgggtaacccccgg

SEQ ID NO: 48064 - DNA, 795 bp, Homo sapiens
  misc_feature: GYAE6OF02H4CBG.16.28.C06.1.454.CMB.1.raw
  modified_base (231)..(231): a, c, t, g, unknown or other
  misc_feature (231)..(231): n is a, c, g, or t
  modified_base (712)..(712): a, c, t, g, unknown or other
  misc_feature (712)..(712): n is a, c, g, or t
  modified_base (785)..(785): a, c, t, g, unknown or other
  misc_feature (785)..(785): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctagagactctcctgtgccacgcctcgtggtactttccccctttaaccacatagtgaccagtggggcttggggtcccnccgaggtcctaccggagggggaacggggcgtggaggtgggtcctctacttagttaggtggtaggtggtagtaactactatactacgcagaccttccgtaggaacgggccgttacactactcctacaagaacgaacctaactaccccgaaagaaccgaacggctttagaacttcgtacgaaccgtaaagttaccgggaaacggtcctaggaacggtacggacccgaagggaccaccggggtacttaattacgttacgtggtaccgacccggggttagggtttaacgtttacagttattaacgttaacgttacgtaaacgggtttaaaacgtaaaaacggttcttacgttagtaccgttacggtacggggacccgtaaccggggtaccgttcggtacctaacccgtctacctcgaccgtacccacccgaaacggacccggcccttaccgttcccggttccctaccccgtcggaccctcccgtntacccggacggtaaggaccctacccggaccctaacccggaacgtaaccgaccggtacccgccgggttacccgngggttacccg

SEQ ID NO: 48065 - DNA, 596 bp, Homo sapiens
  misc_feature: GYAE6OF02GJZPU.16.28.C06.1.454.CMB.1.raw
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (402)..(402): a, c, t, g, unknown or other
  misc_feature (402)..(402): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
  modified_base (535)..(535): a, c, t, g, unknown or other
  misc_feature (535)..(535): n is a, c, g, or t
  modified_base (557)..(557): a, c, t, g, unknown or other
  misc_feature (557)..(557): n is a, c, g, or t
  modified_base (577)..(577): a, c, t, g, unknown or other
  misc_feature (577)..(577): n is a, c, g, or t
  modified_base (591)..(591): a, c, t, g, unknown or other
  misc_feature (591)..(591): n is a, c, g, or t
tcagtgtactactccacgaccggtgctcgatttagagctcacgtattgggtttgggctgagttggctttttcttgtggctattttaaaaaggtgtccagtgtgaggtgcaactgttggagtctggggggagccttgggtacaggcccggggggggtccctgagactctcctgtgcagcctctggattccccctttaccacatatgccatgggctgggtccgccaggctcgagggagggctggagtgggtctcacttagtagtggtagtggtagtactacatacacgcagactccgtgaacgggtccgttcaccatcctccagacgacaactaccaagacacnctgtatctnacaaatggaacgctaggacgacgccgagaccacggaccgtattacttacgngtcgacccggtagggtacgttttacatagtatatacgtagtaaacgtaaaagtactacttgactacgtcgggcgtacggacctgtaccnccgtctccnctcgcctaccacgacgcctagtccgtcctccccgngccgcctcgccgtccgacggcncctaccgaccgacgtaaccncgacgcccggtcgnggtcg

SEQ ID NO: 48066 - DNA, 873 bp, Homo sapiens
  misc_feature: GYAE6OF02FP7AW.16.28.C06.1.454.CMB.1.raw
  modified_base (321)..(321): a, c, t, g, unknown or other
  misc_feature (321)..(321): n is a, c, g, or t
tcagtgtactactccacgaccggtgctcgatttagagctcacgtattgggtttgggctgagttggctttttcttgtggctattttaaaaggtgtccagtgtgaggtgcaactgttggagtctgggggagccttggtacaggccgggggggtccctggagcctctcctgtgcagcctcgtggactttccccctttaccacatatcgccagtcgggctgggtccgccaggctccgaggggagggctggaggttggtctctactttagttaggtggtacggttgggtaacgtaccgtatagttactacgcagaccgttaccggnggaaccgggtccggtttccaacctactccgtaccgacggacgactaactacccaaaggaacctcggcgtagtacttccgtagactaaacgttcggaaccggtccgtaggaacggtaccggaccccgggtaaggaacccggtacccggtacgttaacttaccggtttaaccggtcggtacccggtaaccgggtaggggtttttaacgtttaaccgtagtaggtaactttaacgttaaccggtttaagggttaaaaaccggtaaaaacgggtttaccgttttaaaccgttacgtaaacgtttaccgggtaccggggtaacccggtaaaccgggtacccgttacgggacccgtacccgttaccctcccgtacgtaacccgtccccgtaaccggtaaccccgaccgggtaccccgtaccggtttacccggtcccccgttttacccccgagggttcccccgtcccgttccgacccgtaacccggaccgtaccggccccgttaaccgtccgaaccggtaacccaggacccggtcccggtacccgggttacgggtcccg

SEQ ID NO: 48067 - DNA, 658 bp, Homo sapiens
  misc_feature: GYAE6OF02GUXLX.16.28.C06.1.454.CMB.1.raw
  modified_base (195)..(195): a, c, t, g, unknown or other
  misc_feature (195)..(195): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (605)..(605): a, c, t, g, unknown or other
  misc_feature (605)..(605): n is a, c, g, or t
tcagtgtactactccacgaccggtgctcgatttagagctcacgtattggtttgggctcgagttggctttttcttgtggctattttaaaaaggtgtccgaagtcgtgaggtcgcaactgttggagtctggggagccttggtacagccgggggggtccctgagactctcctgtgcagcctctggacttccctttacncatatagccatggctgggtccgccagctcgagggaggctgagtggtctcattagtagtggtacgtggtagtactacatactacgacagacctccgtaggacgggtccgttcaaccatctactagagacatcccaagacacgcctgtactctgactaancgaacggtccnggtagcgcccgagactaccggacgttatattacgtgacgcccggaagggttaggttttacaagttagtattacttacgttaggtaaacgtaaaaacgggttactacgtttacgtacgtaccgtgggaccgtaacggtacccgtggtcgtaccgtctcctctactacccgtccaaccgtacggtaccctacgtccgttcccgttacccgcgtccgtaccgtccgtaccgtccgtacggaccncccgaaccgtccgaacgacgtaaccggaccgtcccggtaccgtcggtacccgg

SEQ ID NO: 48068 - DNA, 830 bp, Homo sapiens
  misc_feature: GYAE6OF02IWGM4.16.28.C06.1.454.CMB.1.raw
  modified_base (768)..(768): a, c, t, g, unknown or other
  misc_feature (768)..(768): n is a, c, g, or t
  modified_base (799)..(799): a, c, t, g, unknown or other
  misc_feature (799)..(799): n is a, c, g, or t
  modified_base (823)..(823): a, c, t, g, unknown or other
  misc_feature (823)..(823): n is a, c, g, or t
tcagtgtactactccacgaccggtgctcgatttagagctcacgtattgggttgggctgagttggcttttcttgtggctattttaaaaggtgtccagtgtgaggtgcaactgttggagtcgtgggggagccttggtacaggcccggggggtcctgagactctcctgtgcagcctctcggtacttccccctttaccacatactcggccagtggggccgtcggggtcccgcccgagggcccgtaccggaagggggaacggggtcgtcgggtagggtcgggtcctcgtaacttagttagggttgggttaggttgggttaacggttacctaactaacttaaccgttaccggaccgaacggtacccgtacccgggtagggtaaacccgggggtcccggggtttacccaaccccgtagttcccgtaccgaacgggtaaccgtaacccaaaccggttacccccgaaaaaggaacccgtacgtaccgttacggttaactccgtaacgaaccgttaaacgggacggtaaccgggtacctagggaaaccggcggtacccgggaaacggtacccgacggggtacctttacgtaacgtttacgtcgggtaccggaccggggttaacggttagttttaaccagtcttaagttactacgtacggttaaaacgtaaaggttacttattacggactaacggtcggaccgtacggaccgtggacctcgtcaccgtcgacgccctcacggccgtcctacgttcccgtaccttccgcgtccctcccgngtcccgcgacggccctcgacccgtcggaacnccgaaccgtggaccccggtccggngtacccg

SEQ ID NO: 48069 - DNA, 585 bp, Homo sapiens
  misc_feature: GYAE6OF01BK54O.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccacctctcctgcagggccagtcagagtgttgccgactccttggcctggtaccaaacaaaacctggccagcctccaggctcgtcattcatggcacatccaacaggccactggcactcccaggcaggtcaggtggcagtgctcgtgggacagacttcactctacacgatcagcagtcgtcacctgacgtatttcgacttagtttatactgtacagtcgtaacgtcggccgtccgtggaccttacgtccctaaccgtttccgggaccctaaacggggtcctacggtaaccgtagggaacgtaacgtaacggtaaaacccggtacgttcggtacgggaccttacggaccctaacccgtaagtttccttcggttcctttacccg

SEQ ID NO: 48070 - DNA, 496 bp, Homo sapiens
  misc_feature: GYAE6OF01C8JR6.23.23.C01.1.454.CMB.1.raw
  modified_base (201)..(201): a, c, t, g, unknown or other
  misc_feature (201)..(201): n is a, c, g, or t
  modified_base (427)..(427): a, c, t, g, unknown or other
  misc_feature (427)..(427): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcaagggganagagccaccctctcctgcagggccagtcagagtgttgccgactccttggcctggtaccaacaaaacctggccagcctccaggctcgtcattcatggcacatccaacagggccactggcatcccaggcaggttcagtggcagtggctctgggacagacttcactctcacgatcagcagtgtcgaccctgacgtattttgctagtttattactgtcagcaacgtggcncctggcctatcaccttcggccaagggctcgactggagatagaaagactgtggctgcaccatctgtcttc

SEQ ID NO: 48071 - DNA, 499 bp, Homo sapiens
  misc_feature: GYAE6OF01CN9WG.23.23.C01.1.454.CMB.1.raw
  modified_base (201)..(201): a, c, t, g, unknown or other
  misc_feature (201)..(201): n is a, c, g, or t
  modified_base (482)..(482): a, c, t, g, unknown or other
  misc_feature (482)..(482): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctctgggacagacttcactctcacgatcagcagtgtcgaccctgacgtattttgctagtttattactgtcagcaacgtggcgtcctggcctatcaccttcggaccaagggcctcgactggagagtgaaacgactgngctgcacatctgtcttc

SEQ ID NO: 48072 - DNA, 507 bp, Homo sapiens
  misc_feature: GYAE6OF01D2AV5.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcatcccaggcaggtcagtgcagtggctcgtgggacagacttcactctcacgatcagcagtcgtcgaccctgacgtatttgactagtttatactgtcagcaacgtggcgtcctggcctatcaccgttcggactaagggctcgacgtggagtagtcgaaacgacgtggtacgctgaccacatctgtcttcg

SEQ ID NO: 48073 - DNA, 495 bp, Homo sapiens
  misc_feature: GYAE6OF01C62JJ.23.23.C01.1.454.CMB.1.raw
  modified_base (201)..(201): a, c, t, g, unknown or other
  misc_feature (201)..(201): n is a, c, g, or t
  modified_base (427)..(427): a, c, t, g, unknown or other
  misc_feature (427)..(427): n is a, c, g, or t
  modified_base (477)..(477): a, c, t, g, unknown or other
  misc_feature (477)..(477): n is a, c, g, or t
  modified_base (489)..(489): a, c, t, g, unknown or other
  misc_feature (489)..(489): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctcccaggctcgtcattcatggcacatccaacagggccactggcatcccaggcaggttcagtggcagtggctctgggacagacttcactctcacgatcagcagtgtcgaccctgacgattttgctagtttattactgtcagcaacgtggcnctggcctatcaccttcggaccagggctcgactggagatagaaacgatggnggctgcacatcngtctac

SEQ ID NO: 48074 - DNA, 500 bp, Homo sapiens
  misc_feature: GYAE6OF01C7UXF.23.23.C01.1.454.CMB.1.raw
  modified_base (200)..(200): a, c, t, g, unknown or other
  misc_feature (200)..(200): n is a, c, g, or t
  modified_base (345)..(345): a, c, t, g, unknown or other
  misc_feature (345)..(345): n is a, c, g, or t
  modified_base (464)..(464): a, c, t, g, unknown or other
  misc_feature (464)..(464): n is a, c, g, or t
  modified_base (492)..(492): a, c, t, g, unknown or other
  misc_feature (492)..(492): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattctttgacacagtctccagacatcgtgtctgtgtctccagggganagagccaccctctcctgcagggccagtcagagtgttgccgatccttggcctggtaccaacaaaacctggccagcctccaggctcgtcattcatggcacatccaacagggccactggcatcccaggcaggtcagtggcagtggctntgggacagacttcactctcacgatcagcagtgtcgaccctgacgtatttgctagtttattactgtcagcaacgtgcgcctggccctatccaccgttcggccagggactcggactggganagtgaaacgacgtgtggctgcaccatcngttctacg

SEQ ID NO: 48075 - DNA, 516 bp, Homo sapiens
  misc_feature: GYAE6OF01B6638.23.23.C01.1.454.CMB.1.raw
  modified_base (201)..(201): a, c, t, g, unknown or other
  misc_feature (201)..(201): n is a, c, g, or t
  modified_base (477)..(477): a, c, t, g, unknown or other
  misc_feature (477)..(477): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctcccaggctcgtcattcatggcacatccaacagggccactggcatcccaggcaggttcagtggcagtggctctgggacagacttcactctcacgatcagcagtgtcgaccctgacgtattttgctagttttattactgtcagctaacggtggcgcctgggccctatcccaccttcggaccaacgggtctcggactggganagtggaaacgtacgtggtcggctgaccaccatctgtctc

SEQ ID NO: 48076 - DNA, 545 bp, Homo sapiens
  misc_feature: GYAE6OF01BGSEQ.23.23.C01.1.454.CMB.1.raw
  modified_base (201)..(201): a, c, t, g, unknown or other
  misc_feature (201)..(201): n is a, c, g, or t
  modified_base (351)..(351): a, c, t, g, unknown or other
  misc_feature (351)..(351): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcactcccaggcaggttcagtggcagtggctcgngggacagacttcactctcagatcagcagtcgtcgaccctgacgtatttgctagtttatactgtacagtcaacgtggctccgtggcccttatcctaccgttcggacctaaggggacctcggaacgtcgggaagtagtacggaaacggacgttggtcgggtactcggtacctaaccgtattccttggttccttacg

SEQ ID NO: 48077 - DNA, 559 bp, Homo sapiens
  misc_feature: GYAE6OF01AD25F.23.23.C01.1.454.CMB.1.raw
  modified_base (202)..(202): a, c, t, g, unknown or other
  misc_feature (202)..(202): n is a, c, g, or t
  modified_base (434)..(434): a, c, t, g, unknown or other
  misc_feature (434)..(434): n is a, c, g, or t
tcagacgcgagtatcacgaccggtgctcgatttagtacacgtgattagggattgggggagggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctcccaggctcgtcattcatggcacatccaacagggccactggcatcccaggcaggtcagtgcagtggctcgtgggacagacttcactctcacgtatcagcagtcgtccgaccctgacgtattttgctagtttacttactgtcagcgaacgtgggcncctggccctatcctaccgttcggacccgtaagggcccttacggacgttcgggaagtacttacgggaaacccgtaacgttggcgggtacccttgggaccctacctaagttcctggttcctttaccg

SEQ ID NO: 48078 - DNA, 499 bp, Homo sapiens
  misc_feature: GYAE6OF01B8KPM.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacagggccactggcatcccaggcaggttcagtggcagtggctctgggacagacttcactctcacgatcagcagtgtcgaccctgacgtatttgctagtttattactgtcagcaacgtgcgcctggcctatctaccttcggccaagggctcgactggagagtagaaacgacgtgtggctgcaccatctgtcttcg

SEQ ID NO: 48079 - DNA, 514 bp, Homo sapiens
  misc_feature: GYAE6OF01B6PG9.23.23.C01.1.454.CMB.1.raw
  modified_base (474)..(474): a, c, t, g, unknown or other
  misc_feature (474)..(474): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaagggctcgagtggatgggctgagtgagtcctagtgttgagaataccgggcattctcagaagttcaaggccaaggctcagcctgacctggaacacttcagaagaacagcccatttggaactgcgcgcctgacctctgacgacacggccgtgtattattgtgcgagaggcggaggccgngagttttggaatattagtggtatggacgtgtgggtaccgg

SEQ ID NO: 48080 - DNA, 603 bp, Homo sapiens
  misc_feature: GYAE6OF01AGD9Z.23.23.C01.1.454.CMB.1.raw
  modified_base (309)..(309): a, c, t, g, unknown or other
  misc_feature (309)..(309): n is a, c, g, or t
  modified_base (396)..(396): a, c, t, g, unknown or other
  misc_feature (396)..(396): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacngggccactggcatcccaggcaggttcagtggcagtgctctgggacagacttcactctcacgatcagcagtcgtccgaccctgacgtnttttcgctagtttattactgtcagtcaacggtcggcgtccgtcgggacccttacgttccctacccgtttccgggacccgtaaacggggtacccttaccggaccgttaggggaaacgtaacgttaacgggaaaacccggtaaacgttcgggttacgggtaccgttacggaccctaacccgtaagtttccgttcggttccctttacccg

SEQ ID NO: 48081 - DNA, 495 bp, Homo sapiens
  misc_feature: GYAE6OF01ADOTF.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacagggccactggcatcccaggcaggttcagtggcagtggctcgtgggacagacttcactctcacgatcagcagtgtcgaccctgacgtatttgctagtttattactgtcagcaacgtgcgcctggcctatccaccttcggccaagggctcgactggagagtagaaacatgtgctgcacatctgtcttc

SEQ ID NO: 48082 - DNA, 494 bp, Homo sapiens
  misc_feature: GYAE6OF01A9S93.23.23.C01.1.454.CMB.1.raw
  modified_base (424)..(424): a, c, t, g, unknown or other
  misc_feature (424)..(424): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacagggccactggcatcccaggcaggttcagtggcagtggctctgggacagacttcactctcacgatcagcagtgtcgacctgacgtatttgctagtttatactgtcagcaacgtgcnccgtggcctatccaccttcggaccaagggctcgactggagtagtgaaacgatgtgctgcacatctgtctc

SEQ ID NO: 48083 - DNA, 568 bp, Homo sapiens
  misc_feature: GYAE6OF01D5ZNT.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccttggcctggtaaccaacaaaacctggaccagcctcccaggctcgtcattcatggcacatacccaacgacgggccacgtggaccactcccgaggcaggttcaggtggcaggtggctcgtgggacagtacttcactctcacgatcagctagtcgtcgaccctgacgtattttgacttagttttattacgtgtcagtacgtaacggtggccgtccgtcggcccttagtccctaccgttccgggaccaaggggtcctacggacgtgggaagtacgtacggaaacgacgttggtacggctacgacctaccattccttgtccttacg

SEQ ID NO: 48084 - DNA, 522 bp, Homo sapiens
  misc_feature: GYAE6OF01EK7AO.23.23.C01.1.454.CMB.1.raw
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (506)..(506): a, c, t, g, unknown or other
  misc_feature (506)..(506): n is a, c, g, or t
tcagacgcgagtatcacgaccggtgctcgatttagtacacgtgattagggattggggagggaactagctcagtttggtacccgacgagggaaccgaactggaaggaccccacgctcagcttctcttccttccctcgctcctcctggctcccacgagaccaccggagatattcttttgtacacagtctccagacatcgtgtctgtgtctccaggggaggagagccaccctcctcctgcagggccgagtcagagtgttgccgactccttggcctggtaccaacaaaacctaggccacgcctccccaggctcgtcattcatggcacatccacagggccactggcatcccaggcagttcgagtggcagtggctctgggacanacttcacnctcacgatcagcagtgtcgaccctgacgattttgtcagtttattactgtcagcacgtggcgcctggcctatcaccttcggccgacgggacgtcgactggaggatgaaacgaactgtggcncgcaccatctgtcttc

SEQ ID NO: 48085 - DNA, 595 bp, Homo sapiens
  misc_feature: GYAE6OF01A6B7P.23.23.C01.1.454.CMB.1.raw
  modified_base (205)..(205): a, c, t, g, unknown or other
  misc_feature (205)..(205): n is a, c, g, or t
tcagacgcgagtatcacgaccggtgctcgatttagtacacgtgattagggagttgggggaggaacgtgctcagtttggacccagagggaaccatggaagcccagctcagcttctcttcctcctgctcctctggctcccagagaccaccggagatattcttttgacacagtctccagacatcgtgtctgtgtctaccgaggggganagtacgccctaccctctcctggaccaggggcccaaggttcaagaggttgttgcccgacttccttgggaccctggtaccaacaaaacctggccagcctcccaggctcgtcattcatggcacatccaacagggccactggcatcccagcagttcagtgcagtggctctgggacagacttcactctcacgatcagcagtgtcgaccctgacgtattttgactagtttacttacgtcgttcagcgtaagtcgggcgcccttgggtcccttaatccgtaacccgtttccgggacccgtaaacggggtcctccgacggttcgggaagtacgtacggaaaaccgtaacgtcggtcgggacttcgggaccctaaccgaattcgtacgttcgttaaccg

SEQ ID NO: 48086 - DNA, 562 bp, Homo sapiens
  misc_feature: GYAE6OF01END6G.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgatttaggggattgggggaggaactgctcagtttggacccagagggaaccatggaagccccgagctcagcttctcttcctcctgctcctctggctcccagagaccaccggagatattcttttgacacagtctccagacatcgtgtctgtgtctccagggganagagccaccctctcctgcagggccagtcagagtgttgccactccttggcctggtaccaacaaaacctggccacgcctccaggctcgtcacttcatcggcacactccaacgacgggccactcggcatcccgaggcaggttcaggtcggcagtggctcgtgggacagtacttcactctcacgatcagcagtgtcgacctgacgtatttgctagtttattactgtcagtcaacgtggctccgtggccttatccgtaccgtttcggaccgtaacgggtcctcggacgtcgggaagtacgtacggaaaaccgtaacgttggtacggtctacggtaccctaaccgtattcgttcgttcttaccg

SEQ ID NO: 48087 - DNA, 503 bp, Homo sapiens
  misc_feature: GYAE6OF01APSG9.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctcccaggctcgtcattcatggcacatccaacagggccactggcatcccaggcaggttcagtggcagtggctcgtgggacagacttcactctcacgatcagcagtgtcgaccctgacgtattttgctagtttattactgtcagcaacgtggcgcctggcctatccaccgttcggaccaagggctcgactggagagtcgaaacgactggtagctgcacatctgtcttc

SEQ ID NO: 48088 - DNA, 517 bp, Homo sapiens
  misc_feature: GYAE6OF01CRV4R.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacagggccactggcactcccaggcaggttcagtcggcaggtggctcgtgggacagacttcactctcacgatcagcagtcgtcgaccctgacgtatttgctagtttattactgtcagcaacgtgcgccgtggccctatcctaccgttcggacctaagggacctcggacgtgggagtagtacggaaacgtactggtggctgcacatctgtcttc

SEQ ID NO: 48089 - DNA, 801 bp, Homo sapiens
  misc_feature: GYAE6OF01C7QCL.23.23.C01.1.454.CMB.1.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (764)..(764): a, c, t, g, unknown or other
  misc_feature (764)..(764): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctccagacgaccgaccggagatatttctttgacacagtctccagacatcgtgtctgtgtcctcgaggggagagacgccacctctccngcgacgggccagtcagngtgtcgccgtactccgttggcctacggtaaccaaaacaaaaccgtcggaccacgccctaccgaggtcctcgtctattcaagtcggaccactactacccaaacgacgggacctaacggtcggacctaaccgtccccggaaggccgtaacgggtttccgaagggtcgggaccgtaaggggttcggtaccttcggggtacggggaacctaacggttacctttacccgaacccgtttcctaccgaaacggtacttacccgaacggtaccgtaagggttccggtaaccccggtaacccccgtttagggtaaaaccggttttacgtttttaccgggaaccgttttaaacgggtttttttaaacctttaccggttacgggttaccaacggtaaccgtaaacggggttcgggacccgttccggtacgggtacccttaaccgtacccgttacccggtttccgggaacccggtaaacggggtccctacgggtacggtagggaacgtaacgtaaccggaaaacgacgttgggtacggntaccggaccaaccgttattcgttacgttcttaacccg

SEQ ID NO: 48090 - DNA, 528 bp, Homo sapiens
  misc_feature: GYAE6OF01CXPM1.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacagggccactggcatcccaggcaggttcagtggcaggtggctcgtgggacagacttcactctcacgatcagcagtcgtcgaccctgacgtatttgctagtttatactgtcagcaacgttgcgtcctggcccttatcctaccgttcggacctaaggggacctccggacgtggacgagtacggaaacgtaacgtggtacggctgaccaccattcctgttcttcg

SEQ ID NO: 48091 - DNA, 554 bp, Homo sapiens
  misc_feature: GYAE6OF01EIFXF.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggggagagagccaccctctcctgcagggccagtcagagtgttgccgactcttggcctggtaccaacaaaacctggccagcctccaggctcgtcattcatggcacatccaacgacgggccacgtcggaccactcccgaggctaggttcagtggcaggtcggctcgtgggacagtacttcactctcacgatcagctagtcgtccgtaccctgacgtatttgcttagtttacttactgtcagctaacgtcgcgccgtggcctagtcctaccgttcggaccctaagggacctccggacgtgggaagtagtaacggaaacgtacgtggtcggactcggaccaacctacgttctgttccttacc

SEQ ID NO: 48092 - DNA, 592 bp, Homo sapiens
  misc_feature: GYAE6OF01CNZEO.23.23.C01.1.454.CMB.1.raw
tcagacgcgagtatcacgaccggtgctcgatttagtacacgtgattagggattgggggaggaactgctcagtttggacccagagggaatcatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccttggcctggtaaccaaacaaaacctggaccagcctccaggctcgtcattcatggcacactccaacgacgggcccaacgtggccaactccccgagggccagggttcaggtcggcaggtggctcgtgggacaggtaccttcactctcacgatcagctagtcgtcgaccctgacgtatttcgactagttttatacgtgtcaacgtcaacggttggcctccgtggtaccctacgtcctaccgttccgggaccgtaacgggtcctaccgggaccttgggaacgtaacgtacggaaaaccggtaccgttggtacgggtacctacggacccaccgtatcccgttcgttaccc

SEQ ID NO: 48093 - DNA, 542 bp, Homo sapiens
  misc_feature: GYAE6OF01B56G5.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccttggcctggtaccaaacaaaacctggaccagcctccaggctcgtcattcatggcacactaccaaacgacgggccacgtcggccactccccaggcaggttcaggtggcaggtggctcgtggacagacttcactctcacgatcagcagtcgtcgacctgacgtatttgcttagtttatactgtcagctaacgtcggctcgtggcctatccgaccgttcggaccgaagggcctcggtacgtgggaagagtacggaaacgtacgtggtacggctacggaccacctattctgttccttac

SEQ ID NO: 48094 - DNA, 530 bp, Homo sapiens
  misc_feature: GYAE6OF01AOTPU.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacacgggccactggcatccccaggcaggttcaggtggcagtggctcgtgggacagacttcactctcacgatcagcagtgtcgaccctgacgtatttgctagtttatactgtcagcaacgtgcgcctggcctagtcctaccgttcggacctaagggcctcgacgtggagtacgtacgaaacgaacgttggtacggctacggacctacctattcctgttcttaccg

SEQ ID NO: 48095 - DNA, 499 bp, Homo sapiens
  misc_feature: GYAE6OF01B8BLP.23.23.C01.1.454.CMB.1.raw
  modified_base (482)..(482): a, c, t, g, unknown or other
  misc_feature (482)..(482): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactcctggcctggtaccaaacaaaacctggccacgcctccaggctcgtcattcatggcacatccaacagggccactggcactcccaggcaggttcaggtggcagtggctcgtgggacagtactcactctcacgatcagcagtgtcgaccctgacgtatttgctagtttatactgtcagcaacgtgcgcctggcctatccaccttcggacagggctcgacgtggagagtagaaacagtggngctcgcacatctgtctc

SEQ ID NO: 48096 - DNA, 537 bp, Homo sapiens
  misc_feature: GYAE6OF01DMMPH.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaagggctcgagtggatgggctgggtgagtcctagtgttgagaagtaccgggcattctcagaagttcaaggccaggctacagcctgacctggaacctacttcagaagaacagccattgaactgcgcggcctgacctctgacgacacggccgtgtattattgtgcgagagggcggaggccggtcgtagtttttgggaattagttagtaggttatgggacgttcggtggggccgtaaacggggg

SEQ ID NO: 48097 - DNA, 567 bp, Homo sapiens
  misc_feature: GYAE6OF01ENMMR.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgggagatattcttttgacacagtctccagacatcgtgtctgtgtctccgaggggganagagccaccctctcctgcagggccagtcagagtgttgccgactccttggcctggtaaccaacaaaacctggccagcctccaggctcgtcattcatggcacatccaacgacgggccacgtggcactcccgaggcaggttcagtggcaggtggctcgtgggacagtacttcactctacacgatcagctagtcgtccgaccctgacgtatttgacttagtttatactgtacagtctaacggtggaccgtccgtcggacccttagtcccgtacccgtttccgggaccgtaacgggtcctacggacgtgggaagtacgtacggaaaacgtacgtggtacggctacgaccaactattcttgtccttacc

SEQ ID NO: 48098 - DNA, 559 bp, Homo sapiens
  misc_feature: GYAE6OF01DCNO5.23.23.C01.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (362)..(362): a, c, t, g, unknown or other
  misc_feature (362)..(362): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggganagagccaccctctcctgcagggccagtcagngtgttgccgatccttggcctaggtaccaaacaaaaacctcggccagcctcccaggctcgtcattcatggcacatccaacacgggccactggcactcccaggcaggttcagtggcaggtgctgtgggacngtacttcactctcacgatcagcagtcgtccgacctgtacgtatttgactagttttacttacgtgtacagtctaacggtgccgcctacgggccttagtccctaccgttcggacccgtaaggggtcctcggacgtgggagtaacgtacggaaaccgtgtcggtcggaccttacgacctaccagttccttggtcttaccg

SEQ ID NO: 48099 - DNA, 520 bp, Homo sapiens
  misc_feature: GYAE6OF01B5NJF.23.23.C01.1.454.CMB.1.raw
  modified_base (202)..(202): a, c, t, g, unknown or other
  misc_feature (202)..(202): n is a, c, g, or t
  modified_base (479)..(479): a, c, t, g, unknown or other
  misc_feature (479)..(479): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctggtaccaaacaaaacctggccagcctccaggctcgtcattcatggcacatccaacgaggccactggcactcccaggcaggtcagtggcagtggctcgtgggacagtacttcactctcacgatcagcagtcgtaccgacctgacgtatttgcttagtttatactgtcagcaacgtgcgtccgtgcctagtccaccgttcggaacgagggtactcggacgtgggaanagtacggaaacgacgtgacggctgaccacattctgtcttac

SEQ ID NO: 48100 - DNA, 535 bp, Homo sapiens
  misc_feature: GYAE6OF01CBX45.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacacgggccactggcactcccaggcaggttcagtggcagtggctcgtgggacaggacttcactctcacgatcgagcagtcgtcgaccctggacgtattttgctagttttatacgtgtcagctaagtggccgcctaggcccttatccgaccgttcgggaccaagggcctcgacgttggaagagtacggaaacgacgttggtgcctagccaactagttctcgttctttacc

SEQ ID NO: 48101 - DNA, 597 bp, Homo sapiens
  misc_feature: GYAE6OF01AU07B.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctggtaccaaacaaaacctggccagcctccgaggctcgtcattcatggcacactccaacgacgggccacgtggacacgtcccgaggcctaggttcaggtcggcgaggtcggctcgtcgggacagtaccttcgactctcacgactcagcagtcgtacgacctgacgtatttcgacgttagtttacttacgtgtactacgacgtaacggtcggcgtccgtacggtcccttacgtcccgtaccgttaccggaccgtaacgggtcctacggtacgtacgggaacgtaacgtacggaaacgtacgttcggacggcgtacggcctaaccgtattcgttcgttccgttaccg

SEQ ID NO: 48102 - DNA, 536 bp, Homo sapiens
  misc_feature: GYAE6OF01BW6ER.23.23.C01.1.454.CMB.1.raw
  modified_base (201)..(201): a, c, t, g, unknown or other
  misc_feature (201)..(201): n is a, c, g, or t
  modified_base (395)..(395): a, c, t, g, unknown or other
  misc_feature (395)..(395): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcatcccaggcaggttcagtggcagtggctgtgggacagacttcactctcacgatcagcagtcgtcgaccctgacgtntttgactagtttattactgtacagtctaacggtggcgccgtcggtcctacgtccacccgttcggaccaacgggctccgacgtaggagagtaggaaacgacgttggtacggctacgacctaccgattccgtcgttcttaccg

SEQ ID NO: 48103 - DNA, 559 bp, Homo sapiens
  misc_feature: GYAE6OF01CQP0M.23.23.C01.1.454.CMB.1.raw
tcagacgcgagtatcacgaccggtgctcgatttagtacacgtgatttagggagttgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccaagtcagagtgttcgccgtactccttggcctaggtaaccaaacaaaaacctggccacgcctaccaggctcgtcattcatggcacataccaacacgggccacgtcggcacgtcccaggcaggttcagtgcagtggctgtgggacagacttcactctcacgatcgagccagttcgcgaccctagaccgttattttcgcttaagttttattactgtcagcaacgtgctacctggtcctagtccaccgttcggaccaagggcctcggaacgttgggaatacgtaacgaaacgtacgttggacggctacggtaccaactgttacctgttccttaccg

SEQ ID NO: 48104 - DNA, 518 bp, Homo sapiens
  misc_feature: GYAE6OF01ERXLZ.23.23.C01.1.454.CMB.1.raw
  modified_base (201)..(201): a, c, t, g, unknown or other
  misc_feature (201)..(201): n is a, c, g, or t
  modified_base (495)..(495): a, c, t, g, unknown or other
  misc_feature (495)..(495): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaaacagggccactggcatcccaggcaggttcagtggcagtggctcgtgggacagacttcactctcacgatcagcagtcgtcgacctgacgtattttgctagtttattactgtacagactaacgtggcgccgtggcctagtcctaccgttcggaccgaagggcctcgacgtggagtatacggaaacgactgnggctgaccactatcgtgtcttac

SEQ ID NO: 48105 - DNA, 523 bp, Homo sapiens
  misc_feature: GYAE6OF01AD65V.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacagggccactggcatcccaggcaggttcagtggcagtgctcgtgggacagacttcactctcacgatcagcagtgtcgaccctgacgtatttgctagtttactactgtcagctaagtggcgtccgtggcctatccgaccgttcggaccgagggacctcggacgtgggagacgtacggaaacgtactggtacggctacggccacattctgtcttaccg

SEQ ID NO: 48106 - DNA, 527 bp, Homo sapiens
  misc_feature: GYAE6OF01A3UAA.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaaggctcgagtggatgggctgggtgagtcctagtgttgagaagtaccgggcattctcagaagttcaaaggccaggctcagcctgacctgaacacttccagaagaacagacccatttggaactggcgcggcctgacctctgacgacacggccgtgtattattgtgcgagaggcggaggccgcgtagttttgggaattattagtggtatggacgtcgtggggcctaaacgggg

SEQ ID NO: 48107 - DNA, 610 bp, Homo sapiens
  misc_feature: GYAE6OF01D6IJW.23.23.C01.1.454.CMB.1.raw
tcagacgcgagtatcacgaccggtgctcgatttagtacacgtgattagggattggggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcagggccagtcagagtgttcgccgactccgttggcctggtaaccaaacaaaaacctggccacgccctccaggctcgtcattcatggcacataccaacgacgggccacgtggacactccccgaggacgaggttccagtcggcaggtgctcgtgggacagtactcgactctacacgatcagcagtcgtccgaccctggaacgttatttgactagttttactacgtgtcagctaacggttcgggccgtaccgtcgggtaccctacgtaccgtacccgtttcccgggaccgaacggggtacctacgtacgtagggaacgtaagttacgggaaaaaccgtacgttcggtacggtcgtacggtaccctaaccgtatttcgtcgttcctttaaccg

SEQ ID NO: 48108 - DNA, 557 bp, Homo sapiens
  misc_feature: GYAE6OF01C4UJX.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacagggccactggcatcccaggcaggttcaggtggcaggtggctcgtgggacagtacttcactctcacgatcagcagtcgtccgaccctgacgtattttgactagttttattactgtacagctaaggtcggcgtccgttggcccttagtccaccgtttcggaccgaacgggtcctcggactgggaacgtacgtacgaaaccgagttcggtacgggtacctggaccctaaccgtagttcctgttccttaccg

SEQ ID NO: 48109 - DNA, 584 bp, Homo sapiens
  misc_feature: GYAE6OF01ETUWU.23.23.C01.1.454.CMB.1.raw
  modified_base (201)..(201): a, c, t, g, unknown or other
  misc_feature (201)..(201): n is a, c, g, or t
  modified_base (363)..(363): a, c, t, g, unknown or other
  misc_feature (363)..(363): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaaacaaaacctggccagcctccaggctcgtcattcatggcacactcccaaacgacgggccacgtggcactcccgaggcaggttcaggtgcagtggctccggganacgacttcactctacacgatcagcagtcgcgacctgacgtatttgactagtttattacgtgtacagacaacggtggccgccgtggacccttactccgtaacccgttcgggacccgtaaaggggtcctaccgggacgttacgggagtaacgttacggaaaaccgtacgtggtcggaccttacggaccctaaccgtaacgttccgttcgttccttcgtaaccg

SEQ ID NO: 48110 - DNA, 509 bp, Homo sapiens
  misc_feature: GYAE6OF01AX5Q4.23.23.C01.1.454.CMB.1.raw
  modified_base (202)..(202): a, c, t, g, unknown or other
  misc_feature (202)..(202): n is a, c, g, or t
  modified_base (470)..(470): a, c, t, g, unknown or other
  misc_feature (470)..(470): n is a, c, g, or t
tcagacgcgagtatcacgaccggtgctcgatttagtacacgtgattagggagttgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctcccaggctcgtcattcatggcacatccaacagggccactggcatcccaggtcaggttcagtggcagtggctctgggacagacttcactctcacgatcagcagtgtcgaccctgacgtatttgctagtttattactgtacagcaacgtggcgcctggcctatcaccttcggccaagggacctcgactggganagtcgaaacgactggcgctgccaccatcctgtccttacg

SEQ ID NO: 48111 - DNA, 631 bp, Homo sapiens
  misc_feature: GYAE6OF01DYLHW.23.23.C01.1.454.CMB.1.raw
  modified_base (202)..(202): a, c, t, g, unknown or other
  misc_feature (202)..(202): n is a, c, g, or t
  modified_base (362)..(362): a, c, t, g, unknown or other
  misc_feature (362)..(362): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctggtaccaaacaaaacctggaccagcctcccaggctcgtcattcatggcacactccaacgacgggccacgtggaccactcccgaggcaggttcagtggcaggtgctcgngggacagacttcactcacgacgatcagcagtcgtaccgtacccgtgtaacgtagttttcgaccgttagttttacttaacgttcgtacgtaacgtaccgtaacgggttcgggaccgtacccggttcgggacccttacgttacccgtaacccgtttccgggacccgtaaacggggtaccctaccgggtaacgtgggaacgtacggtaacgaaaaccggtacgttggtacggtccgtacgtacccgaccttacgtccttggtccctttaccg

SEQ ID NO: 48112 - DNA, 584 bp, Homo sapiens
  misc_feature: GYAE6OF01AB6W2.23.23.C01.1.454.CMB.1.raw
  modified_base (281)..(281): a, c, t, g, unknown or other
  misc_feature (281)..(281): n is a, c, g, or t
  modified_base (346)..(346): a, c, t, g, unknown or other
  misc_feature (346)..(346): n is a, c, g, or t
  modified_base (455)..(455): a, c, t, g, unknown or other
  misc_feature (455)..(455): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttcgatatcaactgggtncgacaggcccctggaaaaggctcgagtggatgggctgggtgagtcctagtgttgagataccgggnattctcagaagttcaaggccaggctcagcctgacctggaacacttccagaagaacacgacccagtttcggaactggcgccggacctcgaccctcgtacgtaccgaaccnccgggccgttagtactttagttggttacgcggtaggagggcggaacgggcccgtcggtagtttttaggggaacttaggtttacgtagggttaattcgggagttccggtgggggtaccgtaaaccggggg

SEQ ID NO: 48113 - DNA, 508 bp, Homo sapiens
  misc_feature: GYAE6OF01BVFEC.23.23.C01.1.454.CMB.1.raw
  modified_base (201)..(201): a, c, t, g, unknown or other
  misc_feature (201)..(201): n is a, c, g, or t
  modified_base (421)..(421): a, c, t, g, unknown or other
  misc_feature (421)..(421): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctcccaggctcgtcattcatggcacatccaacacgggccactggcatcccgaggcaggttcaggtggcagtggctcgtgggacagacttcactctcacgatcagcagtgtccgaccctgacgtatttgctagtttatactgtacngcaacgtgcgcctggcctatcctaccgttcggcagggtctcggagtggatagtacgaaacgactggtcgctcgacactatctgtctc

SEQ ID NO: 48114 - DNA, 815 bp, Homo sapiens
  misc_feature: GYAE6OF01CSDYO.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattctttgacacagtctccagacatcgtgtctgtgtctccgaggggagagagccacctctcctgcagggccagtcagagtgttcgccgtactccgttggcctaggtaaccaaacaaaaacctggaccacgcctcccaggctacgtcattcatggcacactaccaacgacgggccacgtggaccacgtccccgaggcgtaacgggttccgaaggtcggaccgtagggttcgggccgttacggttacggggaacctaacggtaccgttttaccaaccgtttccgtacctaaaccggtacttaccgaacggtaccgtaacgggttccggtacccggtaaacccccgttagggtaaacccgtttaagttttttacggaccgttttaaggtttttaactttaaccgtttacggtaccgtaacggtaccgtaaaaccgggttcggggtcccgtacccggttacggggtaccccctttaaacgttccccgtaaccccggttttaccgggaacccggtaaaccggggtacccgttaaccggtaaaccgggttacggggtaaacggtaaccggttaaacgggtaaaaacccggtaacgggtttcgggttaccggggtacgtttaccggaacccgtaacccgtacgtttcccgttaggtttccctttaacccg

SEQ ID NO: 48115 - DNA, 521 bp, Homo sapiens
  misc_feature: GYAE6OF01EUYIJ.23.23.C01.1.454.CMB.1.raw
  modified_base (431)..(431): a, c, t, g, unknown or other
  misc_feature (431)..(431): n is a, c, g, or t
  modified_base (480)..(480): a, c, t, g, unknown or other
  misc_feature (480)..(480): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagcccaccctctcctgcagggccagtcagagtgttgccgactccttggcctggtaccaaacaaaacctggccagcctcccaggctcgtcattcatggcacatccaacgagggccactggcatcccgaggcaggttcagtggcagtggctcgtgggacagtacttcactctcacgatcagcagtgtccgaccctgacgtatttgctagtttatactgtcagcacgtgcnccgtggccctatcctaccgttcggaccgtaagggacctcggactggganagtaggaaacgacgtggcggctcggaccacattctgtctac

SEQ ID NO: 48116 - DNA, 513 bp, Homo sapiens
  misc_feature: GYAE6OF01EEGSZ.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaacagggcccactggcactcccaggcaggttcagtggcagtggctcgtgggacagacttcactctcacgatcagcagtgtccgaccctggacgtattttgctagtttattactgtcagcaacgtgcgcctggcctatcaccttcggccaagggcctcgactggagacgtagaaacgactgcgggctcgacaaccattcctgtcttcc

SEQ ID NO: 48117 - DNA, 577 bp, Homo sapiens
  misc_feature: GYAE6OF01C3PGN.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcagggtccagtcagagtgttgccgactccgttggcctggtaaccaacaaaaacctggccagcctccaggctcgtcattcatggcacatccaacagggccactggacactcccaggctaggttcaggtggcaggtcggctcgtcgggacaggtacttcactctacacgatcagcagtcgtccgaccctgacgtattttgactagttttactactgtactagacctaaggtcgcgtcctgggtcccttatccctaaccgttcggaccgaagggtcctcggtaacgttgggaacgtacgtacggaaaacgtacgttcggtaggaccttacgacctaccgtattccgtagttccttaaccg

SEQ ID NO: 48118 - DNA, 548 bp, Homo sapiens
  misc_feature: GYAE6OF01EURR9.23.23.C01.1.454.CMB.1.raw
  modified_base (232)..(232): a, c, t, g, unknown or other
  misc_feature (232)..(232): n is a, c, g, or t
  modified_base (432)..(432): a, c, t, g, unknown or other
  misc_feature (432)..(432): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagngtgttgccgactccttggcctggtaccaacaaaacctggccagcctcccaggctcgtcattcatggcacatccaacgacgggccactggcatcccaggcaggttcagtgcagtggctcgtgggacagacttcactctcacgatcagctagtgtccgaccctgacgtattttgctagtttatctgtcagctaacgtggccncgtcggcctagtcctacccgttcggaccgaacgggtcctacggacgttgggaagtagtacggaaaacgtaaccgttggtacggcctacggacctacctattccgttgtccttaccg

SEQ ID NO: 48119 - DNA, 541 bp, Homo sapiens
  misc_feature: GYAE6OF01EVZZH.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacgacgggccactggcactcccaggcaggttcaggtggcaggtggctcgtgggacagacttcactctcacgatcagctagtcgtccgaccctgacgtatttgacttagtttattactgtacagcgtaacgtggccgccgtcggccctagtcctaccgttcggacccgaagggtcctcggacgtggagtagtacggaaacgtactgtcggctcggaccacgtattcgtgtcttaccg

SEQ ID NO: 48120 - DNA, 567 bp, Homo sapiens
  misc_feature: GYAE6OF01B2NLM.23.23.C01.1.454.CMB.1.raw
  modified_base (200)..(200): a, c, t, g, unknown or other
  misc_feature (200)..(200): n is a, c, g, or t
  modified_base (388)..(388): a, c, t, g, unknown or other
  misc_feature (388)..(388): n is a, c, g, or t
  modified_base (418)..(418): a, c, t, g, unknown or other
  misc_feature (418)..(418): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctaccagagaccaccggagatattcttttgacacagtctcagacatcgtgtctgtgtctcgagggganagacgccaccctctcctgcagggccagtcagagtgttcgccgactccgttggcctaggtaaccaaacaaaaacctggccagcctccaggctcgtcattcatggcacactaccaacgacgggccacgtggccactcccgaggctaggttcaggtcggcaggtcggctcgtgggacagtacttcgactcncacgatcagcagtcgtcgaccgtgacgttntttgacttagtttatactgtcagctaacggtcgcgcgttcggaccttatccgtaccgttcgggacctaagggtcctacggacgtgggaacgtagtaacggaaacggtacgttggtcggtactcgacctacgtacttcgtcgttcttacc

SEQ ID NO: 48121 - DNA, 601 bp, Homo sapiens
  misc_feature: GYAE6OF01DXQM8.23.23.C01.1.454.CMB.1.raw
  modified_base (361)..(361): a, c, t, g, unknown or other
  misc_feature (361)..(361): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctcagacatcgtgtctgtgtctcgaggggagagagccaccctctcctgcagggccagtcagagtgttgccgactccgttggcctggtaccaaacaaaaacctggaccagcctccgaggctcgtcattcatggcacataccgaacgacgggccacgtggccatcccgaggcaggttcaggtggcagtgctcgngggacagtacttcactctcacgatcacgcagttcgtaccgtacccgtagacgttattttcgacgttaagttttattaccgtgtacagtcgtaacggtcggacgtccgtcggtccttacgtacctaccgtttcggaaccggtaacgggtactaccggtagtacgggaacgtaacgtaacggaaacggtacgttcgggacggtacgtacgacccgtaaccgtattccgttcgttccttaccg

SEQ ID NO: 48122 - DNA, 702 bp, Homo sapiens
  misc_feature: GYAE6OF01CME4J.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagccgtggggcatcagtgaaagtcacctgacaaggcttcaggatacaccttcaacctaaatttgaatatacaacgtgggtgcgacgacggaccccgtaggaaaacgggctacggaggtggagtgggacgtgggtagtagtccgtaggtgttaggaagtaacgtaccggggactagttcctacgaacggtaaagttacgaacgggcccgaagggtcctacgacgcccgttacggaacccgtacgggaacctaccgttaccgaaggaaacgtaaacgacgtaccccttaagtttacgggaaacgtcggaccgaccggtccgtacgtaccctacgtacggaaccgaccgaccgggtcccgttagttacgtttacgttcggtacggacggaggacgggtacggggacggtacccgggtcggtttaaggtttttagggaaactttagtttaggttagggttagttagggtacggtcggtcgggggacccggtaaacggggg

SEQ ID NO: 48123 - DNA, 524 bp, Homo sapiens
  misc_feature: GYAE6OF01EWCGZ.23.23.C01.1.454.CMB.1.raw
  modified_base (371)..(371): a, c, t, g, unknown or other
  misc_feature (371)..(371): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacgacgggccactggcactcccaggcaggttcagtggcagtggctcgtgggacagacttcactcncacgatcagctagtgtcgaccctgacgtatttgactagtttattactgtcagtctaacggtgcgccgtggcccttagtccaccgttcggacctaagggcctcgacgtggaagagtacgaaacgacgtggtacggctcgacaccatctgtctcg

SEQ ID NO: 48124 - DNA, 747 bp, Homo sapiens
  misc_feature: GYAE6OF01C8AZM.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagattattcttttgacacagtctccagacatcgtgtctgtgtctccgagggggagagagcccaccctctcctgcagggccagtcagagtgttgccgatccttggcctggtaaccaacaaaacctcggccacgcctcccaggctcgtcattcatggccaacactaccaacgacgggccacgtcgggccaactcccgacggaccgtacgggttcacggttcgggacgtaggttcgggccgttcggtcggggaacaacggtaccttcgtacctcgtaccgaaccgacttccgaacggtccgtaacggttacggttacccgaaccccgttggtaaccgttaagtttttcgacctttaggtttttaactttaccgttcggtacaacgtacgtaaccgggttcgggtccgtcccgttcgggtaccccttacgtcccgttaacccggtttcccggggaacccgtaacgggggtaacccttccggtaaccggttacggggaacgtaaacggttaacgggtaaaaacccggtacggtttacgggtaccgggtaccgttccgggaacccttaaacccgttagtttcccggtcggtttccctttaacccg

SEQ ID NO: 48125 - DNA, 546 bp, Homo sapiens
  misc_feature: GYAE6OF01D229V.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacgagggccacgtggcactccccgaggccaggttcaggtcggcaggtcgctcgtgggacagtacttcactctcacgtatcagcagtcgtccgacccttgacgtatttgacttagttttactacttgtcagcgtaacggtcggcgtccgtggacccttatccgtacgtttcggaccgtaagggtcctcgacgtggagagtacggaaagtacgtgtcggacgtcgacctacattcgtgtctac

SEQ ID NO: 48126 - DNA, 601 bp, Homo sapiens
  misc_feature: GYAE6OF01C8VOF.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccgagggganagacgccaccctctcctgcagggccagtcagagtgtgccgactccgttggcctggtaaccaaacaaaaacctcggaccacgcctcccaggctcgtcattcatggcacactaccaacgacgggccacgtggccactcccgaggctaggttcaggtcggcaggtggctcgtgggacagtacttcactctacacgtactcagctagtcgtcgacccgtgtaaccgttagtttcgcttaagtttattacgtgtacgtagacgtaacggtcggccgtccgtacggtccctacgtcctaccgttccgggaccgtaacgggtacctacggacgttacgggaacgtacgtaacggaaacggtaacgtgggttaccggctacggacctacgagtttcttcgtcttaccg

SEQ ID NO: 48127 - DNA, 970 bp, Homo sapiens
  misc_feature: GYAE6OF01AZ397.23.23.C01.1.454.CMB.1.raw
tcagacgcgagtatcacgaccggtgctcgatttagtacacgtgattagggattgggggggaggaactgactcgagtttgggacccagggagggaaccatagggaaagccccgaggtctcaagcccttcgtctttcctccttgcttccgttctggtccttcccgaagtacgtaccctaccgggtaagtaatagtttctttttcggaaccggactagttcctccaagtaccaactcggttcgtcctggtcgttccctccggagggggtagtacggtacgtcccgtaaccccggttccgtaccggtacgggcccgtaacgggggaccctaacggttaccgaagggtaacggttacggtttccggacccggtaccggtttaccggttttggggttaccccttaacgggttaaacccctaaaaaccgtaaaaaaaacccggttcgggtaacccgtaaacggttcccctttaaccccggaacggggttcccgttaaccgtacgtaactttaaccgaaacgttacgggaccaaccgtaccttaccccgaaaacggcggggtaccctaacgttcgggtacctacgtccccgaggtaccgtaacggttccgacggtggaccgtagttcgggacgttcggacggggtaccgtaggtaccgttaccgacgtttccgttaccgtaaccggtacttacccgaacgtacgtaacggttccggtaccccgtaacccggttacggtaacggtttaccggtttacgaaccggtttaaacggtttttaacgttcggttcggttaaccgtttaacggtacgtttaaccggggtcggaccgttaccgttagggtaccctttaagttcccgttaacccgtttccggaaccggtaacggttcgtaccgggacgtacgggtaactacggtaccggtaaacggtacgttcggtacggtactacggtactacggtagttccgttgtacccttacg

SEQ ID NO: 48128 - DNA, 553 bp, Homo sapiens
  misc_feature: GYAE6OF01D1H94.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgccaccctctcctgcagggccagtcagagtgttgccgactccgttggcctggtaaccaaacaaaacctggccagcctccaggctcgtcattcataaggcacataccgaacgacgggccacgtggcactcccgaggcaggttcaggtggcaggtggctcgtgggacacgtacttcactctcacgatcagcagtcgtccgaccctgtacgtagttttgacttagtttacttactgtacagacgtaacggtcggcgccgtcggaccttacgtcctaccgttcggaccgtaaggcctcgacgtggaagacgtacgaaacgtagtggacgctgacctacattctgtccttac

SEQ ID NO: 48129 - DNA, 577 bp, Homo sapiens
  misc_feature: GYAE6OF01E0FZW.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctggtaccaacaaaacctggccagcctccaggctcgtcattcatggcacactccaacgacgggccacgtggcactcccgaggcaggttcaggtggcagtggctcgtgggacagacttcactctcacgatcagctagtcgtcgaccctgacgtattttgacttagtttacttacgtgtcagctaacggtggccgtccgtggcccttagtccgtacccgttccggaccgaaggggtcctaccggacgtacgggaagtaacgttacggaaaaccggtacgttggtacgggacgttcgacccgtacctagttccgttcgttccttaccg

SEQ ID NO: 48130 - DNA, 537 bp, Homo sapiens
  misc_feature: GYAE6OF01DXRE6.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcagggccagtcagagtgttcgccgactccttggcctaggtaccaaacaaaacctggccagcctcccaggctcgtcattcatggcacactaccaacagggccacgtggcactcccgaggcaggttcagtggcagtggctcgtgggacagacttcactctcacgatcagcagtcgtccgaccctgacgtatttgctagtttattactgtcagacaacggtggcgccgtggccctagtcctacccgttcggaccgtaagggcctcgacgtggagagtacgaaacgtactggtacggctacgccacattcctgttccttac

SEQ ID NO: 48131 - DNA, 693 bp, Homo sapiens
  misc_feature: GYAE6OF01CHE39.23.23.C01.1.454.CMB.1.raw
tcagacgcgagtatcacgaccggtgctcgatttagtacacgtgattaggggattggggggaggaactgctcagtttggacccagagggaaccatggaagcccagctcagcttctcttcctcctgctcctctggctccgagagaccaccggagtattattcttttgactactacgtcccagacatcgtgtctgtgtcgtacggaagggggacgagacgccacctctcctgcagggccagtcagtagtcgttcgccgtacttccgttggccttaggtaaccaaactaaaacctggaccacgtcctccgaggtctcgtctacgttcagtcggacacacgtaccgaacggacgggacctacgtggacacgtcccgaaggtctaggttcaggtcggactaggtcgtactcgtacgggacaacggtaccttcgacttcgtacgaacgtactacgacgctacgttcgtacccgaacctggaacttatttcgacttagtttactcgtcgtacaacgtacgtaacggtcggtcgtaccgttacggtacctacgtaccgtaccgttaccgggaaccgtaacgggtaccttacggtacggttacgggaacggtaacgtaacgggtaaaaccggttacgttcgggtacggtacgtacggtaccgtaacgttaacgttccggtttaacggttccttacgtaacccg

SEQ ID NO: 48132 - DNA, 558 bp, Homo sapiens
  misc_feature: GYAE6OF01BP9MF.23.23.C01.1.454.CMB.1.raw
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggggagagagcccaccctctcctgcagggccagtcagagtgttgccgactccttggcctggtaccaacaaaacctggccagcctccagctcgtcattcatgcacatccaacnggccactggcatcccaggcaggttcagtggcagtggctcgnggacagtacttcactctcacgatcagctagtcgtcgaccctgacgtatttgactagtttatactgtactagctaacggtggcctacgtggcccttaatcccgaaccgttcggaccgtaacgggcctacgacgtgggaagtacgtacggaaaacgacgttcgggtacgtacgtacggtaccacccgtaagttcctaggttccttaaccg

SEQ ID NO: 48133 - DNA, 676 bp, Homo sapiens
  misc_feature: GYAE6OF01DTBZV.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgcccaccctctcctgcgagggccagtcagagtgttgccgactccgttggcctggtaaccaaacaaaaccgtggaccacgccctccgaggcctcgtcattcagtggcacactaccaaacgacgggccaacgtcggacactcccgaggcgtacggttcaggtcggacgtaggtcggctcggtacgggactaggtacttcgaaccttctacgaacgtactacgacgtcgaaggttcgtaccgtaccctaggtaaccgttagttttcgactttaaggttttaacttacgtcgttacacggtacgtaacgggttcggaccgtccgtcggtacccttaacgttcccgtaacccggtttccggaacccggtaaacggggtacccttacgggaacggttacgggaaacgtaacgttaacggaaaaccgtacggttgggtcggacttcggaacctacgtacgttcttggttccttaccg

SEQ ID NO: 48134 - DNA, 502 bp, Homo sapiens
  misc_feature: GYAE6OF01EU77G.23.23.C01.1.454.CMB.1.raw
  modified_base (431)..(431): a, c, t, g, unknown or other
  misc_feature (431)..(431): n is a, c, g, or t
  modified_base (485)..(485): a, c, t, g, unknown or other
  misc_feature (485)..(485): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatagttcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctcgtgggacagacttcactctcacgatcagcagtgtccgaccctgacgtatttgctagtttattactgtcagcaacgtggcnctggcctatccaccttcggccaagggctcgactggaagagtcgaaacgactggngctgcacatctgtcttc

SEQ ID NO: 48135 - DNA, 623 bp, Homo sapiens
  misc_feature: GYAE6OF01A99DE.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccgttggcctggtaccaaacaaaacctggccagccctcccaggctcgtcattcagtcggcacactaccaacgacgggccactcgggcactccccgaggcctagggttcaggtcggcaggtggctcgtgggacaggtacttcactctccgacgatcgagctacgtcgtaccgacccgttggaccgttattttcgacttaagttttattacgtgtacagtctaacggtgggccgtccgttacgggtcccttaagttccctaacccgtttccgggaacccgtaaacggggtccctcggaaccgtaggggaacgtaagtacggaaaacggtacgttggtacgggtcctacgggaccaacccgtattccgtcgttccttaccg

SEQ ID NO: 48136 - DNA, 514 bp, Homo sapiens
  misc_feature: GYAE6OF01EJ5BW.23.23.C01.1.454.CMB.1.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatgcacatccaacgngggccactggcatcccaggcaggtcagtgcagtgctcgngggacagacttcactcncacgatcagcagtcgtcgaccctgacgtatttgactagtttatactgtacagtcagtcggcgccgtggcctagtccaccgttcggacaagggctcgacgtggagtagtacgaaacgtcgtggtcgctcgaccacctatccgtgtccttcg

SEQ ID NO: 48137 - DNA, 529 bp, Homo sapiens
  misc_feature: GYAE6OF01C0QS1.23.23.C01.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagatattcttttgacacagtctccagacatcgtgtctgtgtctccagggganagagccaccctntcctgcagggccagtcagagtgttgccgactctggcctggtaccaacaaaacctggaccagcctcccaggctcgtcattcatggcacatccaacagggccactggcactcccaggcacggttcagtggcgagtggctcgtgggacagtacttcactctcacgatcagcagtcgtcgaccctgacgtattttgctagtttacttactgtctagcaacgtggcgtcctcggtcctactcaccgttcggaccgtagggacctacgacgtggagtagtacgaaagtacgtgtcgctcgacctactatctgttcttaccg

SEQ ID NO: 48138 - DNA, 497 bp, Homo sapiens
  misc_feature: GYAE6OF01ER8NB.23.23.C01.1.454.CMB.1.raw
  modified_base (201)..(201): a, c, t, g, unknown or other
  misc_feature (201)..(201): n is a, c, g, or t
  modified_base (477)..(477): a, c, t, g, unknown or other
  misc_feature (477)..(477): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccaccctctcctgcagggccagtcagagtgttgccgactccttggcctggtaccaacaaaacctggccagcctccaggctcgtcattcatggcacatccaacacgggccactggcactcccaggcaggtcagtgcagtggctcgtgggacagacttcactctcacgatcagcagtgtcgacctgacatttgctagtttactactgtcagcaacgtgcgctgcctatcacttcggacacgggtctcggactggactagtgaaacgtactggngcaggccactatctgtctac

SEQ ID NO: 48139 - DNA, 574 bp, Homo sapiens
  misc_feature: GYAE6OF01DWEWU.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcagggccagtcagagtgttgccgactccgttggcctggtaaccaaacaaaaacctggaccagcctcccaggctcgtcattcatggcacatccaacgagggccacgtggcactcccgaggcaggttcaggtggcagtggctcgtgggaacagtacttcactctcacgatcagcagttcgaccgaccctagacgtattttgactagttttattctgtcagtcaacggttcggcgccgtaggccttacgtcctaccggttcggaccgtaagggtcctacggacgtgggaacgtacgtaacggaaaccggtagtcgggtcggtactcggacctaaccctagttccttgtcccttaccg

SEQ ID NO: 48140 - DNA, 533 bp, Homo sapiens
  misc_feature: GYAE6OF01DG3GL.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcagggccagtcagagtgttgccgactccttggcctggtaaccaacaaaaacctcggccacgccctcccaggctcgtcattcatggcacatccaacacgggccactggcactccccgaggcaggttcagtggcagtggctcgtgggacagtacttcactctcacgatcagcagtgtccgacctgacgtattttgcttagtttattactgtcagcaacgtgcgccgtggcctatcaccgttcggaccgagggcctcggacgtggagagtaacggaaaccgagtggtcggctacggaccaccattcgtgtcttacc

SEQ ID NO: 48141 - DNA, 588 bp, Homo sapiens
  misc_feature: GYAE6OF01EHVAU.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctggtaaccaaacaaaacctggaccagcctcccaggctcgtcattcatggcacactccaaacgacgggcccacgtggcactcccgaggctaggttcaggtggcaggtggctcgtgggacagtacttcactctcacgatcagcagtcgtcgaccctgacgtattttgacttagttttacttacgtgtactagcctaacggtgggccgtccgtacggacccttagtcccgtacccgtttccgggaccgtaacggggaccttccggacgttgggaacgtagtacggaaaaccggtacgttgggtacggactcggaccacctattccgttgttccttacg

SEQ ID NO: 48142 - DNA, 545 bp, Homo sapiens
  misc_feature: GYAE6OF01DOTDT.23.23.C01.1.454.CMB.1.raw
  modified_base (202)..(202): a, c, t, g, unknown or other
  misc_feature (202)..(202): n is a, c, g, or t
  modified_base (461)..(461): a, c, t, g, unknown or other
  misc_feature (461)..(461): n is a, c, g, or t
  modified_base (525)..(525): a, c, t, g, unknown or other
  misc_feature (525)..(525): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcgagggccagtcagagtgttcgccgactccttggcctaggtaaccaacaaaaacctggaccacgccctcccaggctcgtcattcatggacacactaccaacgacgggcccacgtcggacactcccgaggaccaggttcaggtggcaggtggctgagggacagacttcactctacacgatcgagcaggtcgtccgacctagtacgtattttgcttagtttatactgtcagcgtaacgtggcnccgtggcctatccgaccgttcggaccgagggactcggacgtggagagtaggaaacgactggcgnacgtccactatctgttctac

SEQ ID NO: 48143 - DNA, 581 bp, Homo sapiens
  misc_feature: GYAE6OF01A8V22.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcgagggccagtcagagtgttgccgactccttggcctggtaccaacaaaacctggccagcctccagctcgtcattcatggcacactaccaacagggccacgtggcactcccgagcaggttcaggtggcaggtggctcgtgggacagacttcactctacacgactcagactagtcgccgtacctgaacgttatttgacttagttttattaccttgtacagtaccgtaaggtcggacgtccgtcggtaccctagttccgtacccgttccggacccgtaagggtaccctcgggaacgtcgggaagtacgtacggaaaccgtacgttggacggtccgtacggtaccacctattccttgttccttaccg

SEQ ID NO: 48144 - DNA, 524 bp, Homo sapiens
  misc_feature: GYAE6OF01DFU1B.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactcctggcctggtaaccaacaaaaacctggaccacgcctcccaggctcgtcattcatggcacatccaacgagggccactggcatcccaggcaggttcagtggcagtggctcgtgggacagtacttcactctacacgatcagcagtcgcgaccctgacgtatttgctagtttattactgtcagcaacggtggcgccgtcggacctagtcctaccgttcgaccgtaagggcctcgacgtggagagtacgaaacgacgtggtaggctagccacattctgttctac

SEQ ID NO: 48145 - DNA, 580 bp, Homo sapiens
  misc_feature: GYAE6OF01EG8FD.23.23.C01.1.454.CMB.1.raw
  modified_base (205)..(205): a, c, t, g, unknown or other
  misc_feature (205)..(205): n is a, c, g, or t
tcagacgcgagtatcacgaccggtgctcgatttagtacacgtgattagggagttgggggaggaactgcttcagtttggaccctagagggaaccatggaagccccaggctcagcttctcttcctcctgctcctctggctcccagagaccaccggagatattcttttgacacagtctccagacatcgtgtctgtgtctccagggganagagccacccgtctcctgcagggccagtcagagtgttgccgacgtccgttggcctggtaccaaacaaaaccgtggccagcctccagctcgtcatcatggcacactccaacgagggccacgtggcactcccaggcaggttcaggtcggcaggtcggcgtgtcgggacaggtacttcgactctacacgatcagcaggtcgtacgtaccctagtacgtatttgacttagttttatacgtgtcagactaacggtgccgccgtggtcctacgtccaccgttcgaccgaacgggtactcggacgttcgggaagtacgtaacggaaaacgtacgttgggtacggacgttcggaccgaacctaagttcgttcgttccttaccg

SEQ ID NO: 48146 - DNA, 617 bp, Homo sapiens
  misc_feature: GYAE6OF01CLF2V.23.23.C01.1.454.CMB.1.raw
  modified_base (592)..(592): a, c, t, g, unknown or other
  misc_feature (592)..(592): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgccaccctctcctgcagggccagtcagagtgttcgccgtactccgttggcctaggtaccaaacaaaacctggaccacgcctacccgaggcctcgtcattcagtcggaccacactaccgaacgacgggccctacgtcggaccacgtaccccgaggcgtacgggttcacggtggacaggtcggctcggtgggactacgacgtttccacgttctacgacgtatcagcagtcggtaccgacccgtagtaacgtattttcggacttagttttacttacgtcgtacgtagacgtaacggttggccgtccgtacggtacctacgtcccgtaccgttccggaccgtacggcgtcgacgtggacgtaacgttacgaaacgtacgttggtacgtancgtacctaccagtttcctgtcttac

SEQ ID NO: 48147 - DNA, 677 bp, Homo sapiens
  misc_feature: GYAE6OF01BMRMV.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgccaccctctcctgcagggccagtcagagtgttcgccgactccgttggcctggtaaccaaacaaaaaccgtggaccagccctcccgaggcctcgtctattcatggcacactaccaacgacgggccacgtcggccactcccgaggctaggttccaggtcggacgtaggtcggactcgtgggactaggtacttcactctacgacgtatcgacgcgtagtcgtaccaccgtgaacgttatttcgaccgttagttttactacgtgtacacgtaccgtaacggtcgggtaccgtccgtacggtaccctacgtacccgttacccggtttaccgggaaccccgtaacggggtacccttacgggaaccgttacgggaaacgttaaacgtaccgggtaaaaacccggtacggttcgggtaccgggtaccgtacggtaccccttaaaccgttacgtttccttacgggttccctttaacccg

SEQ ID NO: 48148 - DNA, 642 bp, Homo sapiens
  misc_feature: GYAE6OF01AL3YV.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacactccaacagggccacgtcggcactccccgaggcctagtcgtacgaggtacgcgtaggtcggtcgttacggtacggacgtacgttaccttacgtacctccgtacgaacgtactacgacgtacgtaggtaccggtacccgtacccgtacggtacgtttacgtttcgacgtttaagttttaacttacgttacgtaccgtacgtacgtacggtcgggtccgtccggtcgtaccttacgtacccgttaccgtccggaaccgaacggtcgtacggtacggtacggaacgtacgtaacggaaacgtcgtacggtcgtactacgaccgacctacgttcgtcgttacccg

SEQ ID NO: 48149 - DNA, 606 bp, Homo sapiens
  misc_feature: GYAE6OF01A8J7K.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctaggtaccaacaaaacctggaccagcctccgaggctcgtcattcagtcggcacactaccaacgacgggcccaacgtggaccacgtcccgaggctacgggttcaggtcggcaggtcggctcgtagggacagtaccttcgactcgtacacgtactcgagcagtcgtccgaccgtgacgttatttcgacttagtttattacgtgtacacgcgtaacgtcggcgtccgtcggtaccttacgtcccgtaccgttacggaccgtaacgggtccgtacggacgtacgggtaacgtacgtacggtaaaccgtacggtcggtacggtcctacggacctacctagttccgtggttccttaccg

SEQ ID NO: 48150 - DNA, 552 bp, Homo sapiens
  misc_feature: GYAE6OF01EM8SH.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccttggcctggtaccaaacaaaacctggccagcctccaggctcgtcattcatcggcacatccaacgcgggccacgtggcactcccgaggcctaggttccaggtcggcaggtcggctgtgggacagtacttcactctcacgatcagcagtcgccgacctgacgtatttgcttagtttatactgtacagtctaacggtggctccgtggacctacgtccgtaccgttcggaccgaacgggcctacggacgtagggacgtagtaacgaaacgtacgtggtacggctacgaccaactagttctgtcttaccg

SEQ ID NO: 48151 - DNA, 553 bp, Homo sapiens
  misc_feature: GYAE6OF01DLWV0.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagatattcttttgacacagtctccagacatcgtgtctgtgtctccagggganagagcccaccctctcctgcagggccagtcagagtgttgccgactccttggcctggtaaccaacaaaaacctggaccacgcctcccaggctcgtcattcatggcacatccaacagggccactggcactcccaggcaggttcagtcggcagtggctcgtgggacagacttcactctacacgatcagcagtcgtccgaccctgaccgtattttcgcttagtttacttactcgtcaggactaacggtgcgtccgtcggtaccctagtcctacccgttcggacccgacgggtacctcgacgtcggagacgtagaaacgtacgtgtacggctacgaccacacgttctcgttcctacg

SEQ ID NO: 48152 - DNA, 605 bp, Homo sapiens
  misc_feature: GYAE6OF01CDUMH.23.23.C01.1.454.CMB.1.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
tcagacgcgagtatcacgaccggtgctcgatttagtacacgtgattagggagttggggggaggaacgtgacgtcagtttggacccagagggaaccatggaagccccagctcagcttctcttcctcctgctcctctggctcccagagaccaccggagatattcttttgacacagtctccagacatcgtgtctgtgtctccgagggganagngcccaccctctcctgcagggccagtcagagtgttgccgactccgttggcctggtaacccaaacaaaaacctggaccacgccctccgaggctcgtcattcatcgcacactaccaaacgcgggcctacgtcggcacgtcccgaggcctaggttcaggtggcaggtcggctcgtgggacagtacttcactctacgacgtatacgagtcgtagttcgtaccgtacccgtgaaccgttattttcggacttagtttattacgtcgtacacgtacgaacggttcggccgtccgtcggtacctagtccctaaccgttcggacgacgggtacctcggacgtgggaacgtagtaacggaaacgtacggttggacggtacgtcgaccactatcgttgttcctaccg

SEQ ID NO: 48153 - DNA, 530 bp, Homo sapiens
  misc_feature: GYAE6OF01D29QD.23.23.C01.1.454.CMB.1.raw
  modified_base (344)..(344): a, c, t, g, unknown or other
  misc_feature (344)..(344): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaaggctcgagtggatggctgggtgagtctagtgttgagaataccgggnatctacagaagttcaaggccaggctcagcctgacctggaacacttacagaaagaacagcctagttcgaactgcgcggcctgactctgacgacacggccgtgtattattgtcgcgagaggcggaggtccggcgtagttttagggaattagttagtggtagtgggacgtcgtggggtccgtaacgggg

SEQ ID NO: 48154 - DNA, 852 bp, Homo sapiens
  misc_feature: GYAE6OF01B6E4V.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcgagggccagtcaggtagtgttcgccgactccgttggcctaggtaccaaacaaaaccgtggaccagcctccgaggcctcgtacattcagtcggcacgactacccgaaacgtcgggcccaacgttcggacctacgtacccccgagggtaccgtaacgggttacgtaacggtcgggtaccgtaacgggttcggggaccttacggtacgggggtaacctacggttaaccgtttaccgaacccgtttccgtaacccgtaaccggtacgttacccgtaacggtaccgtaaagggttcccgttacccggtaaccccgttagggtaaacccgtttacggtttttaccgggaccgttttaaacgtttttaacgtttaaccgtttcggttaccggtaacggtaaccgttaaccggggtttccgggacccggtttacccgtaccggggttaccctttaacgttccccggttaaccccggttttcggggaaccccggtaaacggggttacccttaccgggtaaaccggttacggggaaccgttaacgggttaaccggtaaaaacccgggtacgttcgggttacgggacccgttacggacccttaaacccgttagttcccgtttaggttaccccgtttaacccg

SEQ ID NO: 48155 - DNA, 636 bp, Homo sapiens
  misc_feature: GYAE6OF01DGJKZ.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcagggccagtcagagtgttgccgactccgttggcctggtaaccaaacaaaaaccgtcggaccacgcctcccaggctcgtcattcatggcacataccaacgacgggccacgtggacatccccaggcgtaggttcaggtggcagtggctgtgggacagactcactctacacgatcaacgcagtcgtaccgaccctaggtacgtattttcgacttagttttacttacgtgtacaagtccgtaacggtcgggtccgtccgtggtacccttacgtccgtacccggtttcggacccggtaacggggtaccttaccgggtaacggtagggtaacggtaacgttaacgggtaaaaaccgtacggtttcgggtacgggtccgtacggacccgtaacctacgtttcgttccgttacccgtttaccg

SEQ ID NO: 48156 - DNA, 553 bp, Homo sapiens
  misc_feature: GYAE6OF01ETFXW.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcatcccaggcaggttcagtggcagtcggctcgtgggacagacttcactctcacgatcagcagtcgcgaccctgacgtatttcgactagttttacttaactgtacagtctaacggtggccgtccgttgggcccttaagtccgtacccgtttcggacccgaagggtcctacggacgtcgggagtacgtacggaaacgactggtacggacttcggactaccgattcctggtcttaccg

SEQ ID NO: 48157 - DNA, 858 bp, Homo sapiens
  misc_feature: GYAE6OF01BMXHT.23.23.C01.1.454.CMB.1.raw
  modified_base (248)..(248): a, c, t, g, unknown or other
  misc_feature (248)..(248): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctggaggtgaagaagccgtggggcatcagtagaaagtcaccgtgacaaggcttnaggactacaccttcacctaaatttgattatcaacgtgggtgcgacgacggccccgtagggaaaacgggcgttacggagtggagtcggggccgggtggaacggtccgtaaggttggttaggaaggtaacgtaccggggactagtttacctacgaaggtaaacgttacgaaacggacccgtacgggtccttaccgaacgtccgtacggtaacccgtgggtaaaccctaccgtttaccgaacggtaaacgaaacccgaacgtacccccgttaaaggttttaaccgggaaacccttcgggtacccggtacccgggtaccccgttacggtaaccccgttcgttaccgggaacccgtaaacccgtacccgggtacccggtttaaggttaacgttttaacggtttcgggacggtaccgggtaacgggaacggggtaccgggggtaaccgggtacccgggttaccggggttttaaggtttttttaacgggggtaaacgttttaaaggttttacggggttttaaacgggtttaacggggtttacggggttaacccgggtttaaccgggggttacccgggggggtaaacccgggttaaaccgggggggtaacccccgggg

SEQ ID NO: 48158 - DNA, 574 bp, Homo sapiens
  misc_feature: GYAE6OF01BJGYB.23.23.C01.1.454.CMB.1.raw
  modified_base (357)..(357): a, c, t, g, unknown or other
  misc_feature (357)..(357): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcaaggggagagagccaccctctcctgcagggccagtcagagtgttgccgactccttggcctggtaccaacaaaacctggccagcctccaggctcgtcattcatggcacatccaacagggccactggcactcccaggcaggttcaggtggcagtggctcgtggacngacttcactctcacgatcagcagtgtcgacctgacgtatttgctagtttattactgtacagtccccaaggtcggccgtccgtcggcccttactccctaccgtttccggaccgtaacggggtacctaccggtaccgtggaacggtacgtacgggaaaaccgtaacgttgggtacggccgttacggacctaacccgtaattcccgttgttcctttaccg

SEQ ID NO: 48159 - DNA, 529 bp, Homo sapiens
  misc_feature: GYAE6OF01C5H0D.23.23.C01.1.454.CMB.1.raw
  modified_base (201)..(201): a, c, t, g, unknown or other
  misc_feature (201)..(201): n is a, c, g, or t
  modified_base (351)..(351): a, c, t, g, unknown or other
  misc_feature (351)..(351): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggnagagcccaccctctcctgcagggccagtcagagtgttgccgtactccttggcctaggtaaccaacaaaaacctggccagcctccaggctcgtcattcatggcacatccaacgacgggccacgtggcactcccgaggcaggtcagtggacnggtcggctcgtgggacagtctcactctgacgatcagcagtcgtcgaccctgacgttattttgacttagtttatactgtcagctaagtcgcgctcgcctatcctaccgtcggaccagggtctccggagtggagtacgtagaaacgacgtggtcggctagaccacgtattcgtgtcttac

SEQ ID NO: 48160 - DNA, 573 bp, Homo sapiens
  misc_feature: GYAE6OF01B6GCW.23.23.C01.1.454.CMB.1.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgtgccgactccgtggcctggtaccaaacaaaacctggaccagcctcccaggctcgtcattcatggcacatccaacgngggccatggcactccgaggcaggtcaggtgcagtggctcgtgggacagacttcactctcacgatcagcagtcgcgaccctgaacgtatttgcttagtttattacgtgtacagtcgaacggtgcgtccgtagtcctactccgtaccgttcggacccgtaagggtacctccgaacgtcgggaacgtacgttaacgggaaaccgttaacgtcgggttacggtacgtacggacctaaacccgtagttcccttggttcccttaccg

SEQ ID NO: 48161 - DNA, 634 bp, Homo sapiens
  misc_feature: GYAE6OF01BGM21.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccaccctctcctgcagggccagtcagagtgtgccgactccttggcctgtaccaacaaaactggccagcctccaggctcgtcattcatggcacatccaacgacgggcccacgtcggccactccccgaggccaggttcaggtgccgtaggtcggctgtgggactagacttcactctcacgatcagctagtgtaccgtacccgtagtacgtatttgacttagttttatacgtgtacgtacgcgtaacggtcggaccgtccgtacgggcccttagtacccgtacccggtttccggacccggtaaacggggtaccgttaccggacgttacgggaacggttaacgtaacgggtaaaaccggtaacggttcgggtacgggtaccgttacgggacccgtaacccttaattcccggtttcggttacccgttaacccg

SEQ ID NO: 48162 - DNA, 550 bp, Homo sapiens
  misc_feature: GYAE6OF01AHDUM.23.23.C01.1.454.CMB.1.raw
  modified_base (346)..(346): a, c, t, g, unknown or other
  misc_feature (346)..(346): n is a, c, g, or t
  modified_base (421)..(421): a, c, t, g, unknown or other
  misc_feature (421)..(421): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagcccaccctctcctgcagggccagtcagagtgttgccgactccttggcctggtaccaacaaaacctggccagcctccaggctcgtcattcatggcacatccaacgagggccactggccatccccgaggcaggttcagtggcngtggctcgtgggacagtacctcactctcgacgatcagcagtgtaccgaccctgacgtatttgacttagtttatcncgttcagtacaacggtggccgtccgtggccctatccgacgttccggaccgagggtacctcggacgtgggacgtacgttaggaaaccgtagtcggtacggctcggacctaccgtatccgtggtccttacg

SEQ ID NO: 48163 - DNA, 520 bp, Homo sapiens
  misc_feature: GYAE6OF01BRA14.23.23.C01.1.454.CMB.1.raw
  modified_base (379)..(379): a, c, t, g, unknown or other
  misc_feature (379)..(379): n is a, c, g, or t
  modified_base (470)..(470): a, c, t, g, unknown or other
  misc_feature (470)..(470): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagcccaccctctcctgcagggccagtcagagtgttgccgactccttggcctggtaaccaacaaaacctggccagcctcccaggctcgtcattcatggcacatccaacgacgggccacgtggccacgtccccaggcaggttccaggtggcagtggctcgtgggacagacttcactcncacgatcagcagtcgtccgaccctgacgtattttgctagtttatctgtcagctacgtggcgtccgtgtcctatccacttcggccgagggcncgacgtggagagtacggaaacgagtgtggctcggacaccgatctgttctc

SEQ ID NO: 48164 - DNA, 726 bp, Homo sapiens
  misc_feature: GYAE6OF01ARGD9.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgtcgcgtactcgtgctacggtaaccaaacaaaacgtcgaccacgccctaccgaggctcgtactattcagtcggacacactaccaacgacgggacctacgtcggacactcccgaggaccgtagggttacgaggtcggacgagggtcggtccgtcggtagggaacctacgtaccttcaaccgttcctacgaacgtactacgacgtacgtaacggttccggtacccgacccgttaggaaccgtttagttttacgacgtttaagttttaacttacgtcggtaccaaggtaaccgtaacgggtccggtccgtacccgttacgggtaccctttaaccgtacccgttacccggttaccgggaaccctaaacgggggttcccttaacccgggtaacggttaggggaaaccgtaacgttaaacgggaaaaacccgtaccggttgggaccggtccgtacgtaacccgtaaccgttattcccggtttagttacccctttaccg

SEQ ID NO: 48165 - DNA, 744 bp, Homo sapiens
  misc_feature: GYAE6OF01DP910.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgaggggagagacgcccaccctctccgtgcgacgggccagtcaggagttggttcgccgtactccgttggccttaggtaacccaaaacaaaaacccgtcggaccacgccctcccgaggcctcgtctattcatcggcacactaccaacgacgggcctacgtcggacctacgtcccgaggctacgggttacaggttacggcgtaggtcggtccgttacggtacgggtaacaacgtacttaccaccttccgtacgaacggtacttacgacgtacgtagttccggtaccgacccgttagtaacgttacgttttcgacgtttacgttttaacgtttaccgtcgttaccgtaagtaccgtaacgggttccggtacccggtcccggttaccgggtacccttaacgttcccgtaaccccggttttacccgggaaccggttaaccggggtaccgttaccggaacggttacgggaaacgtaacggtaaccggtaaaaccgtacggttcgggtacggtaccttcggaccctaaccgtactttccgttagttcccgtttaccg

SEQ ID NO: 48166 - DNA, 657 bp, Homo sapiens
  misc_feature: GYAE6OF01BS56M.23.23.C01.1.454.CMB.1.raw
  modified_base (355)..(355): a, c, t, g, unknown or other
  misc_feature (355)..(355): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctggcctgaggtgaagagcctgggcatcagtgaaagtcacctgcaaggcttcaggatacaccttcaccaaattgatatcaactgggtgcgacacggcccctaggaaacgggctacgagtggagtgggactgggtgagtccgtagtcggttgaagtaagtaccggggntagttctacgtagaagttcgaaggccagggctacgacgtcctaggacctaggaacctacgttaccaaggtaagaaccgagtacccctaagtttcggaaaccttggaccgtcggtcctacggacccttccgtacgtaaccgaaccgtaccgggtccgttaggttaactttagttacggttcgacggagggtacgggcgggtacgggtaccccggtggtttaaggtttttcggggaaactttagtttaagggtcgggtttaaagtcggggtaagttccggtgggggaacccgtaaaccgggggg

SEQ ID NO: 48167 - DNA, 509 bp, Homo sapiens
  misc_feature: GYAE6OF01EHBWX.23.23.C01.1.454.CMB.1.raw
  modified_base (201)..(201): a, c, t, g, unknown or other
  misc_feature (201)..(201): n is a, c, g, or t
  modified_base (413)..(413): a, c, t, g, unknown or other
  misc_feature (413)..(413): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgatccttggcctggtaccaacaaaaacctggccagcctccaggctcgtcattcatggcacatccaacagggccactggcatcccaggcaggtcagtggcagtggctcgtgggacagacttcactctcacgatcagcagtcgtcgaccctgacgtatttgactagtttatactntcagcaacgtgcgctggcctatctaccgttcggacctaacgggctcggacgtcggagacgtagaaacgtactggacgctcgacacatctgtcttac

SEQ ID NO: 48168 - DNA, 568 bp, Homo sapiens
  misc_feature: GYAE6OF01DVQDL.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactcctggcctggtaccaacaaaactggccagcctccaggctcgtcattcatggcacactccaacgacgggccacgtcggcactcccgaggcaggttcagtggcaggtggctcgtgggacagtacttcactctcacgatcagcagtcgtaccgaccctgacgtatttgcttagtttatactgtcagctaacggtggacgtccgtggacctacgtcctaccgttcggaccgtaagggacctcggacgtagggacgtaacgtaacggaaacgtaacgttgggacgggtccttacggaccctaaccgtagtttcctggtttccttaccg

SEQ ID NO: 48169 - DNA, 718 bp, Homo sapiens
  misc_feature: GYAE6OF01BSJ5W.23.23.C01.1.454.CMB.1.raw
  modified_base (233)..(233): a, c, t, g, unknown or other
  misc_feature (233)..(233): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagngtgtcgccgtactcgtcggcgtacgtaaccaaacgaaaacgtcggaccacgtccctaccgaggtcctcgtactacttcagtcgacacactaccaaacggcggacctacgtcggacctaccgtcccgaggaccgtaggttcgaggtcggacgtagggtcggtccgtacgggtacgggaactaacgtaccttaccgaccttccgtaccgaacggtactaccggaacgtcgtaacgggttccgggtaccccgtaacccggttaggtaaccgttttacgttttacggaacgttttaacgttttaacttaccggtcgttaacgaaccggtaccgtaacgggttcgggacccgttccggttacgtacccgttacgtacccgttacccggttaccggaaccggtaacgggtccctacgggacgtagggaacgtacgtaacggaaaccgtggtcggacgtagtccgacctactagttcgttcgttcgttaccg

SEQ ID NO: 48170 - DNA, 853 bp, Homo sapiens
  misc_feature: GYAE6OF01EHWQE.23.23.C01.1.454.CMB.1.raw
tcagacgcgagtatcacgaccggtgctcgatttagtacacgtgattagggatcggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagccgtggggcatcagtgaaagtcacctgcaaggcttcaggatacaccttacacctaaatttgatatcaatgggtgacgacacggacccctagggaaaacgggcctacggaggtcgggagttcggggcgttggggtgtacggttccgttaagggttcggttacggaaggtaaacggtacccgggggtactacgtttaccggtactaagggtaaacggtttacgaaacggggtcccgaagggtcctacggacggtacccgtaggtacccgttacgggaaaccctaccgtttaccgaaggaaacgtaaaccgaaccggtaccccttaaggttttaccgggaaaccgttacggacccggtaccggtccccgttacggtaaccccgttcgtaaccgggaacccggtaacccggtaaccgggtacccggtttaagggtttaacgttttaacggtttccgggttaccgggtacggtaacggggtaccggggtaccggggtaaccggggtaccgggttaacccgggttttagggtttttaaaccggggtaaaaggtttacggttttaaacgggtttaggggttaaaccggtttacgggggttaacccgggtttaccggggtaacggggggttaaccccgggtaaaaccggggggg

SEQ ID NO: 48171 - DNA, 716 bp, Homo sapiens
  misc_feature: GYAE6OF01CVFMA.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgccaccctctcctgcgagggccagtcagagtgtcgccgtactccttggcctaggtaaccaaacaaaactggaccagcctccaggctcgctatcagtgcacactaccaacgacgggccacgtcggacaacgtccccgaagggctaacgggttacaggttagggaccgtagggtcgggtccgtcggtaacggggaactaacggtaccctttaccgaacctaccgttacgaacgtacgtaccgaaggtaccctagggttccggtacccgtacccgttaggtaaacgttatttttcgggactttaagggttttaacttaccgtcggttaacgaacggtaccgtaagggtccggcccggtcgtacgggtcccttaaacgttcccgaaccgtttccgggaaccggtaacggggtcccttacggaggtcgggaaagtacggtaaccggtaaaacggtaacgttcgggacgtcgttaccgaaccgtaaccgtaagtttcccgttattaccgttacccg

SEQ ID NO: 48172 - DNA, 674 bp, Homo sapiens
  misc_feature: GYAE6OF01BSP8H.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctcgaggggagagacgcccaccctctcctgcgacgggccagtcagagtgtcgccgactccgtggcctaggtaaccaaaacaaaacctcggaccacgccctccgaggcctcgtacattcatggacacactaccaaacgagggccacgtcggcacgtcccgaggcgtaggttcgaggtcggctaggtcggtcgtcgtacgggacagtacttaccgactcctacgacgtactcaagcgtaggtcggtacccgaacccggttaggtaaccgtttacttttacggacttttaggtttttaacttacgttcggtaccgaacggtccgtaaacggggtcggaccgtcccgttacgggtcccttacgttacccgtacccgtttaccgggaaccgtaaacggggtccttaacggaccggttagggaacgtaacgtaacggaaacggtacgtgggtacggctacgtaccacccgtattccgttgttcgttacc

SEQ ID NO: 48173 - DNA, 511 bp, Homo sapiens
  misc_feature: GYAE6OF01DR89H.23.23.C01.1.454.CMB.1.raw
  modified_base (202)..(202): a, c, t, g, unknown or other
  misc_feature (202)..(202): n is a, c, g, or t
  modified_base (357)..(357): a, c, t, g, unknown or other
  misc_feature (357)..(357): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (499)..(499): a, c, t, g, unknown or other
  misc_feature (499)..(499): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggcccagtcagagtgttgccgtactccttggcctggtaccaaacaaaaacctggccagcctcccaggctcgtcatcatggcacatccaacagggcccacgtggcatcccaggccaggttcagtgcagtggctcgnggacagacttcactctcacgatcagcagtcgtcgaccctgacctatttgctagtttattactgtcagtcaacgtgctcctggcctatccaccgttcgaccaaggcctcggacngganagtacgaaacgactgagcctgcacnttctgtccttac

SEQ ID NO: 48174 - DNA, 584 bp, Homo sapiens
  misc_feature: GYAE6OF01A4PAV.23.23.C01.1.454.CMB.1.raw
  modified_base (402)..(402): a, c, t, g, unknown or other
  misc_feature (402)..(402): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggctcccagagaccaccggagattattcttttgacacagtctccagacatcgtgtctgtgtctccgaggggagagagccacctctcctgcagggccagtcagagtgttgccgactccgttggcctggtaaccaaacaaaaccgtggccagcctccaggctcgtcattcatcggcacataccaagacgggccacgtcggcactcccgaggctaggttcaggtcggcaggtggctcgtgggacagtacttcactctacacgtatcagcagtcncgaccctgacgtagtttcgacttagtttacttacgtgtcgaacgtcgtaacgtcgggctccgtggtacccttagtcccgtaccggttcggaccgtaacgggacctcgggaacgttgggaacgtaagtaccggaaagtacgtgggtacgcgtacgacccgtactactcggttagtccttaccg

SEQ ID NO: 48175 - DNA, 587 bp, Homo sapiens
  misc_feature: GYAE6OF01C8Q5N.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactcttggcctggtaaccaacaaaacctggccacgcctccaggctcgtcattcatggcacatccaacaggccactggcactccaggcaggttcagtggcagtcggctcgtgggacagtactcactctcacgatcagcagtcgcgaccctgacgtattttgcttagtttatacgtgtcacgcaacgtggcgccgttggccttaacgtcctaccgtttccggaccgtaaggggtacctaccgggtaacgtacgggaacgtaacgttaacgggtaaaaaccggtaacgttcgggtacgggtacccttacgggacccctaacctaagttcccttggttccctttaaccgg

SEQ ID NO: 48176 - DNA, 714 bp, Homo sapiens
  misc_feature: GYAE6OF01B8YRR.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctcgaggggagagacgccacctctcctgcgacgggccagtcagagtgtcgccgactccgttggcctaggtaacccaaacgaaaaccgtggaccacgcctacccgaggcctcgtctattcgacgtggcacactaccgaacgacgggccacgtcggacacgtcccgaggcgtacggttcacggtcggactaggtcggacgttcgacgggacaacggtactttccactctaccaacgtactcgaacgcctaggttccgtaccgtaccgtggtaccgttaatttcgacttaacggttttacttacgtcgttacaacggtacccgtaaggttccgggaccgtccgtacgggttccccttaacgtcccggttaacccggtttccgggaaaccggtaacggggtacccttcggggtaaaccgtgggggaaaacttacggtaaaccgggtaaaaccggtaacgggtttgggaccgggtaccttacggtaacccgtaacccggttacttccgtttcgggtttaccctttacccg

SEQ ID NO: 48177 - DNA, 506 bp, Homo sapiens
  misc_feature: GYAE6OF01CK8I1.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgtcattcatggcacatccaacagggccactggcatcccaggcaggtcagtgcagtggctcgtgggacagacttcactctcacgatcagcagtcgtcaccctgacgtattttgctagtttattactgtcagcaagtgcgcctggcctatccaccttcggacctagggcctcgacgtggagagtcgaaacgactggtcggactgaccacattctgtctcg

SEQ ID NO: 48178 - DNA, 577 bp, Homo sapiens
  misc_feature: GYAE6OF01B8OMA.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctggtaccaaacaaaacctggaccagccctcccaggctcgtcattcatggcacactaccaaacgacgggaccacgtcggacacgtccccgaggcctagggttcaggtcggctaggtcggctcgtgggacaggtacttcacttctacgacgtatcagcagtcgtccgacctgaacgtatttgacttagtttattacgtgtacagtctaacggtggcgtccgtaggccttacgtccgtaccgttcggacccgtaagggacctcgacgtgggaagtagtacggaaacgacgttggcggtcacggacctacgtatcgttcgtcttaccg

SEQ ID NO: 48179 - DNA, 641 bp, Homo sapiens
  misc_feature: GYAE6OF01EKD84.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccgagggganagacgccaccctctcctgcagggccagtcagagtgttcgccgactccgttggccctaggtaacccaaacaaaaaaccgtcggaccaacgccctacccgaggcctcgtctattcagtggacacgataccaaacgagggacccaacgtcggcaactcccgaggtcgaggttccaggtcggcaggtcggctcgtgggacacggtacttcgactctacacgatcagcagtgtccgaccgtgaacgtatttgcttagttttatcgtgtcgagtacgtaacgtcggcctccgtacggaccttacgtccgtacccggttcggaaccgtaacgggtacctccggtaaccgttaggggaacgtaacgttaacgggaaaaccgtaacggttcgggtaccggtacgtaccggtacctaacccgtagttacccgttcggttacccttaaccg

SEQ ID NO: 48180 - DNA, 539 bp, Homo sapiens
  misc_feature: GYAE6OF01AV4PV.23.23.C01.1.454.CMB.1.raw
  modified_base (347)..(347): a, c, t, g, unknown or other
  misc_feature (347)..(347): n is a, c, g, or t
  modified_base (434)..(434): a, c, t, g, unknown or other
  misc_feature (434)..(434): n is a, c, g, or t
  modified_base (480)..(480): a, c, t, g, unknown or other
  misc_feature (480)..(480): n is a, c, g, or t
tcagacgcgagtatcacgaccggtgctcgatttagtacacgtgattagggattggggagtcaacaaccacatctgtcctcgagaggacaccctgtgaccacagctcctcaccacggactggacctggacgatcctcttcttggtggcagcagccagaagtgcccactcccacgaggaattggtgcagtctgggcctgaggtgaagagcctggggcatcagtgaaagtcacctgcaaggcttcaggatacaccttcaccaaattttgatatcaactgggtgcgacaggcccctggaaaagggctcgagtggatgggctgggtgagtcctagtgttgagaataccgggnattctcagaagttcaaggccagggctcagcctgacctggaacacttccagacgaacagcccatttcggaactgcgcggcctgacctntcgacgacacggccgtagtattattgtagcgagaggcggaggccgngtagttttgggaattagttagtggtatcgggacgttgtggggtccgaaggggtacccgg

SEQ ID NO: 48181 - DNA, 622 bp, Homo sapiens
  misc_feature: GYAE6OF01DEKEO.23.23.C01.1.454.CMB.1.raw
  modified_base (354)..(354): a, c, t, g, unknown or other
  misc_feature (354)..(354): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctggaggtgaagaagccgtggggcatcagtgaaagtcacctgcaaggcttcaggatacacttcacctaaatttgatatcaactgggtgcgacaggcccctaggaaaagggctacggagtggagtgggcgtgggtgagtcctagtgttgagaagtaccggntattcacagtaagttcgaacggccgaggtcctacgacgtccctagacccgtaggaacctaaccgttccgaaagaaacgaacacggaccctaagttttacgggaactcggcgccggacctacgacccttgtacgaaccgaccgaccgggtccgttagttactttagttggtagcggaggacgggcggacggccggtacgttaggtttttagggaattagtttagtagggttacgtacgggtacgttcggtagggggtccgtaaacgggg

SEQ ID NO: 48182 - DNA, 573 bp, Homo sapiens
  misc_feature: GYAE6OF01D8HJV.23.23.C01.1.454.CMB.1.raw
  modified_base (202)..(202): a, c, t, g, unknown or other
  misc_feature (202)..(202): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctggtaaccaaacaaaaacctggccagccctccaggctcgtcattcatggcacatccaacgagggcccacgtggccaatccccgaggcctagggttccaggtggcgaggtggctcgnggacaggtcttcactcncacgatcagcagtgtccgacctgacgtatttgactagtttattactgtctagacgtaacggtgtccgtcctcgggtacccttagtacccgtaccgttacggacccgtaaggggtacctcggtacgtgggtaagtaacgtacgaaaccgacgttggacggtctacgacctacattcgtgttccttacg

SEQ ID NO: 48183 - DNA, 730 bp, Homo sapiens
  misc_feature: GYAE6OF01ENTAJ.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaacctaaatttgatatcaacgtgggtgcgacgacggccccgtagggaaaacgggctacggaggtggagtggggcgttggggtgaggtccgtaggttggttaggaagtaaacggtaccggggtactaacgtttaccgtacgaaggtaaacggtttaccgaaagggcccgtaagggtacctacgacgtcccgtacggtaacccgttacggaacctaccttaccgaagtaaacgaacgaacgtaccctaagtttacggaaccgttcggacccggtaccggtccgtaccgtaacccgtcgtacggaacccgaaccggtaccgggtaccgttaggttaactttacgttaggtacggtacggaagggcgggtaccgggaccgggtccggtacggtttaaggttttacgggtaaattaacggtttagtaggttaacggttacgggtaccggttcgggtcgggggacccggtaaaccggggg

SEQ ID NO: 48184 - DNA, 580 bp, Homo sapiens
  misc_feature: GYAE6OF01EQTJ1.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatatttcttttgacacagtctccagacatcgtgtctgtgtctccgagggganagacgccaccctctcctgcgagggccagtcagagtgttgccgactcgttggcctggtaaccaaacaaaacctggaccagcctccgaggctcgtcattcatggcacactaccaacgacgggccacgtggccactcccgaggcctaggttcaggtggcgaggtcggctcgtgggacacgtacttcactctacacgtatcgagctagtcgtacgaccctgacgttatttgacttagtttatacgtgtacagctaacggtgccgtccgtggcctactccgtaccgttcggaccgtaacgggtcctacggacgtacgggaagtacgtaacggaaacgtacgtggtacggctacggaccaccgtattccgttgttccttaccg

SEQ ID NO: 48185 - DNA, 747 bp, Homo sapiens
  misc_feature: GYAE6OF01COF8I.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgagggganacgacgccaccctctcctgcgagggccagtcagacgtgttcgccgtactccgttggacctaggtaacccaaacgaaaaaccgtcggaccaacgccctacccgaggtcctcgtcacttcagtcggaccactactaccgaacgacgggcccacgtcggaccacgtaccccggaggtaccgtacgggttcgaacggtcggacctagggtcggccgttacggtacgggaccacggttaaccttcccgtaacttcctaccgtaacgacgttacaacggtaccgtaggttaccgtacccggaaccgtttacgtacggtttaacgttttacggacgttttacgttttaattaaccgttcggtaccgtacgggtacccgtaacgggttccgggtccgttacccggttacgggtacccctttaccgtccggtaacccggtttaccgggaaccggtaacggggtaccctacgggtacggtacgggaacgtacgtaaaggaaacccgttagtcgggtacgtcgacgtacaaccgttattccgtcgttccttaccg

SEQ ID NO: 48186 - DNA, 652 bp, Homo sapiens
  misc_feature: GYAE6OF01CWWEM.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggctccagagaccaccggagatattcttttgacacagtctccagacatcgtgtctgtgtctccgaggggganagagccaccctctcctgcagggccagtcagagtgttcgccgactccttggcctggtaaccaacaaaaactggaccacgcctccaggctcgtcacttcatggacacactaccaacgacgggccacgtcggacactcccaggccgaggttcaggtcggcaggtggctcgtgggacacgtactcactctcacgatcagctacgtcgtaccgacctcggtacgttattttcgactttagttttacttacgttgtaccgtacggtccgtaacggttcgggccgtacccgtcgggtacccttacgtacccgtaccgtttaccgggaaccgtaacggggtaccgtaccggtaaccggtagggaacggtaacgttaaacggaaaaccgtaacggttcggggtacgggtacccgttcggaaccctaaccgttagtttcccgttgtttcccgtttaccg

SEQ ID NO: 48187 - DNA, 580 bp, Homo sapiens
  misc_feature: GYAE6OF01DVTDH.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacacgggccacgtggcactccccaggcaggttcaggtcggcagtggctcgtgggacagacttcactctcacgatcagcagtcgtccgaccctgaccgtattttcgacttagtttacttacttgtcagtactaacggttcgggcgtccgtacggtcctacgtccgtaacccgtttccggacccgtaagggtccttacggaacgttcgggaacgtagtaacggaaaccgtacgttcggtacggccgtacgaccaacctattccgttgttccttacg

SEQ ID NO: 48188 - DNA, 692 bp, Homo sapiens
  misc_feature: GYAE6OF01A9O8D.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatatttcttttgacacagtctccagacatcgtgtctgtgtctccgagggganaggacgcccaccctctcctgcgacgggccagtcaggtagtggttcgccgtacttcccgttcgggccttacggtaacccaaaaaccgtaaaaacccgtcgggacccaacgtccccgtacccgaggtcccttcgtacctactttcaagttcggacactaactacccgaaacgacgggcccaacgtcggaccaccgtcccgaggacgtacggttacgaggtcggctaggtcggtcctcggtacgggactacggactttcgaccttctaccgacgtactacgacgtcgtaggttccgtacccgtaccgttggtaccgtttatttcgactttaagttttacgttacgtcgtacgtacgtacgtaacggtcgggaccgtcgtacggtcctacgtccgtaccggttaccggacgtaacgggtccacggtacgtggaagtacgtacggtaaagtcgtggaccggtacacgtaccctacgtatttcctgtcttacccg

SEQ ID NO: 48189 - DNA, 529 bp, Homo sapiens
  misc_feature: GYAE6OF01AGA8R.23.23.C01.1.454.CMB.1.raw
  modified_base (486)..(486): a, c, t, g, unknown or other
  misc_feature (486)..(486): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccttggcctggtaccaacaaaacctggccagcctcccaggctcgtcattcatggcacatccaacgagggccactggcactccccgaggcaggttcagtggcagtggctcgtgggacagacttcactctcacgatcagcagtcgtccgaccctgacgtattttcgactagtttatactgtacagcaacgtggcgccgtggcctagtcctaccgttcggaccgtaagggcctcggactggganagtacgaaacgacgtggacgctagacctacattctgtcttacg

SEQ ID NO: 48190 - DNA, 668 bp, Homo sapiens
  misc_feature: GYAE6OF01BKKHF.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgcccaccctctcctgcgagggccagtcagagtgttgccgactccgttggcctggtaaccaaacaaaaccgtcggaccacgccctaccgaggtcctcgtctattcatcggcacactaccaacgacgggacctacgtcggaccacgtaccccgaggcgtacggttcaggtcggcgtaggtcggctcggtgggacacgtacttacgacttctacacgtactaccgagcgtaggtcggtaccgtacccgttggtaaccgttacgttttcgacttaagttttacttacgttcgttacgacgtacgtaacggtcggccggtacccgtcgggtacccttaacgttcccgtaaccgttccgggaaccgtacggggtacctaccggtacggtacgggaaagtacgtaacggtaaaccgtacggttcgggtacggtacgttcggaaccctaccgtattccgtgttccttacg

SEQ ID NO: 48191 - DNA, 550 bp, Homo sapiens
  misc_feature: GYAE6OF01AJHKL.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcatcccaggcaggttcagtggcaggtgctcgtgggacagtacttcactctcacgatcagcagtcgtcgaccctgaacgtatttcgctagtttacttactgtcagtacaacggtcggccgtccgtcggtaccctatccctaccgtttcggacccgtaagggtacctcggacgtagggaacgtagtacggaaacgtacgtcggtacggactgacctactatcttcgttcttacc

SEQ ID NO: 48192 - DNA, 547 bp, Homo sapiens
  misc_feature: GYAE6OF01B1YPS.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactcttggcctggtaccaaacaaaacctggccagcctcccaggctcgtcattcatggcacatccaacagggccatggcatcccaggcaggttcagtggcagtggctcgtgggacagtacttcactctcacgatcagcagtcgtcgacctgacgtatttgctagtttattacgtgtacagcgtaacggtcggcgtcctgggacccttagtccctaccgtttccggaccgtaagggtacctcggtacgtggaagtagtacggaaaacgtacggttggacggtctacgaccaccattctgttcttaccg

SEQ ID NO: 48193 - DNA, 581 bp, Homo sapiens
  misc_feature: GYAE6OF01EAUX2.23.23.C01.1.454.CMB.1.raw
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagccgtggggcatcagtgaaagtcacctgcaaggcttcaggatacaccttcaccaaatttgatatcaactgggtgcgacacggcccctagggaaaagggctcggaggtgggagtgggctgggtgagtcctagtgttgagaagtaccgggnattcncagtaagtcaaggccaggctcgagcctcgaccgtaggaacctacttccgaagaaacgaacaacgaccctaagtttacggaactcggccggcggccgtcgtaccctcgtacgaacgacgaccggtccgtagttatttagttgtgcgaggaggcgggaggccgtggtagttttgggaattagttagtaggtagtcggtacggtcggtggggcgtaaacgggg

SEQ ID NO: 48194 - DNA, 642 bp, Homo sapiens
  misc_feature: GYAE6OF01EISTZ.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcagggccagtcagagtgttcgccgactccgttggcctggtaaccaaacaaaaacctggaccagcctcccgaggctcgtcattcatgcacataccaagacggccactggcacgtcccagctaggttcagtggcgagtcggctcgtggacagtacttcgactctcgacgatcgagtcagtcgtcccgaccttggtacgtatttgacttagtttatacgtgtacgagtctaacggtggtcgccgttacggtaccttacgtcccgttaacccgtttccgggaaccggtaaccgggtacgttacccggacggttacgggaaagtaacgggtaaccggtaaaaacgggttaaccgttcggggtacggtaccgttaaccggtacccgtaaaccctacgggtttccccttaggtttcccctttaacccgg

SEQ ID NO: 48195 - DNA, 605 bp, Homo sapiens
  misc_feature: GYAE6OF01A9HHQ.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggganagagccaccctctcctgcagggccagtcagagtgttgccgactccttggcctggtaccaaacaaaacctggccagcctcccaggctcgtcattcatggcacatccaaacagggccacgtggcactcccgaggcaggttcaggtggcaggtcggctcgtgggacagacttcactctcacgatcagcagtcgtccgaccctgacgtatttgacctagtttacttacgtgtacacgacgaacgtcgggcgtcccgttggcccttaacgtcccgtaacccgtttccgggacccgtaaacggggacccttccggacgttagggaacgtagtaaccggtaaaacggtaacgttgggtaccggtcttacggaccctaacccgtaagtttcccgttcggttccctttaccg

SEQ ID NO: 48196 - DNA, 640 bp, Homo sapiens
  misc_feature: GYAE6OF01C1SF4.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccgaggggganagacgcccaccctctcctgcacgggccagtcagagtgttcgccgactccttgggcctaggtaaccaaacaaaacctggaccacgccctcccgagctcgtcattcatcggcaacactaccaaacgacgggccaacgtcggacaactcccgaggcgtaacggttcgaaggtcggcacggtcggctcggtacgggacacggtacttccgactctacacgactcgacgctagtcgtccgtaaccgtgtaacgttagttttacggactttagttttattaccgttgacgtacgacgtacggtggaccgtccgtacggtcccttagtccctaaccggttcgaaccggtaagggtacctaccggacgtaggaagtaacgtaacggtaaaaccgtaggtcggtacggtacctacggacctaaccgtatttcgtcgttccgttaccg

SEQ ID NO: 48197 - DNA, 568 bp, Homo sapiens
  misc_feature: GYAE6OF01BN4O8.23.23.C01.1.454.CMB.1.raw
tcagacgcgagtatcacgaccggtgctcgatttagtacacgtgattagggattgggggagtcaacaaccacatctgtcctcgagaggacaccctgtgaccacagctcctcacccatggactggacctggacgatcctcttcttggtggcagcagccagaagtgcccactccccacgaggaattggtgcagtctgggcctgaggtgaagaagcctggggcatcagtgaaagtcacctgcaaggcttcaggatacaccttcgaccaaaatttgataatcaacgtgggtgccgacaggcccctggaaaagggctcgagtggatgggctgggtgaggtcctagtgttgagaataccgggcagttctcagagttcaaggcccaaggctcagtcctagacctggaacacttaccagaagaacagaccatttggaacttgcgcggcctgacctctagacgacacggccgtgtattagttgtacgacgtaggagggcgggagggccggtcggtagtttttaggggaacttaagttagtgggtatcgggtacggttcgtgggggccgtaaacggggg

SEQ ID NO: 48198 - DNA, 570 bp, Homo sapiens
  misc_feature: GYAE6OF01E0VXJ.23.23.C01.1.454.CMB.1.raw
  modified_base (358)..(358): a, c, t, g, unknown or other
  misc_feature (358)..(358): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaaacaaaacctgccagcctccaggctcgtcattcatggcacactaccaacgacgggccactggcactcccgaggcaggttcaggtggcaggtggctcgngggacagacttcactctcacgatcagcagtcgtccgacctgaacgtattttcgacttagttttattacgttgtacgagtccgtaacggtggccgtccgtcggcccttacgtccctaccgtttccggacccgaagggtcctacggacgtaggaacgtagtacggaaaacgtacgtggtacggctacgaccgtaaccattctcgttccttaccg

SEQ ID NO: 48199 - DNA, 581 bp, Homo sapiens
  misc_feature: GYAE6OF01CTUJS.23.23.C01.1.454.CMB.1.raw
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaagggctcgagtggatgggctgggtgagtcctagtgtgagatacggnattcngagtaagttcaaggccaggctcgagcctgaccgtggaacctaccttaccgagaaacgaacacgaccctagtttacggaacttggaccgcggccgtcgtacctacgtcgacgacgaccgggtccgtagttattagttgtgacggaggagggcgggacgggccggtcggtagtttttagggaaagttagttaagttggtagttgggtacggttcggtcggggccgtaaacggggg

SEQ ID NO: 48200 - DNA, 671 bp, Homo sapiens
  misc_feature: GYAE6OF01EIO9Y.23.23.C01.1.454.CMB.1.raw
  modified_base (198)..(198): a, c, t, g, unknown or other
  misc_feature (198)..(198): n is a, c, g, or t
  modified_base (393)..(393): a, c, t, g, unknown or other
  misc_feature (393)..(393): n is a, c, g, or t
tcagacgcgagtatcacgaccggtgctcgatttagtacacgtgattagggattgggggaggaactgctcagtttggacccagagggaaccatggaagccccagctcagcttctcttcctctgctcctctggctccagagaccacggagatattcttttgacacagtctccagacatcgtgtctgtgtctcgagggganagacgccaccctctcctgcaggccagtcagagtgttcgccgacttcgttcggcctaggtaaccaaaccaaaaaccgtcggaccacgcctccgaggcctcgtactacttcgatcggacactactaccaacgacgggccacgtcggactacgtcccgaggcgtacggttcgaggttcgcgtaggtcggtcgtacggnggtaactacggtaccttcactcctacgacgacttacgacgtcgtacggtcgtacccgaaccgttgtaacgttatttcgatttaacgtttattacgtgtacgtagtacgtaacggtcgcgtcgtacggtacctacgttaccgtaccggttacggaccgtaaacggtccgtaacggtacgtagggtaacggtaaagttaaccggaaaaggttacgtacgggtacgtacccgtacggtacccctaacggttaccgtttccgttccgttaccgtttaacccg

SEQ ID NO: 48201 - DNA, 672 bp, Homo sapiens
  misc_feature: GYAE6OF01DJUJK.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagattattcttttgacacagtctcagacatcgtgtctgtgtctcgaggggagagacgccaccctctccgtgcgacgggccagtcagtgtgttcgccgtactccgttggccgtacggtaaccaaaacgaaaaccgtcggaccacgtccctcccgaggctcgtctattcacgtcggacacactaccgaacgacgggccacgtcggacacgtacccgaggcgtacggttactaggtcggacgtagggttcggcgttcggtacggggaacacggttacctttaccacctttcgtacgacgtactacgacgacgtacggtccgtaccgtacccgtgtaaccgttagtttcgacttaagttttacttacgtcgtcgtacgtacgtacggtcgaccgtccgtacggtacctacgtaccgtaccggttaccggaaccgtacggggtacctcggtaacggtaggtaagtacgtaacggtaaacggtacgttcggacggtcgtacgtaccgacctagttcttacgtcttacccg

SEQ ID NO: 48202 - DNA, 702 bp, Homo sapiens
  misc_feature: GYAE6OF01B8FNR.23.23.C01.1.454.CMB.1.raw
  modified_base (216)..(216): a, c, t, g, unknown or other
  misc_feature (216)..(216): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgaggggagagagccacctctccngcagggccagtcagagtgttgccgtactcgttggcctaggtaaccaaacgaaaacctggacctacgccctcccgaggcctcgtctagttcagtcggacacactaccaacgacgggaccacgtacggcactcccgaggcgtacgggttacaggtcggacgaggtcggtccgtcggtaggggacctacggtactttccgaccttcgtaccgaacgtactacaggcctaaggtcgtaccgtacccgtaggtaacgttacttttacggacgtttaacgtttactttacgtacgttacaacggtaccgtaacgggtcgggtacccgtccgtacgggtacccttacgttacccgtaacccggtttaccgggacccggtaacgggtcccgttacggacggtacgggtaataccggtaaacggtaaaccggtaacgttcgggtacggtaccgacgtaccccgtacttacgtttaccgttggtttccttaacccg

SEQ ID NO: 48203 - DNA, 572 bp, Homo sapiens
  misc_feature: GYAE6OF01BTGU2.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctccgaggggagagagcccaccctctcctgcagggccagtcagagtgttcgccgactccttggcctggtaaccaaacaaaacctggaccacgccctcccgaggcctcgtcattcatggcacatcccaacgacgggcccaacgtggccacgtccccgaggcgaggttcaggtggacaggtgctcgtgggacagcttcactctcacgtatcgagctagtcgtccgacctgacgtagtttgacttagtttacttacgtgttaccagtccgtaacggtggcgtccgttcggaccttagtccgtaccgttcggaccgaacgggctcgacgtagacgtagtacgaaaccgtagtggtcgactcggacctacattcgtgttccttacg

SEQ ID NO: 48204 - DNA, 590 bp, Homo sapiens
  misc_feature: GYAE6OF01A772X.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattctttttgacacagtctccagacatcgtgtctgtgtctccgaggggagagagcccaccctctcctgcagggccagtcagagtgttgccgactcctggcctggtaccaacaaaacctggccagcctccagctcgtcattcatggcacatccaacgacgggccactcggcactcccgaggctaggttcagtggcagtgctcgcgggacagtacttcactctacgacgatcgagctagtcgtaccgaccctagacgttatttgacttagttttacttacgtcgttacaacgtctaacgggtcggaccgtccgtcggtaccctaacgttcccgtacccgtttccgggacccgtaaagggtccttcggacgtcgggaagtacgtaacggaaacgtacgttcgggtcggtactcgacctaactattccgtgttcttacccg

SEQ ID NO: 48205 - DNA, 516 bp, Homo sapiens
  misc_feature: GYAE6OF01AUCYT.23.23.C01.1.454.CMB.1.raw
  modified_base (347)..(347): a, c, t, g, unknown or other
  misc_feature (347)..(347): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactggtgcgacaggcccctggaaaacgggctcgagtggatgggctgggtgagtcctagtgttgagaataccgggnattctcagaagttcaaggccaggctcagcctgacctggaacacttcagaagaacagaccattgaactgcgcggcctgacctctgacgacacggccgtgtattagttgtgcgagnggcggaggcgngtagtttgggattagtatggtatggacgtgtgggcgtaacgggg

SEQ ID NO: 48206 - DNA, 569 bp, Homo sapiens
  misc_feature: GYAE6OF01BOQ6T.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgttgccgactccttggcctggtaccaacaaaacctggccagcctccaggctcgtcattcatggcacatccaacgagggccactcggacactcccgaggcctaggttccaggttcggacaggtcggctcgtcgggaacagtacctttcacttctacacggtactcgacgctagtcgtccgaacccttggtaacgtattttgacttagtttattactgtcagcacgtgcgcctggcctatccaccttcggaccgtaacgggcctcggacgtcggagtaacgtacggaaaccgtacgttggaccggtctacggccctaacgacttccttgtccgtttac

SEQ ID NO: 48207 - DNA, 562 bp, Homo sapiens
  misc_feature: GYAE6OF01AICB3.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccagctcgtcattcatggcacatccaacgacgggccaactggcactcccgaggcaggttcagtggcagtggctcgtgggacagacttcactctcacgatcagcagtcgtaccgaccctgacgtattttgctagttttatacgtgtcagctaacggtgccgtccgtggccctatccgtaccgttcggaccgaagggtcctacggacgttacgggaagtacgtacggaaaaccggtacgttcgggtacggtactcggaccacccgtaatccttggttccttacccg

SEQ ID NO: 48208 - DNA, 713 bp, Homo sapiens
  misc_feature: GYAE6OF01BI9WI.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttcgccgtactccttggcctggtaaccaacaaaactggaccacgcctcccaggctcgtcattcatggcacactaccaacgacggccacgtggcactcccgaggccgtaggttcaggtggcgtaggtcggctcgtcggactaggacttcacttcgtacacgtactacgagaccgtaggtcgtaccgtacccgttagaacgttattttacgacgttaagtttttacttacgtagttacgaacgtacgtaacgggttcggcccgtccggttacggtaccccgttaagttccccgtaaccgggttttacccgggaacccggttaaacggggtacccttaccgggtaaccgttacggggtaagttaaccgtaaaaccggggtaaaccgggtaaaccggtttcgggttacccgggtaacgttacccggtaacccgttaacccgtaaacccgtttccggttacccgttttccgtttaaccccgg

SEQ ID NO: 48209 - DNA, 557 bp, Homo sapiens
  misc_feature: GYAE6OF01AMZFY.23.23.C01.1.454.CMB.1.raw
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagcctggggcatcagtgaaagtcacctgcaaggcttcaggatacaccttcaccaaatttgatatcaactgggtgcgacaggcccctggaaaagggctcgagtggatgggctgggtgagtcctagtgtgagaagtaccgggcattctcgagaacgttcaaggccaggctcagcctgacctggacacttaccgagaagaacacgaccctattaggaactgccgtcgccgtcgacctcgtcgacgacgacggccgtagtatttattggtgacgaggagggcggaggccggtcgtagttttagggattagttagttggttagtgggtacgttcggtggggtccggtaaaccgggg

SEQ ID NO: 48210 - DNA, 668 bp, Homo sapiens
  misc_feature: GYAE6OF01C0F4L.23.23.C01.1.454.CMB.1.raw
  modified_base (203)..(203): a, c, t, g, unknown or other
  misc_feature (203)..(203): n is a, c, g, or t
  modified_base (447)..(447): a, c, t, g, unknown or other
  misc_feature (447)..(447): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggganagacgccaccctctcctgcaggggccagtcagagtgttcgccgactccttggcctaggtaccaaacaaaaccgtcggaccacgcctcccgaggtcctcgtctattcatcggactacactaccgaacgcggccacgtacggcactcccgaggccgaggttccaggttcggacaggtcggcgtcgtagggactagtacttcactcgtacacgtatcagctaggtcgtccgtaccgtagtaacgttntttcgacttaacgttttagtaccgttggtacctaaggtaccgtacgggtccgtccggccgttacgggtcccttactacccgttaccggttccgaacccggtaaggggtaccctacggtaccggtagggtaacgtaacggttaaaccggtaaaacggtacggttcggtaaccgggcccttacgggaccctaccgtaagtttcccgttaggttcccttaaccg

SEQ ID NO: 48211 - DNA, 828 bp, Homo sapiens
  misc_feature: GYAE6OF01CZXV8.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccgagggganagacgccaccctctcctgcgagggccagtcaggagtgttcgccgtactccgttggcctaggtaaccaaacaaaacctggaccacgccctcccgaggctccgtctattcgagtcggacactactaccaaacgacgggccctacgtcggacctacgtccccgaggtccgtaacgggttcaagggttcggaccgtaaggttcgggtccgttacggtacggggaacctaacggttaccctttaccgtaccttaccgtacgtaaccggtactaccgtaacggtccgtaacgggttccggttaccccgtaaccccgttagggttaaccgtttagtttttacggaaccttttaaggtttttaccgttaacgttcggttaccgtaacggttaccccgtaaacggggttccggggacccggttacccgtttaccgggtaccccgtttaaccgtacccccgtaacccgggtttacccggggaacccgtaaacggggtacccgttaacccggtacgggtaccgggtaaagtaaccggttaaaccggaaaaccggttaaccggttcggggtaacggtaccccgtacggtaaccccgtaacccgttagtttacccggttccgttacccgttttaaccccg

SEQ ID NO: 48212 - DNA, 568 bp, Homo sapiens
  misc_feature: GYAE6OF01APGMN.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctcccaggctcgtcattcatggcacactccaacacgggccactggcactcccgaggcaggttcaggtggcaggtggctcgtgggacagacttcgactctcacgatcagcagtcgtccgaccctgacgtatttgactagtttatactgtcagctaagtcggctccgtggccctagtccgtacccgttcggacccgaacgggcctcggacgttagggaacgtacgtaacggaaaacggtacgtgggtacggtacctacggacccctactacgttccgttcggttcctttacccg

SEQ ID NO: 48213 - DNA, 575 bp, Homo sapiens
  misc_feature: GYAE6OF01DQNL7.23.23.C01.1.454.CMB.1.raw
  modified_base (562)..(562): a, c, t, g, unknown or other
  misc_feature (562)..(562): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggggagagagcccaccctctcctgcagggccagtcagagtgttgccgactccgttggcctaggtaaccaaacaaaaaccgtcggaccacgccctcccaggctcgtcattcatggacacactaccaacgacgggccacgtcggacactcccgaggctaggttcaggtggcgagtgctcgtgggacagtactcactctacacgatcgacgcacggtcgtccgacccgtgtacccgtattttcgcttagtttacttacgtgtacagtcgtaacggtcggccgtccgtcggcccttagtcctaccgttcggaccgtacggtctacggacgtaggagacgtaacgaaacgtacgtggcgcgtacgctacnttctcgttcttac

SEQ ID NO: 48214 - DNA, 700 bp, Homo sapiens
  misc_feature: GYAE6OF01EXGFV.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgttcgccgactccttggcctggtaccaaacgaaaaacctggccacgcctccaggctacgtcattcatggcacactccaacgacggaccacgtcggcacgtcccgaggccacggttcaggttcggacgtaggtcggcgtcgtgggaactaggtaccttcacctcctacgaacgattacgacgtccgtaggtcggtacccgaccccgtaggtaaccgttagtttttacgaccgttaagtttttaacgttaacgttcggttaccgtaacgttccgtaaccgggttcgggtacccggtcccgtttaccggggtccctttaaaccgttcccgttaacccggtttacccgggaacccggtaaacggggtacctccggtaaccggttgggaaacggtacgttaacggaaaacggttacgttacgggtacgggacttacggccctaaaccgttacttccgttgttcccgttaccg

SEQ ID NO: 48215 - DNA, 634 bp, Homo sapiens
  misc_feature: GYAE6OF01E5T0D.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcagggccagtcagagtgttgccgactccttggcctggtaaccaacaaaacctggccagcctcccaggctcgtcattcatggcacactccaacgacggggccacgtcggacactcccgaggcgaggttcaggtggcgagtcggctcgtgggacagacttcactcgtcacgactcacgctagtcgtaccgacccttgacgttattttcgacttagttttacttacgttcgtacgagtaccgtaacggtcgggccgtccgtcggtaccccttacgttacccgtaacccggtttccgggaacccgtaacggggtacccttacggaacgttacgggaacgtaacggtacggtaaaaccgtaacggttcgggtacggacttaccgtaccctaccgttattccgtttacgtcctttacccg

SEQ ID NO: 48216 - DNA, 633 bp, Homo sapiens
  misc_feature: GYAE6OF01BWTH8.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggggagagagcccaccctctcctgcagggccagtcagagtgttgccgactccttggcctggtaccaaacaaaacctggccagcctccaggctcgtcattcatggcacactaccaacgacgggccacgtcggcacgtccccaggctaggttcaggtcggctaggtggcctcgtacggggacaacggtaccttcactctacacggactcgagcaggttcgtccgacccgttgaacgttattttcgcgttagttttaactttactgttacacggtaccgaacggttcggccgtcccgtggtacccttacgtaccttacccgttcggaccgtaacgggtacctacggtacgttacgggaagtaacgtacgggtaaaaccgtaacggttcgggtacgggtacgtacggacctaacccgtaatttccgttcggttccttaccg

SEQ ID NO: 48217 - DNA, 578 bp, Homo sapiens
  misc_feature: GYAE6OF01EYDMD.23.23.C01.1.454.CMB.1.raw
  modified_base (203)..(203): a, c, t, g, unknown or other
  misc_feature (203)..(203): n is a, c, g, or t
  modified_base (360)..(360): a, c, t, g, unknown or other
  misc_feature (360)..(360): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgggagatattcttttgacacagtctccagacatcgtgtctgtgtctccgagggganagagcccaccctctcctgcagggccagtcagagtgttgccgactccttggcctggtaccaaacaaaacctggccagcctccaggctcgtcattcagtggcacatccaacgacgggccactggcactcccgaggcaggtcaggtggcaggtcgctcgngggacagtacttcactctcacgactcagcagtcgtcgaccctgacgtatttgacttagtttattactgtcagactaacggtggccgtcctggccctacgtccgtacccgttcggaccgtaacgggacctcggaccgttgggaacgtacgtaacggaaaaccggtacgttcgggtcggaccgtcggtaccctaccgtaacttcgtacgttccttaaccg

SEQ ID NO: 48218 - DNA, 737 bp, Homo sapiens
  misc_feature: GYAE6OF01DWUIC.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtcgtctcgagggganagacgccaccctctcctgcgagggccagtcagagtgtcgccgactccgttggcctaggtaaccaaacaaaaccgtggaccacgccctcccgaggtcctcgtactacttcagtcggaccactaactacccgaacgacgggccaacgtcggaccacgtacccgaggtccgtaggttcacggtcggcgtaggtcggtcgtggtacgggaactacggtacttacgaccttccgtacgaacgtactacgacgacgtacggttccgtaccgtacccgtaggtaaccgttagttttcggacgtttaggttttacttacgttgtaccgtacggtacgtaacgggtccggtaccgttccggttacggtcccttaccgttacccgtaccccggtttacgggaaccccggtaacggggtaccctaccgggaagttacgggggaaagttaacgggtaaaccggtaaaaccgggttaccggttcgggttccggtaaccgtaccggtacccaacgttaaccggtttccgttggtttacccttaacccg

SEQ ID NO: 48219 - DNA, 529 bp, Homo sapiens
  misc_feature: GYAE6OF01EQDRO.23.23.C01.1.454.CMB.1.raw
  modified_base (351)..(351): a, c, t, g, unknown or other
  misc_feature (351)..(351): n is a, c, g, or t
  modified_base (398)..(398): a, c, t, g, unknown or other
  misc_feature (398)..(398): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcagggccagtcagagtgttgccgactccgttggcctggtaccaacaaaaacctggccagcctccagctcgtcattcatggcacatccaacaggccacgtggcacgtcccaggcaggtcagtgcagtgctcnggacagtactcactctcacgtatcagctagtcgtccgacctgacgtntttgacttagttattactgtcagcaacgtgcgcgtgtacctactctaccgttcggcaagggtcacgacgtcggaagacgtacggtaaacgacgttggtacggtctacgtaccacctagttctgtccttacc

SEQ ID NO: 48220 - DNA, 600 bp, Homo sapiens
  misc_feature: GYAE6OF01BI1D4.23.23.C01.1.454.CMB.1.raw
  modified_base (305)..(305): a, c, t, g, unknown or other
  misc_feature (305)..(305): n is a, c, g, or t
  modified_base (381)..(381): a, c, t, g, unknown or other
  misc_feature (381)..(381): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccttggcctggtaccaaacaaaacctggaccagcctcccaggctcgtcattcatggcacntaccaacgagggccacgtggcactccccgaggctaggttcaggtcggcaggtggctcgtgggacagacttcactcncacgtatccagcagtcgtccacccgtgacgtattttgacttaagtttattactcgttacgacgtacgaacggttcgggccgtccgttcgggacccttacgtcccgtaacccgtttcgggacccgtaaacgggtcctacggacgttagggaagtacgtaacggaaaacggtaccgttgggtcgggtacctacggacctacctatccgttgttcccttacg

SEQ ID NO: 48221 - DNA, 783 bp, Homo sapiens
  misc_feature: GYAE6OF01ALJTW.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgcccaccctctcctgcagggccagtcagagtgttcgccgactccgttgcctggtaccaacaaactgccagcctccgagctcgtcattcatggcacactccaacgagggccacgtggacactcccgaggcctacggttacaggtcggacgacggtcgggaccttcggtacggggtaactaacggtaacccgtttccgaaaccgtttccgttaccgaaaccggtacttacccgtaacggtccgtaaacgggttcggttaaccccggtaaccccgttcgggttaaaccggttacgttttttaaccgggacccttttaagggttttttaaactttacccggtttccggttaaacgttccgggtaaacccgttaacgggttaccggggtacccggttcccgtttaccggggaccctttaaccgtttcccggtaaccccggttttacccgggaccggtaaacggggttacccgttaccgggtaacggtcggggtaaacgtacggtaacggaaaccgttaaacggttcggtaccgggtaccgtcggtaaccaccccgttaaggttcccttggtcccgtttaccg

SEQ ID NO: 48222 - DNA, 543 bp, Homo sapiens
  misc_feature: GYAE6OF01C3RCT.23.23.C01.1.454.CMB.1.raw
  modified_base (360)..(360): a, c, t, g, unknown or other
  misc_feature (360)..(360): n is a, c, g, or t
  modified_base (434)..(434): a, c, t, g, unknown or other
  misc_feature (434)..(434): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctggaggtgaagaagccgtggggcatcagtgaaagtcacctgcaaggcttcaggatacaccttcaccaaatttgatatcaaactgggtgcgacaggccccgtaggaaaaagggctacgagtggagtgggctgggtgagtcctagtgttgagaataccgggcattcncagaagttcaaggccaggctcagctgactggacacttcagaagaacagccatttgaactgcgcgcctgacctcngacgacacggcgtgtattattgtgcgtaggaggcgggaggccgcggttagtttttagggaaattagttagttaggttagttaggtacgtcgtggggccgtaaacggggg

SEQ ID NO: 48223 - DNA, 740 bp, Homo sapiens
  misc_feature: GYAE6OF01CZG8L.23.23.C01.1.454.CMB.1.raw
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (634)..(634): a, c, t, g, unknown or other
  misc_feature (634)..(634): n is a, c, g, or t
tcagacgcgagtatcacgaccggtgctcgatttagtacacgtgattagggagttgggggaggaactgctcagtttggacccagagggaaccatggaacgccccagctcagcttctcttcctcctgcctcctctcggcctccgagacgaccaccggatattatttctttagacactacgtctaccagacagtcgtgtctgtcgtcgtcggaggggagacgacgcccncctctccgngcgacggcagtcgaggtagttcggtcgccgtacgtccgttcggaccttaacggaaaccaaaacaaaccgtcggacctacgccctaccgacggtcctacgtctattcgagtccgacaacctactaaccgaacgacggacctacgtcgaccacgtacccggaggtaccgtaggtacgaggtcggagtcggtcggtcgttacggacgggacacgttacttccacttacgcgactcgtcgacgtacgagttccgaacgtccgtagttaacgtttcgttaacgtacgtttaacgttttactacgttacgacgtaacgaccgtttacgggccgtccggttaccgttaccggtacccttaccggtacccgttaacccgggttcgggaacccgtacggggttacccncggggttacggaaacggggtataaacccgggtaaacggtaaaccggtcgttcgggtaaccggtcctaaccgggtaccaaccgttgttccgttacgtcctttacccg

SEQ ID NO: 48224 - DNA, 601 bp, Homo sapiens
  misc_feature: GYAE6OF01EMHS3.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgccaccctctcctgcgagggccagtcagagtgttcgccgactccgttggccttacggtaaccaaacaaaaaccgtcggaccacgccctcccgacggcctcgtcattcagtcggcacactccaacgacgggccacgtcggcactccgaggcgtaggttcaggtcggctaggtcggctcggtcgggacagtaccttcaccttcgtacgacgtactcgagctacggtcgtccgtacctggacgttatttacgactttagttttactacgtcgtactacggactaacggtcggccgtccgtcgtaccttactcccgtaccgttcggaccgtaacgggctacggacgttggactagtacgaaacgtagtggtacgctcggacactattcgtcgtcttacg

SEQ ID NO: 48225 - DNA, 651 bp, Homo sapiens
  misc_feature: GYAE6OF01AWLTF.23.23.C01.1.454.CMB.1.raw
  modified_base (361)..(361): a, c, t, g, unknown or other
  misc_feature (361)..(361): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcgaggatacaccttcaacctaatttgatatcaacgtgggtcgcgacgacggcccccgtaggaaaacgggcctacggaggtggagtgggctgggtgagtctaggtgtgagaagtaccggntatctgagtagtacgagcaggctcagtcctgacctggaacctacttaccgaagaaacgtaacacgtacctaagtttcggaactcggcgccggtcctcgtaccctcgtacgaccgtacgaccggtccgttagttacgttagttcggtacggtcggaaggacgggtacgggaccgggtccggttaccgggttaaggtttttacgggtaaagtttaacgggttttaagttacggggtttaagttcggggttaaccggttcggggttaccggggggaacccgtaaaccgggggg

SEQ ID NO: 48226 - DNA, 555 bp, Homo sapiens
  misc_feature: GYAE6OF01EME1F.23.23.C01.1.454.CMB.1.raw
  modified_base (358)..(358): a, c, t, g, unknown or other
  misc_feature (358)..(358): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacacggcccccgtagggaaaacgggctcggaggtggagtgggctgggtgagtcctaggtgttgagaagtaccgggnattctcgagtaagttcgaaggccgaggctcagcctgacctggaacacttccagaacgaacacgccctagtttcgaactgccgcggcctgaccctcgtcgacgacgacggcgtgttattgttgtgcgaggaggcggacggccgcgtagttttgggaattagttagtggttagtggtacgtcggtgggccgtaacgggg

SEQ ID NO: 48227 - DNA, 563 bp, Homo sapiens
  misc_feature: GYAE6OF01BUO5O.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccttggcctggtaaccaaacaaaaacctggccagcctcccaggctcgtcattcatggcacatcccaacgacgggcccacgtggacactccccgaggcaggttccaggtggcaggtggctcgtgggacagacttcactctcacgatcagcagtcgtccgacctgacgtattttgacttagttttattactgtcagcaacggtcggcgcctggccttatccgtaccgttcggaccgaacgggcctacggacgttagggaagtagtacggaaaacgtacgttggtcggtcctaggaccaccgtattcgttcgtctttaccg

SEQ ID NO: 48228 - DNA, 715 bp, Homo sapiens
  misc_feature: GYAE6OF01CVM9X.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagatattcttttgacacagtctccagacatcgtgtctgtgtctccgagggganagagcccaccctctcctgcgagggccagtcaggagtgttcgccgtactccgttggcctaggtaaccaaacaaaaacctggaccacgcctacccaggcctcgtcattcatcggacacactccgaacgacgggcccaacgtcggaccacgtccccgaggacctagggttccaaggttcggacgtaggtgggtaccttcggtacggggaacaacggtacctttccaacgttcctacgaaccgtatcgaacgtccgtaaggttccggtacccggaacccgttaggtaccgtttagtttttacggactttaaggtttttaacttcgttacgtaccgaggtacctaacgggttcggcccgttaccgtcgggtacccttacgttcccgtacccggtttaccgggaacccggtaacggggtccctacgggtaaccgtgggtaacgacggttaacggaaaacgtacgttgggttcggaccgttacgacccgtaacctattaccggttcgttaccttacccg

SEQ ID NO: 48229 - DNA, 819 bp, Homo sapiens
  misc_feature: GYAE6OF01DP5U4.23.23.C01.1.454.CMB.1.raw
  modified_base (199)..(199): a, c, t, g, unknown or other
  misc_feature (199)..(199): n is a, c, g, or t
tcagacgcgagtatcacgaccggtgctcgatttagtacacgtgattagggattgggggaggaactgctcagtttggaccagagggaaccatggaagcccagctcagcttctcttcctcctgctcctctggcctccagacgaccacggagattattctttgacacagtctcagacatcgtgtctgtcgtctcgagggganacgacgccacctctccgtgcgagggccagtcagtagtgtcgccgtctcgtgcctagtaaccaaacaaaccgtgaccacgcctccgaggcctcgtactacgttcagtcgacaactacgtaccaaacgcggaccacgtcgacacgtcccgaggtcgtacggttcgaggtcggacgtagggtcggtaccttacggacgggaaactacggttaacctttccgaaccgtttcgaaccgtaacggtacttaccgaacgggtcctaagggttccgtaccccggtaaaccgttacgggtaaacgtttaacgtttttccggaaaccgtttttaaaggtttttaacgtttaccgttacgggtaaccgtaacggttaaccggtaaccggttccgggtaccggttcccggtttaacggaccctttaacgttaccccggttaacccgggtttaccggaaaccgggttaaacgggtcccggttaaccggtaaaccgggttacgggtaaaagtaaccgggttaaacccgggtaaaacggttaccgggtttacgggtaccgggtaaccgttacccggtaaccgtaaaccccgtttaaggtttacccccgttttagggttaccccgttttaaacccg

SEQ ID NO: 48230 - DNA, 525 bp, Homo sapiens
  misc_feature: GYAE6OF01DXHOS.23.23.C01.1.454.CMB.1.raw
  modified_base (352)..(352): a, c, t, g, unknown or other
  misc_feature (352)..(352): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaagggctcgagtggatgggctgggtgagtcctagtgttgagataccgggcattctnagaagttcaaggccaggctcagcctgacctggaacacttccagaagaacagcccatttggaactgcgcggcctgacctctgacgacacggccgtgtattattgtgcgagacggcggaggccggcgtagttttgggaattagttatggtatggacgtcgtggggcgtaacgggg

SEQ ID NO: 48231 - DNA, 561 bp, Homo sapiens
  misc_feature: GYAE6OF01EQ2UJ.23.23.C01.1.454.CMB.1.raw
  modified_base (311)..(311): a, c, t, g, unknown or other
  misc_feature (311)..(311): n is a, c, g, or t
  modified_base (440)..(440): a, c, t, g, unknown or other
  misc_feature (440)..(440): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgggagatattcttttgacacagtctccagacatcgtgtctgtgtctccagggggagagagccaccctctcctgcagggccagtcagagtgttgccgactccttggcctggtaccaacaaaacctggaccagcctccaggctcgtcattcatggcacatccaacngggcccactggcatcccaggcaggttcagtggcaggtgctcgtgggacagtacttccactctcgacgtatcgaagcaggtcgtccgaccctgaacgtatttgctagtttatactgtcagcaacgtggcnccgtaggcctactctaccgtttcggaccgaacgggtctcgtacgtgggaacgaacgttacggtaaacgaacgttgggtacgggtctacgggtaccctaccgtagttccgtgtcctttaccg

SEQ ID NO: 48232 - DNA, 687 bp, Homo sapiens
  misc_feature: GYAE6OF01BM36W.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagccgtggggcatcagtgaaagtcacctgcaaggcttcgaggatacaccttcaacctaaatttcgatactacaacgttgggtacgcgacgacgggacccctaggggaaacggcgtacggaggtggagtgggactgggtagtagttccgtagttggttaggacgaacgtaccgggctagttcctacgagtaacgttacgaacggccgaaggtcctacgacgcctacgaccgtaggaacctaccgttacaaggaacgaaccacgtaccctagttacggaacgttcggacgtacgtcccgtacgtaccctacgtacgaaccggaccgtaccgggtccgttaggttaactttaggttcgtacgggacggtaacgggtagggccgggtaacgggtccggtacggtttaaggttttagggaaactttagtttaggtagggtttagttacgggaccggtttcgggtaccgggggtacggtaaccggggg

SEQ ID NO: 48233 - DNA, 600 bp, Homo sapiens
  misc_feature: GYAE6OF01EQ943.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttcgccgactcttggcctggtaaccaacaaaacctggccagccctccaggctcgtcattcatggacacactccgaaacgacggggcccactcggacactcccgaggtccaaggttcaggtggaccaggtcggcctcgtagggacagtacctttcacctctaccacgatacgagctagtcgtccgaccctggtacttatttcgacttagtttattcgtgtacagacgtacggtcggcgtccgtacggccttacgtcccgtaacccgtttccgggaccgaagggtaccctcggaacgtgggtaacgacgtaacggtaaacgtcggttacggtcggacgtacgaccaaccgtattcgttgtcttaccg

SEQ ID NO: 48234 - DNA, 648 bp, Homo sapiens
  misc_feature: GYAE6OF01DSZ3M.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggctcaggatacaccttcacctaaattgatatcaactggtgccgacgacggcccctaggaaaacggtctcgagtggagtgggctgggtgagtccgtagtgtgagaagtaccgggctagttctacgagtaacgttcgaacggccgaaggtcctcgacgtcccgtagacccgtaggaaacctaccgttaccaacgtaaacgaaacacgtacccctaagtttacggaacttcggccgtccggtaccctacggtacccttacgacggaccggaaccgaccgggtcccgttagttaactttagttcgtcggacggtacggacgggtccgggaacgggccggtaccggttaggttttacgggaattacgttaggtaggttagtcgggtaagttccggtaggggcccgtaaaccgggg

SEQ ID NO: 48235 - DNA, 669 bp, Homo sapiens
  misc_feature: GYAE6OF01EKUIY.23.23.C01.1.454.CMB.1.raw
  modified_base (369)..(369): a, c, t, g, unknown or other
  misc_feature (369)..(369): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccttggcctggtaccaacaaaacctggccagcctccaggctcgtcatcatggcacatccaacacgggccactggcatcccgaggcaggttcagtggcagtggctcgtgggacagacttcactcncacgatcagcaggtcgtccgaacccgtgacgtattttgaccttagttttacttacgttgtaccgtagtaccgtaaaccgggttcgggcccggtcccgttacggggacccctttaacgttccccgttaaccccggttttcccggggaacccgtaaaccggggggtacccttaccggggtaaccgttacggggaacgttaaacggttaaccgggtaaaaaccggtaaccggtttcggggtacgggtaccgttaccgggtacccgttaacccctaagtttcccgttcggttccctttaacccg

SEQ ID NO: 48236 - DNA, 588 bp, Homo sapiens
  misc_feature: GYAE6OF01C33CW.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagatattcttttgacacagtctccagacatcgtgtctgtgtctccgagggganagagcccaccctctcctgcagggccagtcagagtgttgccgactccgttggcctggtaaccaacaaaaacctcggaccacgcctcccaggctcgtcattcatggcacactaccaacagggccactggcactcccaggcaggtcagtggcagtggctcgtggacagacagtcactctacacgatcagcagtgtcgaccctgacgttatttgctagtttactacgtgtcagctaacggtcggaccgtccgttcgggaccttacgtcctacccgtttcccgggaccgtaaacgggtaccttacggacgtacgggtaaggtaacgtaaggaaaaccgtaacgtacgggtcggacgttcggacctacccgtaacttccgttcgttacccg

SEQ ID NO: 48237 - DNA, 687 bp, Homo sapiens
  misc_feature: GYAE6OF01B4BNA.23.23.C01.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgagggganagacgccaccctctcctgcagggccagtcagngtgttcgccgtactccgttggcctaggtaacccaaacaaaaccgtggaccacgccctccgaggtcctcgtcacttcagtcggacacactccaacgacggccacgtggccacgtcccgaggcgtaggttcaggtcggcgtaggtcggacgttcggtagggacctacggtaccttacacgttccgtacgaacggtcttacgacgtccgtaaggttccggtaccggtacccgttaggtaacgttagttttcggacgtttagttttacgttacgttgtaccgtacgtaccgtaacggttcgggtaccgtccggttacgtcccttacgtcccgttaacccggttcgaaccggtacggtacctcggtacgtgggtaaacgtcggtaacgaaaccgggtacgttcgggtaccggtctaccggtacccgtacgttacgttccgttacgttccctttaaccgg

SEQ ID NO: 48238 - DNA, 704 bp, Homo sapiens
  misc_feature: GYAE6OF01A5GRZ.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttacgaggatacaccttcaacctaaatttgatatactaactgggtgcgacgacggcccctaggaaaagggtctacggaggtggaagtggggccgggtgacgtccgtagtggttgaagtaacgtaccgggctacgttcgtacgtaaggtaagttcgaaaggccgaagggtctcgaaggcccgtaggaaccgtaggaacctaccgttaccgaagtaaacgaaacacgtacccgtaagtttacggaacgtacggcggaccggtaccgtacgtaccctcgtacggaccgaaccgtaccgggtacccgttaggttaactttacgttcggtacggaccggtagggtaacgggtacgggtacgggtaccggtacgggttaggtttttagggaacgtttaacgttaggttacgggttacgttaggggttaccggttacggttcgggggacccggtaagggggtaaccccggg

SEQ ID NO: 48239 - DNA, 562 bp, Homo sapiens
  misc_feature: GYAE6OF01D4DDH.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgtcgccgactccttggcctcggtaaccaacaaaacctggaccagccctccaggctcgtcattcatggccacactacccaacgacgggccactggctaacgtcccgaggcaggttcaggtcggcaggtcgcgtcgtgggacacgtacttcacttcacacgatcagctgtcgtccgacctgactatttgcttagtttactactgtcacgtctacggtgcgtcgtcggtaccttagtccgtaccgttccggaccgtaacgggtctacggtagtcggagtacgtacggaaaacgtcgtggtacggctacgctaactgttcgtcgtcttaccg

SEQ ID NO: 48240 - DNA, 537 bp, Homo sapiens
  misc_feature: GYAE6OF01CDV21.23.23.C01.1.454.CMB.1.raw
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (456)..(456): a, c, t, g, unknown or other
  misc_feature (456)..(456): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctaggaaaggctcgagtggatggctagggtgagtctagtgttgagatacgggnattcncagagtcaaggccaggctcagcctgacctggaacacttacagaagaacagcccatttcggaactgcgcggcctgacctctcgacgacacggccgttagtattagttgngtcgaggtaggcggaggccgtcgtagttttacgggaattagttagttcggttagtggacgtcgtggggtccgtaaacgggg

SEQ ID NO: 48241 - DNA, 543 bp, Homo sapiens
  misc_feature: GYAE6OF01B4A0K.23.23.C01.1.454.CMB.1.raw
  modified_base (369)..(369): a, c, t, g, unknown or other
  misc_feature (369)..(369): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggggagagagccaccctctcctgcagggccagtcagagtgttgccgactccttggcctggtaaccaaacaaaaacctggccagcctcccaggctcgtcattcatggcacatccaaacacgggccaacgtggcaacgtccccaagggctaggttcaggtggcagtcggctcgngggacagacttcactctcacgatcagcagtcgtccgacctgactatttgctagtttatactgtcagcaagtcgcgccgtggcctagtccgaccgttcggaccgtaagggacctcggactgggacgtagtacgaaacgtacgtggtaggcttagccaccgtattctgtccttacg

SEQ ID NO: 48242 - DNA, 726 bp, Homo sapiens
  misc_feature: GYAE6OF01BPGOO.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccagtggaagccccagctcagcttctcttcctcctgctcctctggctcccagagaccaccggagatattcttttgacacagtctccagacatcgtgtctgtgtctccagggganagagccaccctctcctgcagggccagtcagagtgttcgccgtactccgttggcctggtaaccaaccaaaacctcggaccacgccctcccgacggcctcgtactattcagtcggacacgactaccaaacggacgggacctaacgtcggcactacccgaggccgtaggttccaggtcggctacggtggcgtcgtaggggaacacggtacctttaccgaccttcccgtactaacggtacttaccgaacgtacgtacggttccgtacccggtaaccccgttaggttaaccgttaacgttttcggaccgtttagttttaacgttacgtagttaccgacgtacgtaacgggtcgggtccgtccgtacgggtacctttacgtaccctaacccggtttccggaccggtaacgggtaccgttaccggaacgttacggtaacggtaacgtaaacgggtaaaccgtaacgttgggtaaccgggtccgtacggtaccctaacccgtaagtttcccgttacggttcctttaacccgg

SEQ ID NO: 48243 - DNA, 730 bp, Homo sapiens
  misc_feature: GYAE6OF01DDIXM.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctccagacgaccaccggagtatatttcttttgacactagtctccagacatcgtgtctgtgtctcggagggacgagacgcctacctctcctgcgacgggccagtcagtaggtgttcgccgtacgttccgttcggcctacggtaaacccaaaacgtaaaaaccgtcggaccaacggccctcccggagtccttcgtcacttcacgtcgacacactaccgaaacgcgggacctacgtcggacctaccgtcccgacggtcgtacggttacgaggtcgacgtaggtcggtacgtcggtacgggaacacgtaccttacaccgtactacgaacgtcgtacgacgtactacgggttacctaccgacccgttagtaaccgttagtttcgacgtttaaggtttactttacgtacgtacgacggtaacggtacggtcgggtccgtccgtaccggtaccttaaccgtaccttaacccggttaaccgaacccggtacgggtacccttacgggtaacggtacggaaccggttaaacgaaacgggtaaacgttacggtcggttacgggcctaacgggtaccttacgtaccgttcgttacgttacccgttaccg

SEQ ID NO: 48244 - DNA, 715 bp, Homo sapiens
  misc_feature: GYAE6OF01DSGV9.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagccgtggggcatcagtgaaagtcacctgcaaggcttcaggatacaccttcacctaaatttgaatatacaacgtgggtgcgacgacggccccgtaggaaaacgggctacggagtggagtgggcgtgggtgagtccgtagtgtaggagtaacgtaccgggactattcgtacgtaagtaacgttcgaaggccaggcctcgacgccgtagaccgtacggaacctaccgttacgaagaaacgaaccacgtaccctaagtttacgggaactcggaccggcggtcccgttacgacccttacgtacggtaacccggaaccgtaccgggtacccgtttagttaacgtttacgtttcgggtacggtaccggtaagggtaccggggacgggtaccgggtacccgggttacggtttaaggttttttacggggtaaacgtttaggtttaaggttacgggtttaacggttacggggttaccgggtttaccgggtacgggggtaaacccggtaaaccgggggg

SEQ ID NO: 48245 - DNA, 709 bp, Homo sapiens
  misc_feature: GYAE6OF01BSUYZ.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccgtggcctggtaccaacaaaacctggccagcctccaggctcgtcattcatggcacatccaacgacgggccacgtggccacgtcccgaggactaggttccaaggtcggctaaggtcggctcgtacgggaactaggtacctttacaccgttcgtaccgaacgtacttaccgacgtctaaggttccggtaccgtaccccgttaggtaaaccgtactttttacggacctttaaggttttaacttttaaccgtcggttaccgtaacgggtaccgtaaaccgggttcgggtaccgtccccggttacggtaccccgtttaacgtacccgtacccgttttacccggggaacccgtaaacgggggtacccttaccgggtaccgttcgggaaacgtaacgttaccggaaaaccgtacggttcggtacggtacctacgggaccctaaccgtacgttccgttacgttcccttaccg

SEQ ID NO: 48246 - DNA, 693 bp, Homo sapiens
  misc_feature: GYAE6OF01BSQFP.23.23.C01.1.454.CMB.1.raw
  modified_base (201)..(201): a, c, t, g, unknown or other
  misc_feature (201)..(201): n is a, c, g, or t
  modified_base (396)..(396): a, c, t, g, unknown or other
  misc_feature (396)..(396): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccacggagatattcttttgacacagtctccagacatcgtgtctgtgtctccgagggganagacgcccaccctctcctgcgagggccagtcagagtgtcgccgactccgttggcctaggtaaccaaacaaaacctggaccacgcctccgaggtctcgtctattcatggcacactaccaacgacgggccaacgtcggacactcccgaggcctaggttcgaggtcggactaggtggctgtgggaactaggtcttacncttcaccgagactcgagcgtaggtcgtacccgtacctaggtacgttagttttcgacgtttaagttttacgttacgttcgttaccgaacggtaccgtaacgggttccggacccgtccggttacgtacccgttaacgttacccgtaacccggtttcggaacccgggaaacgggtacccgtaaccggtacggtacggggtaaacgtaacggttaaacggtaaaacccggtacgtttacggggacgttacccgtacggtaccctaaaccgttagtttccgttaccggttcctttaacccgg

SEQ ID NO: 48247 - DNA, 644 bp, Homo sapiens
  misc_feature: GYAE6OF01B3T92.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttcgccgactcctggcctggtaaccaaacaaaaccgtggaccacgccctccgaggctcgtcattcagtggcacactaccaacgcgggccacgtcggcctacgtcccgaggccgtaggttcgaggtcggcgtaggtcggctcggtacgggactacgtacttcactcgtacacgtactacgagtcgtaaggttcgtaccgacccgtaggtaaccgttagttttcgactttagttttacttacgtgttaccgaagtccgtaacggtcggccgtccgtcggtacctacgtcccgtaccgttccgggaccgtaacgggtccttacgggacgtacgggtaacgtacgtaacggaaaccgtacggtggtacgggtaccttcggaccctacgtaagttccgttcgttcgttacccg

SEQ ID NO: 48248 - DNA, 541 bp, Homo sapiens
  misc_feature: GYAE6OF01AK406.23.23.C01.1.454.CMB.1.raw
  modified_base (201)..(201): a, c, t, g, unknown or other
  misc_feature (201)..(201): n is a, c, g, or t
  modified_base (351)..(351): a, c, t, g, unknown or other
  misc_feature (351)..(351): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacgagggccactggcatcccaggcaggtcagtggcaggtggctcgngggacaggacttcactctcacgatcagcaggtgtcgaccctgacgtattttgcttagtttacttacgtgtacagctaacggtggccgtcgtcggcctactccgaccgtttcgggacctaagggacctcggacgtggagacgttacggaaacgtaactggttaggctggccaaccagttcttgttccttcg

SEQ ID NO: 48249 - DNA, 575 bp, Homo sapiens
  misc_feature: GYAE6OF01AW0DV.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacagaaacctggccaggctcccaggctcctcatccatgatgcatcccaacgacgggtccctgggccgtccccaagaccgtagggttcccgtggcctaggtcggggtctaggggacaggtacgttcactctaccgaccgttcagccagccgtggacgtcctgatgtatttgacttagtttcttctgtcagcagtccgtccgccgaccgccgctcgtaccggtttcgggccgggggactaggggtggaggagtcggaacggacggtaacgtggtcggcgtacgcctaccgtagttcgtagttccttcgtcgttcccg

SEQ ID NO: 48250 - DNA, 539 bp, Homo sapiens
  misc_feature: GYAE6OF01BVVG9.23.23.C01.1.454.CMB.1.raw
  modified_base (201)..(201): a, c, t, g, unknown or other
  misc_feature (201)..(201): n is a, c, g, or t
  modified_base (438)..(438): a, c, t, g, unknown or other
  misc_feature (438)..(438): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactcttggcctggtaccaacaaaacctggccagcctcccaggctcgtcattcatggcacatccaacgacgggccactggcatcccaggcaggttcaggtggcaggtcggctcgtgggacagtacttcactctacacgatcagcagtcgtccgaccctgacgtatttgctagtttattactgtacagctaacgtggcnccgtggcctagtccaccgttcggaccgaagggcctcgtacgtgggaagtagtcgaaacgtacgtggacggtctacggtaccacctattcgtgttccttacg

SEQ ID NO: 48251 - DNA, 604 bp, Homo sapiens
  misc_feature: GYAE6OF01DNRLB.23.23.C01.1.454.CMB.1.raw
  modified_base (351)..(351): a, c, t, g, unknown or other
  misc_feature (351)..(351): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagcctggggcatcagtgaaagtcacctgacaaggcttcaggatacaccttcaccaaatttgatatcaactgggtgcgacaggccccctaggaaaagggctacgagtggagtgggctgggtgagtcctagtgttgagagtaccgggntattctcagaagttcaaggccgaggctacacgcctgacctaggaacctacgttcaagaacgaacaacgaccctagtttacggaacttcggccgcggtccgtcgaccctcgtcgaaccgacgaccgggcccgttagttatttattggtggcgaaggagggaccggagggcccggtacggttagtttttacggggaaattacgttagtagggttacgttacgggtacggttacggtcgggggccgtaaacggggg

SEQ ID NO: 48252 - DNA, 574 bp, Homo sapiens
  misc_feature: GYAE6OF01EZ43X.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatcccaacgacgggccacgtcggcactcccaggcaggttcagtcggcagtggctcgtgggacagacttcactctacacgactcagctaggtcgtccgtaccctgtacgtattttcgacttagtttatactgtacagtctacgtggctccgtcggtaccttacgtcctaccgttcggaccgtaacgggtacctcggtacgtgggaacgtacgtaacggaaaccgtaacgttcgggtacggtactcggacctacctaagttcgttcgttcttaccg

SEQ ID NO: 48253 - DNA, 769 bp, Homo sapiens
  misc_feature: GYAE6OF01CR31V.23.23.C01.1.454.CMB.1.raw
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccgagggganagacgccacctctccngcagggccagtcagagtgtcgccgactccgtggcctaggtaaccaaacaaaaccgtggaccacgaccctcccgaggcctcgtactattccgagttcggacaacactaccgaaacgacgggacccaacgtcggactacgtaccccgaggtaccgtagggtttaccgaaggttcgggacctaagggttcgggaccgttccgggtaacgggggaaacctaacggttaccctttacacccgtttacgtaaccgaaaccggtacttaccgtaagaaccgttacgggttaccgttacccggaaaccccgttaggtaaccgtttaagttttacgaaccgtttaagttttaacgtttaccgtagtaccgtacggtaaccgtaacgggtccggtaccggttaccctacgggtcccctttaagtacccgtacccggtttaccgggaccggtaacgggaccttaccgggaagttcgggaacgtaacggtaacggaaaacccggtagttcgggtaccggtctaacggtacccaaaccgttgtttaccgtggttccctttacccg

SEQ ID NO: 48254 - DNA, 797 bp, Homo sapiens
  misc_feature: GYAE6OF01A6DXY.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgaggggagagagccaccctctcctgcgagggccagtcagagtgttcgccgacttccgttggcctggtaccaaacaaaacctcggaccagccctccgaggctcgtcattcatggcacactaccaacgacgggcccacgtcgggacctacgtccccgagggtccgtaagggtttccgaaggttcggaccgaagggttcgggccttcggtaggggaaccaacgtaaccgtttccgaaaccttccgttaccgaaaccggtacttacccgaaggtccgtaacggtttcggtacccgtaaccccgttagggtaaaccgtttaagtttttacggaaccgtttaagggttttttaacttaaccgttggttaccgaacggtaccgttaaccgggttcgggcccgttacccggttacgggtacccctttaacggttcccgttaaccccgggttttacgggaaccccggttaaacgggggtacccttaccgggtaaccggttaggggtaaccgtaaggtaaaccggtaaaaccgggtaaacgtttcgggtacggggtaccctacggggtaccctaacccgttaaggttttcccgttaggtttccccgttaacc

SEQ ID NO: 48255 - DNA, 649 bp, Homo sapiens
  misc_feature: GYAE6OF01B0BYU.23.23.C01.1.454.CMB.1.raw
  modified_base (202)..(202): a, c, t, g, unknown or other
  misc_feature (202)..(202): n is a, c, g, or t
  modified_base (328)..(328): a, c, t, g, unknown or other
  misc_feature (328)..(328): n is a, c, g, or t
  modified_base (392)..(392): a, c, t, g, unknown or other
  misc_feature (392)..(392): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcgagggccagtcagtagtcgttcgccgtactccgttggcctacgggtaacccaaaacaaaaaccgtggacccacggccctcccgaggcctcgtcattcagtcggcacntaccaacgacgggccacgtcggcactcccgaggctaggttcaggtcgcaggtgctcggtggacngacttcactcacacgtatcagtcagtcgtaccgacctgaacttgtttcgactttaagtttacttacgtcgtacgacgtacgtaacgtcggaccgtccgtaggtccttacgtccgtacccgtttccgggaaccgtaacgggtccgtacggtaacggtacgggaacgttaacggtaaccggtaaaaccggtacggttggtacccggtcttaacgggtacccctaacgttaccggttacgtttccgttcccgttaacccg

SEQ ID NO: 48256 - DNA, 663 bp, Homo sapiens
  misc_feature: GYAE6OF01CY7MA.23.23.C01.1.454.CMB.1.raw
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (509)..(509): a, c, t, g, unknown or other
  misc_feature (509)..(509): n is a, c, g, or t
tcagacgcgagtatcacgaccggtgctcgatttagtacacgtgatttaggggagttggggggaggaactgctcagtttggacccagagggaaccatggaagccccagctcagcttctcttcctcctgctcctctggcctccgagacgaccaccggagattattcttttgacacagtcctccagacatcgtgtctgtgtctcgagggganagagccacctctccgngcgacggccagtcaggngtgtcgccgacttcgtggaccttaggaaacccaaactaaaaccgtcggaccacgccctaccgagggtctcgtctattcagtcgcacactaccacgacggaccacgtgacctacgcccgaggtacgtacggtacagggtaggcgaggtcgacgttcgacgggaactgtacttacacttcgtacacgtagtaccagggtactagggttccgtaccgtaacccggttgtaaccgtttattttcggaaccgtttaagttttaccgtttacnggttacaacgtcggtaacggttcggacccgtccgtacggtcccacgttaccgtaccgggttacggacgtaacggggtctccgaagggttcgaagtaacgtacggaaacgttcgttggaccgtacgtacgactacctagttccgttatccgttcg

SEQ ID NO: 48257 - DNA, 526 bp, Homo sapiens
  misc_feature: GYAE6OF01D8ASP.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaaacaaaaacctggaccagcctccaggctcgtcattcatggcacactccaacgacgggccactggcactcccgaggctaggttcaggtggcagtcggctcgtgggacagtacttcactctacacgatcagcagtcgtcgaccctgacgtatttgacttagtttattctgtcagcacggtgcgtccgtgctatcctacgttcgacgaggctcgacgtggagtagtacgaaacgtacgtggtcgctacgcaccgtatcgttgtcttacg

SEQ ID NO: 48258 - DNA, 622 bp, Homo sapiens
  misc_feature: GYAE6OF01BFCH5.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagattattcttttgacacagtctccagacatcgtgtctgtgtctccgagggganagagcccaccctctcctgcagggccagtcagagtgttgccgactccgtggcctcggtaaccaaacaaaaccgtggccacgccctcccgaggcctcgtcattcagtcggcacactaccaacgacgggccacgtggccacgtcccgaggctaggttcgaggtcggcgaggtcggctcgtacgggacacgtactcactcacacgtctcgagctagtcgtaccgaccctagtaacgttacttttgacgtttaagttttacttacgtcgtacacgtacgtaacggtcgggtccgtaccgttcggtacctacttccgtaacccgttccgggaaccggaacggggtacctacggacgttacggaacgtacgtaacggtaaaacgtcggttggcggtacgtacgacctactatcgttcgttcttac

SEQ ID NO: 48259 - DNA, 795 bp, Homo sapiens
  misc_feature: GYAE6OF01C1AKR.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgagggganagacgcccaccctctcctgcgacgggccagtcagagtgttcgccgtactccgttggccctaggtaacccaaacaaaacctcggaccacgccctcccgaggcctccgtactacttccagttcggaccaactacctacccaaacgacggggaccctaacggtcggacccacgtccccgaggtaccgtacgggttacaggttcgggccgtacgggtcggggtaccttcgggtaggggtaacctaacggtacctttccgaaccttccgtaccgtaaccgtacttccgaacggtaccctagggttcccgttacccgacccggttacggtaaccgtttaagtttttacgggactttacgggtttttaacttacggttcgtacgaacggtaccgtaaccggttccgggtaccgtccggttaccgggtacccttaacggtcccctaaccgggtttcccgggaacccggtaggggtaacccctcgggtaaacggttacgggaaccggtaacgttaaccgggaaaaccgttaacggtttcgggtaccgggtaccgttaccggaacccctaacgtacgtttccgttcggtttccctttaaccg

SEQ ID NO: 48260 - DNA, 674 bp, Homo sapiens
  misc_feature: GYAE6OF01BMXP0.23.23.C01.1.454.CMB.1.raw
  modified_base (200)..(200): a, c, t, g, unknown or other
  misc_feature (200)..(200): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctcgagggganagacgccaccctctcctgcagggccagtcagagtgttcgccgactcgttggcctaggtaccaaacaaaacctcggaccacgcctccgaggctcgtcattcagtcggacacactaccgaacgacggccaacgtcggcacgtccgacggtacgtacggtcgaggtcggcgtaagggtcggacgttcgtacggggaactacggtaccttccgtaaccgttccttacgaaccgtaagtccgaacgacgtacgggtacgtacccgtaaccgtagtaacggttacgttttacgacgtttaacgttttactacgtttcgtactacggtacgtacggttcggccgtccgtacggtaccctacgtccgtaccgttccgggaaccggtaacgggtcctacggtacgtaggtaacgtacggtaacgtaaacggtcggtacgtcggacgtaccggtacctacggttagttcttacgttcgttaccg

SEQ ID NO: 48261 - DNA, 613 bp, Homo sapiens
  misc_feature: GYAE6OF01AD7Y1.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatatttcttttgacacagtctccagacattcgtgtctgtgtctcgagggganagacgcccaccctctcctgcgagggccagtcaggagtgtcgccgtacttccgtggcctaggtaacccaaacaaaaccgtcggaccacgtccctcccgaggccttcgtactattcagtcggcaacactaccaacgacggaccacgtcggcactcccgaggcgtaggttcaggtcggactaggtcggtcgtcgtacgggacacggtactcactcgtacgacgactcgagctacggtcgtacccgaccgtgtaacgttatttcgacttacgtttacttacgtgtactagccgtaggccgtacgtcgtcgtactacgtcctaccgttcggaccgtaacggccgtacgacgtaggaacgacgtaaggtaaacgcgtggtacgacgtacgtaccgacttatcgttcgttccttacg

SEQ ID NO: 48262 - DNA, 612 bp, Homo sapiens
  misc_feature: GYAE6OF01B39Z5.23.23.C01.1.454.CMB.1.raw
  modified_base (202)..(202): a, c, t, g, unknown or other
  misc_feature (202)..(202): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgatccttggcctggtaccaacaaaacctggccagcctccgagctcgtcattcatggcacatccaacagggccatggcactccaggcagtcagtgcagtgctcgtggacngactcgactcncacgatcgaacgcgtagtcgtaccgtacccctggaaccgtatttttcggaccttaaggtttttactacgtacgttacgaacgctaaacggttcggaccgtccgtagggtcccttaagtcccgtaacctttccgggaccgtaacgggcctacggtaccgttagggaacgtacgtaacggaaaacccggtacttcgggtacggtaccgttacgggaccctaacccgttagttcccgttaggttcctttacccg

SEQ ID NO: 48263 - DNA, 734 bp, Homo sapiens
  misc_feature: GYAE6OF01ESI40.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagacgaccacggagattatttccttttgacacagtctcagactatcgtgtctgtgtactcgaggganagacgccacctctcctgcgacgggccagtcgagtgtgttcgccgtctccgtggccgtacggtaaccaaaacgaaaaccgtcggaccacgccctaccgacggtctcgtctagtcgaagtcggacacgtactaccaagcggccagtcgacacgtccgagcgtacggtacacggtgaccgtaggtcggtcctcggtacgggactaacggtaccttaccgaccttaccgtacgtaaccgtacgttaccgacggtccgtaagggttccgtaacccgttacccttaggtaaccgtttacggttttacggaaccttttaacggttttaacttaccggttacgtacgtaaccggtaacggttaacgggtcccggtaccgtccgggttaacggcccttaaccgttacccggtacccgtacggtaaccccggtagggtacccttacgggaagtacgggtaactaacgggtaaccgtaaaaccggtggtaccgtacgggtacttacgaaccctacttaacgttccgtacgttcgttacccg

SEQ ID NO: 48264 - DNA, 832 bp, Homo sapiens
  misc_feature: GYAE6OF01EHHT2.23.23.C01.1.454.CMB.1.raw
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagccgtgggcatcagtgaaagtcacctgacaaggcttacgaggactacaccttacaacctaaatttgatactactaacgtgggtcgcgacgacggcccgtagggaaacgggtcgtacggaggtgggagtcggggcgttggggtagtacggttccgtaggttggttaggaaggtaaacggtaccggggtctaacgtttaccgtacgtaaggtaaacggttaccggaaacgggtcccgtaagggtcctacggacggtcccgttacggtaaccgttaccgggaaaccttaacccgttaccggaaacggaaacgaaacccgtaaccggtacccgtttaaagggtttaccgggtaaaccgttcgggacccgggtaccgggtaccccggttaccggtacccgttacgttaaccggaacccgggtaaccggtaaccccgggtccggttagtttaacgttttacggttcggttacgggacgggtaacggggacgggtaccggggaacgggtccccgggttacggttttaagggtttttaaacggggaattttaggtttaagggttacgggttaacgggttacgggttaacccggggtttcgggtaccggggggtaacccggtaaaccggggggg

SEQ ID NO: 48265 - DNA, 643 bp, Homo sapiens
  misc_feature: GYAE6OF01CLQ5O.23.23.C01.1.454.CMB.1.raw
  modified_base (362)..(362): a, c, t, g, unknown or other
  misc_feature (362)..(362): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaaccaaatttgatatcaactgggtgcgacaggccccgtaggaaaagggctacggagtggagtgggcgtggggtgagtccgtaggtgttggaggtaagtaccggggntagttcgtacgagaacgttcaacggccagggctacgacgcctacgaccgtaggaacctacttaccgaagaacgtaacacgacctagtttacggaacgttcggccgcggcctcgaccgttcgtacgaccgacgaccgggtccgttgttaacgtttacgttggtcgtacggagggtacgggcgggacgggtccggtacggttaaggtttttaggggtaatttaggttaaggttacggtaagtttcggggaaccgttccgggtgggggacccggtaaacggggg

SEQ ID NO: 48266 - DNA, 662 bp, Homo sapiens
  misc_feature: GYAE6OF01BMXG1.23.23.C01.1.454.CMB.1.raw
  modified_base (234)..(234): a, c, t, g, unknown or other
  misc_feature (234)..(234): n is a, c, g, or t
  modified_base (609)..(609): a, c, t, g, unknown or other
  misc_feature (609)..(609): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcagggccagtcagngtgttgccgactctggcctggtaacaacaaactggaccagcctccgaggctcgtcattcatcgacacactaccaacgacgggccacgtcggacacgtcccgaggcacggttcaggtggctaggtcggtctcggtacgggaacacggtactttccgaactccgtacacgacttacagtcgaggttcgtacccgaccttagaacgttattttcgactttaacggttttaacttaccgtggttaccgaaggtaccctaacgggttcggtaccgtcccgttacgggttaccctaacgttacccgttacccggttaccgggaaccgaacgggttcctacggaacgttcgggtaaagtaacgttaacggaaaaccgggttntcggggttcgaaccgttcggaacccctacttagttaccttcggttcttacccg

SEQ ID NO: 48267 - DNA, 587 bp, Homo sapiens
  misc_feature: GYAE6OF01B5EM4.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccgagggganagacgccaccctctcctgcgagggccagtcagagtgttgccgactcctggcctggtaaccaaacaaaacctggaccagcctccaggctcgtcattcagtggcacactaccaaacgacgggacctacgtcggcactcccgaggctaggttcaggtggacaggtcggctcgtgggacacgtacttcactctcacgactcagctagtcgtcgacctgacgtatttcgacttagtttactacgtgtacagtacgtaacggtgaccgtccgtacggtccttagtcctaccggtttacggaccgtaacgggtacctacggacgtgggaagtacggtaacggaaacgtacgttcggtacggaccgtcgacctacgtatcgttgttccttaccg

SEQ ID NO: 48268 - DNA, 709 bp, Homo sapiens
  misc_feature: GYAE6OF01BI19N.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctcagacatcgtgtctgtgtctcgaggggagagacgccaccctctcctgccgagggccagtacagagtcgttcgccgtactcgttggccgtaggtaaccaaactaaaaccgtcggaccacgaccctccgaggtctcgtacacttcgagtcggacacactaccgaacgacgggccacgtcggaccacgtcccgacggcgtacggttcgaggtcggcgtagggtcggtccgttacggtacggggaactacggtaccttcgtaaccctcgttaccgaccgtataccgaggtaccgtaggttcgtacccgaccgttacgtacgtttacgtttcgtacgtttagtttacgtacttaggttaccgacggtaacggtacggtacggaccgtccgtaccggtacccttacgtacccttaccggttaccgggacccgtaacggtaccgttaccggaggtaacggtaacgtaacggttaaacggaaaccggttacggtgggaccggtactacccgtacgtaacccgtacgttcttcgttacccttaccg

SEQ ID NO: 48269 - DNA, 567 bp, Homo sapiens
  misc_feature: GYAE6OF01AQ74E.23.23.C01.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgggagatattcttttgacacagtctccagacatcgtgtctgtgtctccagggganagagccaccctctcctgcagggccagtcagagtgttgccgactccgttggcctggtaccaacaaaacctggccagcctcccagctcgtcattcatggcacatccaacngggcccactggcactcccaggcaggttcaggtggcgagtggctcgtggggacaggtaccttcactctccgacgatccgagcaggtcgcgtaccctggacgttattttgacttagttttattccgtgtcagtcaacggtcggacgcccgtaggccctatccgaccgttcggacccgtaacgggcctcggactgggagtacgtaggtaaaaccgacgttggtcgtcttaggaccctacgtattccgtgttccgttaccg

SEQ ID NO: 48270 - DNA, 678 bp, Homo sapiens
  misc_feature: GYAE6OF01AFVNC.23.23.C01.1.454.CMB.1.raw
  modified_base (658)..(658): a, c, t, g, unknown or other
  misc_feature (658)..(658): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgcccaccctctcctgcgacgggccagtcagagtgttcgccgtacttccgttggccgttacggtaacccaaaaccgaaaaaccgtcggacccacgcccctcccgaggcctccgtctacttcagtcggcaacactacccaaacgacgggacccacgtacggcctaacgtccccgaaggccgtagggttaccgaggtcggcgtaggtcggccgtcgtcgggactacggtaccttcactcctacgtacgactcgagtcgtagttccggaccgtacccgtagtacgttatttcgacttagttttacttactcggttacacggtactaacggtcgtcccggtctacgggtacccttacgtacccgtacccgttcccggtaccggtaacgggtcctaccggtaggtacggtagaacggtaacggaaacgtcggttcgggacggtactacgtcccaacgngtttctcgttccttaacccg

SEQ ID NO: 48271 - DNA, 672 bp, Homo sapiens
  misc_feature: GYAE6OF01A7A7X.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctccgagggganagagccaccctctcctgcgaggccagtcacgagttgttcgccgactccttggcctaggtaaccaaacgaaaaaccgtgccacgcctacccaggctcgtcattcagtggcacactccaaagacgggcctacgtcggcactcccgaggctaacggttcaggtcgacgtaggtcggcgtcgtcgggtaacacggtaccttacgaacgttcctacgaacggtatccaaggtccgtaggtcgttccgaaccgtggtaaccgtttagtttcgacgttagttttaacttacgtgtacctagtaccgtaacgtgggcccgtaccgttcgtaccgttaccgtacccgtaaccggtttaccggacccggaaacggtaccgttcgggtacctagggggacttaacgaaccgggtaaacgtaaccggttggttaccggacgtaccgtaacgtaaccctaggtcctttagttccttacccgg

SEQ ID NO: 48272 - DNA, 686 bp, Homo sapiens
  misc_feature: GYAE6OF01DZH28.23.23.C01.1.454.CMB.1.raw
  modified_base (375)..(375): a, c, t, g, unknown or other
  misc_feature (375)..(375): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgcccactcccacgaggaattggtgcagtctgggcctgaggtgaagaagccgtggggcatcagtgaaagtcacctgcaaggcttcaggatacaccttcacctaaatttgatatacaacgtgggtgcgacgacggccccgtagggaaaacgggctacggaggtggagtcgggcgtgggtgacgttccgtaggttgttaggaagtaacgtaccgggntaacgttctacgaagtaacgttaccgaacgggccgaacgggtcttacgacgtcccgtagacccgtaggaacctacttaccgaaagaaacgaacacgtaccgtaagtttacgacgttgaccgtccgccgtacgacctcgtacggacgaaccgaccggtaccgttagttacgttagttggtacggacggagggtacgggaccgggacggggtaccggtacgggtttaaggtttttacgggaaatttacggttagttacgggttaacggtacgggtaacggttcccgggtagggggtacccggtaaaccggggg

SEQ ID NO: 48273 - DNA, 623 bp, Homo sapiens
  misc_feature: GYAE6OF01D69SF.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccaagacatcgtgtctgtgtctccgaggggagagagcccaccctctcctgcagggccagtcagagtgttcgccgacttccgttggcctacggtaacccaaaacgaaaaaccgtggccacgccctacccgaggcctcgtacagttcagtcggccactactaccaacgcgggaccacgtcgcacgtccgaggctacggttcaggtcggacgtaggtggctcgtacgggactacgtacttcaccgttcgtacgacgactacgacgacgtagtacgtaccgaccttggtaacttatttcgacttagtttacttacgtgacgaagcgtaacggtcggcccgtcggtaccgtacctacgtaccgtaccggttaccggaacggtaaccggtcacgtacggtaggaactaaggtaacgaaacgtacgtggacgtcaccgtacacgttatcgtctctaccg

SEQ ID NO: 48274 - DNA, 684 bp, Homo sapiens
  misc_feature: GYAE6OF01CSPGJ.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgaggggagagacgcccaccctcgtcctggccacgggccagtcgagtaggtgttcggccgtacctccttcgggcctaggtaacccaaacaaaaaccgtcggacccagccctcccgaggtcctcgtcacttcagtcggctacactaccaacgacgggacccacgtcggacacctccccgaaggccgtaaggttcgaggtcggactagggtcggctcggtagggacaggtaccttctactctacacgactcgacgacgtacggttcgtaccgtaccgtggtaaccgtttagttttcgactttaagtttacttacgtagtcgacgtaccgtaacgggtcgggtaccgtccgtacggtacctttcgtacccgtaccgttccgggaaccgtacgggccgtccggacgtacgggtaagtacggtaaacggtaaccggtaaaggtccggtacggaccttacgggaccctaccgtaagttccctttaggttcccttcg

SEQ ID NO: 48275 - DNA, 649 bp, Homo sapiens
  misc_feature: GYAE6OF01DD4FV.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaccatggaagccccagctcagcttctcttcctcctgctcctctggctcccagagaccaccggagatattcttttgacacagtctccagacatcgtgtctgtgtctccgagggganagacgcccaccctctcctgcagggccagtcagagtgttcgccgtactccgttggcctaggtaacccaaacaaaaacctcggaccacgccctacccgaggcctccgtacacttcagtggaccactactaccaacgacgggaccaacgtggaccaccgtacccgaggaccgtaggttccgaggtcggcgtaggtcggtcgtcggtacgggaacacggtaccttcgtaccttcgtaccacgtactcaacggtctaggttcgtaccgtacccgtgtacgttcgtttacgactttagtttactacgttcgacgtacgtacgtacggtcggccgtcgtcggtaccttacgtccgtaccgttaccggacgacgggtctaccggtacggtaggaagtacgtaacggtaaacgtgtacggtcgtacgtacgacctacgtattcgtcgttcgttaacc

SEQ ID NO: 48276 - DNA, 580 bp, Homo sapiens
  misc_feature: GYAE6OF01BFBTZ.23.23.C01.1.454.CMB.1.raw
  modified_base (524)..(524): a, c, t, g, unknown or other
  misc_feature (524)..(524): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgcccaccctctcctgcagggccagtcagagtgttcgccgactccgttggcctaggtaccaaacaaaacctcggaccacgccctccgaggctcgtcattcatggcacataccaacgacgggccacgtcggccactcccgagggccagggttcaggtcggcgaggtcggcgtcgtcgggacaggtacttcacttctcacgactcgagcgtagtcgtccgacctgacgttatttgacttagtttacttacgtcgtcgagacgtaacggtcggacgtccgtacggtcctacgtccgtacccgttcggaccgaacgggtaccncgacgtggaacgtagtacggaactacggtcgtagcacgtcacagtcttgtcttacg

SEQ ID NO: 48277 - DNA, 694 bp, Homo sapiens
  misc_feature: GYAE6OF01DB2KF.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgcctcctctggctcccagagacccaccggagatattcttttgacacagtctccagacatcgtgtctgtgtctccgagggganagagccaccctctcctgcagggccagtcaggagtgttcgccgactctggcctaggtaaccaaacaaaacctggaccacgcctccaggctcgtcattcatggcacactaccgaacgacgggacccacgtcgggacctactccccgaggaccgtagggttcaaggtcggactaggtcgggcttcgtagggacaacgtacttccgactcgtcaacgtatacgagtccgaaggttcgtaccgaacccgttggaaccggttaacgtttttgaccgttaaggtttttacttacgttcgtacgtaacggtacgaaaccggttcgggcccgtaacgttcgggtacccttaactcccgtaacccgtttccggaacccgttaaacggggtccttaccggaccgtacgggaacgtaacgttaaacgggaaaacgttacggttacggacggtacccgttacgaaccgtaacccgttaattcccggtagtttaccgttacccg

SEQ ID NO: 48278 - DNA, 720 bp, Homo sapiens
  misc_feature: GYAE6OF01AIYRP.23.23.C01.1.454.CMB.1.raw
  modified_base (227)..(227): a, c, t, g, unknown or other
  misc_feature (227)..(227): n is a, c, g, or t
tcagacgcgagtatcacgaccggtgctcgatttagtacacgtgattagggattgggggaggaactgctcagtttggacccagagggaaccatggaagccccaactcagcttctcttcctcctgctcctctggctcccagagaccaccggagatattcttttgacacagtctccagacatcgtgtctgtgtctccgaggggagagagccaccctctcctgcagggccngtcagagtgtcgccgactccgttggcctggtaaccaaacaaaacctcggaccacgccctccgaggctcgtacacttcatcggctacactccaacgacgggccacgtcggaccacgtccccgaggccgtagggttaccaaggttcggactaggtcgggcgttacggtacggggaaccaacggtacctttccgtaaccttcctaacgaaacggtactccgaacgtaccgtaacggttaccggtacccgtaaccccgttaggtaacccgtttaaggtttttcgaaccgtttaaggtttttaaccttacgttcgtaccgtacgtacccgtaacgggtcgggtcccgtaccggtacggtacccgttacgtcccgtaccgttccgggaccgtaacggggtcctaccggacgtacggtacgtaacgtacggtaaaccgtacgttcggtacggccgttacgacccgtaccgttagttcccttaggttcccttacgtacccg

SEQ ID NO: 48279 - DNA, 805 bp, Homo sapiens
  misc_feature: GYAE6OF01BQ1XI.23.23.C01.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
tcagacgcgagtatcacgaccggtgctcgatttagtacacgtgattagggattgggggaggaactgctcagtttggacccagagggaaccatggaagcccagctcagcttctcttctctgctcctctggctccagacgaccaccggagatattcttttgacacagtctaccagacatcgtgtctgtgtctaccgagggganagcgccacctctcngcgacgggcctagtcaaggtgttgttcgccgtactccgttcggtccgtaggtaaccaaactaaaaccgtggccgaacgccctaccgaggtacctcgtactatttacgacgtcggaccaaccgtactaccgaacggacgggtaccaacggtcggacctaaccgtccccggacgggtactacgggttacgtacggtacggacgtacgggtcggggacctttacggggacgggaaccgtacggttaacccttttaccgaaacctttcgtaccgtaaacgtaccgttacgaacggtaccgtaggttaccgggttaccccgtaacccgggttaggtaaaccggttttacgttttacggaaccgtttttaacggttttaacgtttaccgttacggttaccggtaacgggtaaccgtttacggtccggggtaccggtccgttaccgggtacctacggttacccgtaccggttaccggggacccgtaacggggtcccctaacgggtacggtcggtaaaccggtaacgtaacggtaaaccggtacggttcgggacgtccgtaaccggtactaccgttaagtccttaacggtctttaccg

SEQ ID NO: 48280 - DNA, 816 bp, Homo sapiens
  misc_feature: GYAE6OF01DBK2I.23.23.C01.1.454.CMB.1.raw
  modified_base (212)..(212): a, c, t, g, unknown or other
  misc_feature (212)..(212): n is a, c, g, or t
tcagacgcgagtatcacgaccggtgctcgatttagtacacgtgattaggggattgggggaggaactgctcagtttggacccagagggaacatggaacgcccagctcagcttctcttcctcctgctcctctcggcctccagagaccaccggagtattatttcttttagacacagtctccagactattcgtgtctgtcgtacgtccgagggganacgacgccctacccgttctccgtggaccgacggggtacctaggtccgtaggtacggttcggttaccggcccgtacgttcccgtttaccggaccgttaaccggtaaacccaaaaccgtaaacccggtccggtacccgaccgtcccgtacccggtacggtccttcggtacctactcgtacgtcggaaccacgtaaccgtaaccggacggaccgggtacctaccgggtacaccgtaccgtaccggaggtaccgtacggtacgtgggacgtacggtaggtcgtcgtggtacggacgtacctacgttaccacttaccgacgaacgtacgtacgacgtacgttaccggtccgttaccgtaacgttgtttaacgttcgttacgttaacttacgtttacgtcgtacgtacggtaacgtccggttaccggtccgtaccggttaccgtaccgtacccccgtaacgttccgggtacccgtaaaggggtacccgtaccgggtaacgttaggggaaccgttaggttaaacggtaaaccggtaacgtttcgggtaccgggcttacggcccttaacccgttattacccgtttaggtcctttaaccggccctttaacccg

SEQ ID NO: 48281 - DNA, 655 bp, Homo sapiens
  misc_feature: GYAE6OF01B8I6A.23.23.C01.1.454.CMB.1.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (357)..(357): a, c, t, g, unknown or other
  misc_feature (357)..(357): n is a, c, g, or t
  modified_base (439)..(439): a, c, t, g, unknown or other
  misc_feature (439)..(439): n is a, c, g, or t
  modified_base (637)..(637): a, c, t, g, unknown or other
  misc_feature (637)..(637): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctcgagggganagacgccaccctctccgtgacncgggccagtcaggtagtgttcgccgacttccgttggcctaggtaaccaaactaaaaaccgtcggaccaacggcctcccgaggcctcgtcacttcatggccactactaccaacgacggcctacgtcgcctaacncccgaggcgtacggttacaggtcggacgtaggtcgggacctcgggtacggtacgagtaccttacgccttactacgacgtacncgtacgcgagttcgaccgtccgtagtacgtttactttgtacttaggttttactacgttcgtacgagtaccgtaaggcggtaccgtccgtaggttaccctacgtcccgttacccggttcggtaaccgacggggtacctccgaacggtcggaacacggtaacgaaaccgtacggtggtaccgtacgtcggtactaaccgngttacgtcgttccttacg

SEQ ID NO: 48282 - DNA, 823 bp, Homo sapiens
  misc_feature: GYAE6OF01EXS1W.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganaggacgccaccctctcctgcacgggccagtcagtagtgttcgccgtacttcgttcggccttaggtaacccaaaaccgtaaaaaccgtcggaccctaacgccccttacccgaacgggtccttaccggtacctacgtttaccgacgttcgggaccaacgtaactaccccgaaaacggaccggggtaccctaacggtacgggacctaaccgtaccccggtaagggaccgtaacggggtttaccgaaacggggttcgggaccgtaacgggtcggggtccgttacgggtacggggaaacctacggttaaccctttaccgaccgttacctacgaacgtacgtacgtaacgacgtaacgggttcgtaccggtaccgttaggtaccgtttaagttttcgaacctttaagttttacgttacgtacggttacaacgtaccgtaacggttcgaccgtccgttacggtacccttacttacccgtaccggttacggaacccggtaacgggttaccgtaccggtaaccggttagggaaaccggttaaggttaaccggtaaaaccggtacggttcggtaaccggtccgttaacggaccctaaaccggttagttacccgttcggtttacccttaccg

SEQ ID NO: 48283 - DNA, 681 bp, Homo sapiens
  misc_feature: GYAE6OF01BMBIC.23.23.C01.1.454.CMB.1.raw
  modified_base (397)..(397): a, c, t, g, unknown or other
  misc_feature (397)..(397): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattgggtgcagtctgggcctggaggtgaagaagccgtggggcatcgagtagaaagtccaccgtgacgaaggtcttacgaggtactaccgtaccttacaacctaaatttgaattactactaacgtgggtacgaccgtacacgggtacccccgtagggaaaacggtcgtacggaggtggagtgggcgtgggtcggagtccgtagtgtgagtaacgtaccggntagtctagagtaagtcaacggcaggtctacgacgtccgtagaccgtacgaacctacgttaccaagtaacgaacgacgaccctaagttacgaactcggaccgtcggcctacgacctccgtacggaccgaccgtaccggtaccgttagttacgttagttcgtaggacggtaggacgggacggacgggtaccggtacggttaggttttacgggtaaacgtttagtttaggttacgggttacgttacgggtaccggttacgggtcggggggtaaccgtaaaccggggg

SEQ ID NO: 48284 - DNA, 924 bp, Homo sapiens
  misc_feature: GYAE6OF01AS5NY.23.23.C01.1.454.CMB.1.raw
  modified_base (902)..(902): a, c, t, g, unknown or other
  misc_feature (902)..(902): n is a, c, g, or t
tcagacgcgagtatcacgaccggtgctcgatttagtacacgtgattagggattgggggaggaactgctcagtttggacccagagggaaccatggaagccccagctcagcttctcttcctcccgtgcctcctcgtcgtccctccagacgacccgaccggatattacttttcgtttacgaccacgtacgtccctaccaacgaactcgttcgttcgtcgttgttcgtcctacgggagggagaggccgaccctaccctcctccgtcgcgggaaaaaccggccgtacgtacgacggtaggttcggtaccggacccgtaccctttccggttccggtccggttaaccggtaaaaccccaaaaaaaccccgtaaaacccggtcccggaacccgtacccgtacccccgtacccggtaccggtcccgttaccgtaccttaacttacctacggttccggaccacctacccgtaaacccgaacgggaccggtaccctaccggtcggacctaccccgtacccggacggaccggttacggtacgtacgggtacggacggtacggtcggtccgtacggggtacggacgtaccgttacctacctacccgttacctacccgaacgtaccgtaccggaccgtaccggttagggttcccggtaacccccgttacccggtaggttaacgttttttacggtttaccggtaaccggtttttaacgttttttaaccgttccggttaccgtaacgtaaccggtaacccgggttacgggtaccgggtccccttccgggtaccgtacccgtttacctacccggttacccgggtaccgaaccgggtacgtacccggtacgtacgggtacgtacgtaacgtaaccggtaaacgttcggttacgggcgtaccgacgtaccccgtaacgttntaccgttccgttccttacccgg

SEQ ID NO: 48285 - DNA, 655 bp, Homo sapiens
  misc_feature: GYAE6OF01D9DOH.23.23.C01.1.454.CMB.1.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgttgccgacttccttggcctaggtaccaacaaaacctggccagcctccaggctcgtcattcatgcacatccaacncgggccactggcactcccgaggtcccgtaggttcaggtcggcgaggtcgggcttcggtacgggaacacgtaccttacacttctacgacgtatacgagcgtagtcgtaccgtacccgttagaacgttagtttcgacctttaagttttacttaccgttgtacgtacgtacgtaacggttcgggccgtccgtacgggtacccttagtacccgtacccgtttcgggaacccgtaaaggggtcccttaccggtaacgttgggaaacgtaggttaaccggaaaaacggttacgttcggggtacggtccgttacggacctaaacccgtatttcccgttcggttccctttacccg

SEQ ID NO: 48286 - DNA, 588 bp, Homo sapiens
  misc_feature: GYAE6OF01EO2BY.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgcccaccctctcctgcagggccagtcagagtgttcgccgactccttggcctaggtaaccaaacaaaaacctggaccacgcctcccaggctcgtcattcatcggcacatccaacgacgggcccacgtggccactccccaggccaggttcaggtggcaggtcggactcgtgggacacgacttcactctcgacgtatcagcaggttcgtaccgtaccctggtaacttagttttgacttagttttacttactgtacagtcgtaacggtggccgtcgtcggacccttacgtcctacccggttcggaccgtaacggggtcctcggacgtaggacgtagtacggaaacgagtggtcggactcggacctacacgttcgtgtccgttaacc

SEQ ID NO: 48287 - DNA, 596 bp, Homo sapiens
  misc_feature: GYAE6OF01BCVU4.23.23.C01.1.454.CMB.1.raw
  modified_base (202)..(202): a, c, t, g, unknown or other
  misc_feature (202)..(202): n is a, c, g, or t
  modified_base (392)..(392): a, c, t, g, unknown or other
  misc_feature (392)..(392): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcagggccagtcagagtgttgccgactcctggcctggtaccaacaaaacctggccagcctccaggctcgtcattcagtggccacactaccaacgacgggccaacgtggcactccccgaggctaggttcaggtggcaggtcggctcgtgggactagacttcactctcacgtacncagcagtcgtccgtacccgtgacgtagttttcgacttagtttacttactgttacagtactaacggtggccgccgtacggcctatcccgtaccgttcgggacccgtaacgggacctacggacgtagggaacgtacgtaacgggtaaacctacggttcggtcggaccgttacgacccgtaccgttagtccgttcgttccttacccg

SEQ ID NO: 48288 - DNA, 660 bp, Homo sapiens
  misc_feature: GYAE6OF01BTHTQ.23.23.C01.1.454.CMB.1.raw
  modified_base (351)..(351): a, c, t, g, unknown or other
  misc_feature (351)..(351): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactccccacgaggaattggtgcagtctgggcctgaggtgaagaagcctggggcatcagtgaaagtcacctgcaaggcttcaggatacaccttcaccaaatttgatatcaacgtgggtgcgacacggcccctaggaaaacggctcgaggtggatgggcgtgggtgagtcctagtgtgagagtaccggnagttctacgagtaacgttacgaaggccgaggtctacgacgtccgtacggacccgtaggaaccctaccgttaccgaaggtaaacgaaaccgacgtacccctaagtttacggaaccgttcggaccgtccgggtcctacggacccttctcggaaccgtaccgaccggtcccgttagttaacgtttacgttcggtggaccggtagggacgggaccgggtacgggcccggtcggttaaggtttttagggaactttacgtttaggttacgggtagttcgggtaccggttcggtcgggggcccggtaaaccggggg

SEQ ID NO: 48289 - DNA, 606 bp, Homo sapiens
  misc_feature: GYAE6OF01CZ2RI.23.23.C01.1.454.CMB.1.raw
  modified_base (401)..(401): a, c, t, g, unknown or other
  misc_feature (401)..(401): n is a, c, g, or t
  modified_base (578)..(578): a, c, t, g, unknown or other
  misc_feature (578)..(578): n is a, c, g, or t
  modified_base (589)..(589): a, c, t, g, unknown or other
  misc_feature (589)..(589): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgcccaccctctcctgcagggccagtcagagtgttcgccgtactccgtggcctggtaacccaaacgaaaaacctggccacgccctcccgacggcctcgtcattccagtggcacactccaacgacgggcccaacgtcggacacgtcccgaggcaggttcagtggcaggtcggcgtcgtagggacagtacttcactcncacgatcgagtcgagtcgtaccgacccgtggtacgttatttcgcttaagttttactacgtgtcacgtacgtacggtcgtccgtccgtcggtacccttacgtcccgtaccgttaccggaccggtaacggccgttacggtacgtgggaagtacgtaacggaaacgtacgtggtcggacncggaccacctntccgtgttccgttaccg

SEQ ID NO: 48290 - DNA, 699 bp, Homo sapiens
  misc_feature: GYAE6OF01DEFVX.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgaggggagagacgccaccctctcctgcgagggccagtcagagtgttgcccgtactccgttggcctaggtaaccaaacaaaaaccgtggaccacgcctcccgaggcctcgtctatcatcggcacactccaacgacgggccacgtcggacactcccgacggcgtaggttcaggtcggacgtaggtcggcgttcgtagggactacgtacgttcacttctcgaacgatccagtccgtaaggttcgtccgaaccgtcgtacgtagttttcgacctttaggtttaacttacgtcgtacgtacgtaccgtaacggtcgggtacgtcccgtagggtaccccttaacggttcccgaacccggttttcggggaaccccgtaacggggtaccccttaccggggtaacttacgggggtaacgtaaacggttaacgggaaaaaccggttacggttacgggtacgggtaccgttacggaccccgtaaacgttagttacccttcggttactttaacccg

SEQ ID NO: 48291 - DNA, 636 bp, Homo sapiens
  misc_feature: GYAE6OF01AKLTB.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttcgccgactccttggcctggtaccaaacaaaacctggccacgcctccgaggctcgtctattcatggccacactccaacgacgggccacgtcggcacgtcccgaggctaggttcaggtcggcgaggtcggctcgtagggacaggtacttcactctcacgtatcagtcagtcgtaccgacctgtacgttatttgacttagtttatacgtgtcgaacgtcgtaacggtcggccgtccgtcggaccttacgtacccgtacccgttccggaaccggtaacgggtacctaccggtaccgtaggggaacgtaacggttaaccggaaaacccggttacggttcgggttaccgggtaccgttacgggtaacccctaaccgtagttcccgttgttacccgtttaacccg

SEQ ID NO: 48292 - DNA, 650 bp, Homo sapiens
  misc_feature: GYAE6OF01CD8ZM.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatatttcttttgacacagtctccagacatcgtgtctgtgtctccgagggganagagcccacctctcctgcagggccagtcagtagtgttcgccgacttccgttggccctggtaaccaaacaaaaacctcggaccaacgccctccgaggcctcgtcattcatggcaacactaccaacgacgggaccacgtacggcaacgtccccgaggtccgacgggttccaggtcggcgaacggtcggcttacgtgggactagtacttcgatttcacacgattcaagctaaggtcgtacgaccctagtagttactttacggctttaacgtttaacttccgtaggttacaacggtcaacgggtttcggcccgtccgttacgggtaccttacggtcctaaccgttccgggaaccgtaagggcccttacggtacgtacggagtaacgtaacgaaaccggtaacgttcgggtacggacttacggaccgtaacctagttccctggttaccttacg

SEQ ID NO: 48293 - DNA, 707 bp, Homo sapiens
  misc_feature: GYAE6OF01DDI35.23.23.C01.1.454.CMB.1.raw
  modified_base (185)..(185): a, c, t, g, unknown or other
  misc_feature (185)..(185): n is a, c, g, or t
tcagacgcgagtatcacgaccggtgctcgatttagtacacgtgattagggattggggagtcaacaaccacatctgtcctcgagaggacacccctgtgaccacagctcctcaccatggactggacctggacgatcctcttcttggtggcagcagccagagtcgcccactcccacgaggaattggtncagtctgggcctggaggtgaagagccgtgggcatcagtagaacgtcacctgcaacggtctacgagactaccgtaccttacaacctaaatttgaacttactacgaacgttgggtacgaccgaacgaccgggacccgtaaagggaaaacgggtcctacggtaggttacggacggttcgggacgttggggtacgtacggtaccgttaagggttcggttaaggacgttaaccggtaccgggacttacgtacgtacgaagtaccgtacgaacggtcgacgacttcaacggttccgtacgtaccgtacggtaaccttaaccgtacgaaacggaaagtaccgtaacgacccgttaagttaccggaacgtcggaccggtccgctacgtacctcggtacacgtacccgtacggtcgttagtaccttaggttccgagggactagggacgtccgggagccggtttaacggtagtttaggaacttagttaccggttaggtacctacggtacggtcggtagggaccgtaacgggg

SEQ ID NO: 48294 - DNA, 602 bp, Homo sapiens
  misc_feature: GYAE6OF01DL3EM.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagacgccaccctctcctgcagggccagtcagagtgttcgccgactccgttggcctaggtaaccaacaaaaaccgtggaccacgcctcccaggctcgtcatcatggcacactccaacgacggccacgtggccactcccgaggcgaggttcgagtcggactaggtcggctcgtgggacagtaccttcgactcgtacacgatcagcagttcgccgacctgtacgtatttcgacttagtttacttctcgtacacgtacgtaacggtcggccgtaccgtcggtaccctagtcccgtaccgttccgggacccgacgggtacctaccggacggtcggtaagtacgtaacggtaaaccgtacggttcggacggtactacgacctaacctagttcctgttccttaacccg

SEQ ID NO: 48295 - DNA, 786 bp, Homo sapiens
  misc_feature: GYAE6OF01B6VHZ.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggtaattggtgcagtcgtgggcctgaggtgaagacgccgtgggcagtcagtagaagtcaccgtgacgaaggtcttcgaaggtactaacctaccttacaaccttaaatttcggaaattatacgtaaacgtgggttacgaccgtaacgtacgggtacccccgtaaagggaaaacgggtccgtacggtaggtagggacggttaggggccgttaggggtaggtacggttacccgtaggttcggttagaacggtaacggttaccgggactacgtttaccgtacgtaacggtaacgttacgaaccgggtaccgtacggcttaccgacgtaccgtccggtaactacggaaacccgttacgtacgaacgtaaacgaacgtaccgaccttaagttacggaacctcggtaccgccggtacgtactaccgtacgacggttaccgaaccggtaccgggttacgttaacggttatttacggttacggtaggaccgggtaacggtacgggaccgggtaccgggtaccgttaaccggttttaggtttaaaccgggtagtttaacgttaggttaaggttacggtacggggtaacgtttccgggtaacgggggtcccgtaaacgggggg

SEQ ID NO: 48296 - DNA, 845 bp, Homo sapiens
  misc_feature: GYAE6OF01CCJ93.23.23.C01.1.454.CMB.1.raw
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccaggggganagcgcctacctctcgngacggcggactacgacgaaggtggttgtcgaccgtccgttcgtcgtcgttaccgaaaccaaaaacctaaaccggtcgaccgaccgtaccctaccggacggtcgtccgtactacttacgacggtacgacaactacctaaccgaaaccgggaccggaaccgtacggtaccggacttaaccccgtacccgggacggtaacgggttaccggtacggtaagggttccggacgtacggggtccgtaccgttaggggaccggtaacgtacgttacctacgtaccgtcgtaaccgtaacgtacgtacgacgtacggttacggtccggtacccctacggtaacgggtaacgtttttagttacccgggtaatttttaacggttttacgtaccggttaccgttaaccgaacggtaaacccggttacgggtaccgggccctttaacgggggtacccttaaccggtttacccgtaccccggtttaccgggtaccccgggaaacgggtaaccggttcccgtaacggttaccggggaaaggtaacgtaaaccggtaaaccggtaaacccgggtttgttaccgggggactaacccgccggtaaaccctacggtttctcccgggtttacttaccccgttaacccg

SEQ ID NO: 48297 - DNA, 685 bp, Homo sapiens
  misc_feature: GYAE6OF01C4FVC.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagattattcttttgacacagtctccagacatcgtgtctgtgtctccgaggggagagagccacctctcctgcagggccagtcagagtgttgccgactccttggccctaggtaacccaacaaaaacctggaccagccctccaggctcgtcattcatggaccacactaccaacgacgggccacgtggcacgtcccgaggccgtaggttcacggtggccgaggtcggcttcggtgggaacacggtacctttcgaaccgttctacgaacgactccgagacgtacgttacgtccgtaacccctggtaaccgttagtttttacggacgtttaacgttttacttaaccggttgtaccgtaacggtaacgtaaccgggtcgggtacccggtcccttacggggtaccctttaacgtcccgtaacccgtttacgggaacccgtaacgggtcctaccggtagtccgggaagtacgtaaacggaaaccggttaacggtagggtacggtaccgtcgtaactaacccgtatttccgtgttccgtttaacg

SEQ ID NO: 48298 - DNA, 607 bp, Homo sapiens
  misc_feature: GYAE6OF01A19OP.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcagggccagtcagagtgtgccgactccgttggcctggtaccaacaaaaacctggccagcctccaggctcgtcattcatggcacactccaacgagggccacgtggacatccccgaggctagggttcaggtgcagtggctcgtgggacaggtacttcactctacacgactcagcagtcgtccgacctgacgtattttgcttagtttactacgtgtacgagtctaacggttcggccgtccgttgggacccttagtacccgtacccgtttccgggaccgtaacgggtccgtaccggtaccgtgggaaacgtacgtaacggtaaaccggtaacgttcgggtcgggaccttacgggacctaacccgtagttaccggttcgttaccgtttaccg

SEQ ID NO: 48299 - DNA, 612 bp, Homo sapiens
  misc_feature: GYAE6OF01CU8UJ.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgcccaccctctcctgcgacgggccagtcagagtgttcgccgactccgtggcctggtaaccaaacaaaaacctggccacgcctcccaggtctcgtcattcatggccacactaccaacgacgggcccagtcggaccacgtccccgaggctacgggttcaggttggacctaggtcggcttcgtagggacagtacctcactctcacgatcagcagtcgtaccgacctgaacttagtttgcttagtttattactgtcagtacgtacggtcggacctccgtggtcccttagtcccgtaccgttcggacccgtaagggtccttacggacgtgggaacgtagtaacgggtaaaccgtacgttcgggtcggtacctacggacctaaccgtagttcccgttgttacccgtttaccg

SEQ ID NO: 48300 - DNA, 722 bp, Homo sapiens
  misc_feature: GYAE6OF01BP9JE.23.23.C01.1.454.CMB.1.raw
  modified_base (202)..(202): a, c, t, g, unknown or other
  misc_feature (202)..(202): n is a, c, g, or t
  modified_base (706)..(706): a, c, t, g, unknown or other
  misc_feature (706)..(706): n is a, c, g, or t
tcagacgcgagtatcacgaccggtgctcgatttagtacacgtgattagggattgggggaggaactgctcagtttggacccagagggaaccatggaagccccaactcagcttctcttcctcctgctcctctggctcccagagaccaccggagattattctttgacacagtctccagacatcgtgtctgtgtctccgagggganagacgcccaccctctccgtgcacgggccagtcaggtagttgtcgccgtactccgttggcctacggtaaccaaaccgtaaaaccgtcggacctacgccctaccgaggtcctcgtactaacttcagtcggaccactacctaccgaacggtacggacccacgtacggacctaccgtccccgaggggtactacgggtttcgaacgggttggacctgggtacgggtcttaccgggtagggaaccgtaacggtaaccctttacccgactttacccgtaccgtaaccgtacgtcgaccggtacgtacgggttccggtaccgtaccccgttaggtaccggtttaatttcgggtaacttaggttttaccttacggtgtacgtacggacgtaacggttcggtccgtacgtcccggtacttacgtcccgtaccggtacgacgtacgggcctacggcgtagacgtaacgacggtaacgtagtcggcgtaccgtacgaccttacgtacgttccgttnttccgttacgtacccc

SEQ ID NO: 48301 - DNA, 604 bp, Homo sapiens
  misc_feature: GYAE6OF01B21BH.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgagggganagagcccaccctctcctgcagggccagtcagagtgtgccgactccttggcctggtaccaacaaaacctggccagcctccaggctcgtcattcatggcacactccaacgagggccacgtgggcactcccgaggcacggttcaggtcggacaggtggactgtgggacagtacttcgactcgtactacgatcagcaggtcgtaccgacctggtacgttatttacggactttaggttttaacttacgtcgttacgacgtacgtaaccggtggtccggtcccgttagggtacccttacgttcccgttaacccgttcggggaaccgtaacgggtacctacggtacgtacggaagtacgttaacggaacgtacggtcggtagacctcgacactagtcctggtcttacg

SEQ ID NO: 48302 - DNA, 734 bp, Homo sapiens
  misc_feature: GYAE6OF01CNAIQ.23.23.C01.1.454.CMB.1.raw
  modified_base (249)..(249): a, c, t, g, unknown or other
  misc_feature (249)..(249): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgcccacctcccacgaggtaattggtgcagtcgtgggcctggaggtagaagagccgtgggcagtcagtagaagtcacctgacaggcttnaggtatactaccttacaacctaatttgatatacgtacgtggtcgacgacgacggacccgtaaggaaacggtcgtacggtaggtaggacgtagggtcgttgggtagtacgttaccgtagttaggttaggaacgtaacggtaccgggtacgtaacgtttaccgtacgtaaacgtacgttaacgaacgggtacgaacggtacctacgaaccggtccgttacggaaccgtaacggtaacctaaccgttaaccgaaaggaaacgtaaccgtaaccggtaacccttaagttaccggaaacgtcggacccggtaccggtcccgtacgtacccgttccgacggtaacccgacggtacccggtaccgtttagttacgtttaagtttgacggtcggaaggacggtcgggaccggtcggttacggttaggttttaagggacttaggttaggtggttacggtaggtaccggtacggtcggggtaccggtaaccgggg

SEQ ID NO: 48303 - DNA, 622 bp, Homo sapiens
  misc_feature: GYAE6OF01BYJX3.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcagggccagtcagtagtgttcgccgactccgttggcctggtaaccaaacaaaacctggaccagccctcccaggctcgtcattcatggcaacatcccaaacgacgggaccacgtcggaccactccccgaggcctagggttcaggtcggcaggtcggctcgtacgggacacgtacttcgactctacgacgatcacgcgaagttcgtaccgacccgttaggtaccgttagttttacgactttacgttttaattaccgtcgttacgacgtacgtaacggttcgggaccgtccgtacggtaccctacgtaccgtaccgttccggaaccgtaacggacctacggacgtggaacgtagtacggaaacgtacgtggtacgtcgtacgacctactactcgttgtccttacg

SEQ ID NO: 48304 - DNA, 639 bp, Homo sapiens
  misc_feature: GYAE6OF01BW592.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctccgaggggagagacgccaccctctcctgcgacgggccagtcagtagtgttcgccgacttccgttggccgtacggtaaccaaaccaaaaaccgtggacccaacgccctcccaggcttacgtctacttcatcggcacataccaacgagggtcacgtggcatcccgaggctaggtcacggcggacgacggtcggcctcggtacggggactacgtaccttcgactcctacgacgactcgagcagtcgtcgaccgtgacgttatttgacttagtttaacttactcgtacgagacgtacggtcgtcgtccgtacgtcccttacgtaccgtaccgttccgggaccgtaacggggtcctacggtacgtagggtacgtaacgtaacggtaaacccggtacggtcggtcggacttaccggaccaccgtaaccgtttctaccggttcgtttaacccg

SEQ ID NO: 48305 - DNA, 626 bp, Homo sapiens
  misc_feature: GYAE6OF01CFCCT.23.23.C01.1.454.CMB.1.raw
  modified_base (203)..(203): a, c, t, g, unknown or other
  misc_feature (203)..(203): n is a, c, g, or t
  modified_base (398)..(398): a, c, t, g, unknown or other
  misc_feature (398)..(398): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagatattcttttgacacagtctccagacatcgtgtctgtgtctccgagggganagacgcccacctctcctgcgagggccagtcagagtgttcgccgactccgttggcctacggtaaccaaacaaaaaccgtcggaccacgccctccgaggcctcgtcacttcagtcggcacactaccaacgacggccacgtcggcactcccgagctacggtcaggtggcgtaggtcgctcgtggacagtactcactcncacgactcacgcgtagtcgtaccgacctgtacgtagtttcgactttagtttacttacgtgtacaggtactaagttcggtacggccgttaccggtcggtaccttacgttaccgtacccgttccgggaaccgtaagggtaccctacgggtaccgtaggacggtaagtaaccggtaaaccggtacgttgggtacggaccgtacacgtaaccgtctttcggttcgttacccg

SEQ ID NO: 48306 - DNA, 880 bp, Homo sapiens
  misc_feature: GYAE6OF01D741F.23.23.C01.1.454.CMB.1.raw
  modified_base (204)..(204): a, c, t, g, unknown or other
  misc_feature (204)..(204): n is a, c, g, or t
  modified_base (437)..(437): a, c, t, g, unknown or other
  misc_feature (437)..(437): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggctcccagagaccaccggagatatttcttttgacacagtctccagacatcgtgtctgtgtctccgagggganagacgccctaccctctccgtgccgacgggccagtccgaggtacgttcgttcggcccgtacttccgttcgggccttaggtaaacccaaaaccaaaaaccgtcggaccacgccctacccgacggtcctccgtactacttcgagtcggacacactaccaacggacggaccacgtcggacctaacctcccgaggacgtacggttacgaggtcgcgtagtcggcctcggtcgggaacncgtacctacacgtctacacgtactacgacgtacgtacggtaccgtaccgtacccgttaggttaacgttacgttttcggtaaccggttttaacgtttttaacgttacccgttacggttaccggtaacggtaacccgggttaacgggttccgggtaccccggtacccggttaccggggtacccctttaaccgttaacccccggttacccgggtttaccccggggtaacccgggttaacgggggtaaccccgttaaccgggttaaccggggttaaaccggggtaaaccggggttaaaaccgggtaaaaaaccccgggttaaaccggggttaacggggttcccgggtttaaacccgggtacccgttaaacccgggtaaacccccggttaaaccgggtttaccgtttttaaccccggtttccccgttttaaccccgtttacccccggg

SEQ ID NO: 48307 - DNA, 809 bp, Homo sapiens
  misc_feature: GYAE6OF01CTI6D.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgccaccctctcctgcgacgggccagtcagagtgttcgccgactccgttggccgtaggtaaccaaaccaaaaaccgtcggaccacgccctacccaggctacgtcattcagtcggacacactaccaaacgacggcccagtcggacactacccgaggaccgtaggttccgaggtggaccgtaagggttcgggccgtttaccggtacgggggaacctaacggtacccttttaccgaaccgtttcctaaccgaaccggtaacttcgaacggtaccgtaacggttcggttacccgaaccccgttaggtaaccgtttagttttacggacctttaagggttttaaattaaccgttacgtaaccgtaacggtacggtaacccggttacgggtccccggttaccgttacgggtaccccttaaacgttcccgtaaacccggtttcccggggtaaaccgtaaacgggggtacctaacccgggtaacggttaggggtaaccgttaaacggtaaaccgggtaaaaacccggttaccggttaacggggtaccgggtaacccgttaaccggaccccggttaaaaccttaccgttcgtttacggttaccccttttaaccg

SEQ ID NO: 48308 - DNA, 631 bp, Homo sapiens
  misc_feature: GYAE6OF01C7DM6.23.23.C01.1.454.CMB.1.raw
  modified_base (599)..(599): a, c, t, g, unknown or other
  misc_feature (599)..(599): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccacggagatattcttttgacacagtctccagacatcgtgtctgtgtctccgaggggagagacgccacctctccgtgcgagggccagtcagtagtgttcgccgtactccgttggccgttaggtaacccaaaaccgaaaaccgtcggaccacgcccgtacccgaggtcctacgtactattacagtcggacacactaccaacgacgggacctacgtcgacactccgaggcgtaggtcgaggtcgcgtaggtcgcgtcgtacgggacagtaccttacaccgttcacacgtatacgagcgtagtcgtaccgacccgttgtaaccgttatttacgacttaagtttacttacgtcgtacagacgtacgtcggtacgtccgtagacctacgtcctaaccgttcggaaccgacggtaccgtacgaacgtaggacgtaacgtaacggaaacggttactgggaccgtnttaccgacgtaacctattcgttcgtccttacg

SEQ ID NO: 48309 - DNA, 730 bp, Homo sapiens
  misc_feature: GYAE6OF01DZOIC.23.23.C01.1.454.CMB.1.raw
  modified_base (446)..(446): a, c, t, g, unknown or other
  misc_feature (446)..(446): n is a, c, g, or t
  modified_base (699)..(699): a, c, t, g, unknown or other
  misc_feature (699)..(699): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggcctcccagagaccaccggagatattcttttgacacagtctccagacatcgtgtctgtgtctccgaggggagagacgcccaccctctcctgcgacgggccagtcaggtagtgttcgccgtactccgttggcctacggtaacccaaaactaaaaccgtcggaccacgccctccgacggctcgtctacttcagtcggccactactaccaacgacgggcctacgtcggacctaacgtaccgaacggacgtacgggttcagggtcggcgtacggtgggaccgttacggtacggggtactaacggttaccgtttacccncgtttaccgttacaaaccggtacgttaacgaccggtacgttaacgggttcccgtacccggttaacccccgtggttaaaaccggttttgttttaccggaccgttttaagttttacgttacgttagtaccgtacgtaccgtacgggtcggccgtaccccgttaggccccttagtacccgttaccgttacccgggaaccgtaacgggtcctacggaacgtacgggacgtaacgtaacgaacgtacgttggaccggntacggcctaacgtatcggttctacgttaccg

SEQ ID NO: 48310 - DNA, 612 bp, Homo sapiens
  misc_feature: GYAE6OF01CMSCV.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcgagggccagtcagagtgttcgccgactccgttggcctaggtaaccaaacaaaaacctcggccacgcctcccaggctcgtcattcagtcggcacactaccaacgacgggccacgtggcactcccgaggcaggttcaggtggctaggtcggctcgtgggacagtacttcactctacacgatcagcagtcgtccgacctgtacgtagtttcgcttagtttattactgtacagtacgtaacggtcggccgtccgtggtacccttacgtcccgtacccgtttaccgggaccgtaacggggtacctacgggacgtagggaacgtaacgtaacggaaaacggtacggtggtacggaccgtacggaccctaaccgtagttacgttcggttccttacccg

SEQ ID NO: 48311 - DNA, 798 bp, Homo sapiens
  misc_feature: GYAE6OF01AGN8P.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgagggganagacgccacctctccgtgccgagggccagtcagtagtgttcgccgtacttccgttggccttacggtaaccaaaaccgaaaaacccgtcgggacccaacggccccttacccgacggtaccgttccggtactactttaccagttcgggaccaaccgacttacccgaaacgacggggtacccaacgtcgggaccctacgtacccccgaggtccgtaacgggttccgaggttacggacgtaacgggttcgggccgtttaccggttaggggaacctaacgggtaaccctttacccgaacctttccgttaccaaccgggtactacgaacggacccgtaagggtttccgtaacccggttaccccgtaggtaaaccgtttagtttttacggacgtttaagtttttaacgttaaccgttggtacccgtaaggtaccgtaacggttcgggaccgtcccggttacggtacccttacgttccgttacccggttcggaacccggtaagggtcctcggacggttaggaacgtaacggtacggtaaaacctcggttcgggtacgaccgttacgaccgttaacccgtatttcccgttacgttccgtttacccg

SEQ ID NO: 48312 - DNA, 695 bp, Homo sapiens
  misc_feature: GYAE6OF01A6R2M.23.23.C01.1.454.CMB.1.raw
  modified_base (351)..(351): a, c, t, g, unknown or other
  misc_feature (351)..(351): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccacctctcctgcgagggccagtaccaggagtgttcgccgtacttccgttggcctaggtaaccaaaacaaaaaccgtcggaccaagccctcccgaaggctacgtctaattccagtcggcactacaccaaacgcgggacctacgnggacacgtaccccgaggtaccgtaggttaccaaggtacggccgtaagggtcggtacttcggtacgggaactacggactttaccgactaccgtacgaaccgatcgaagccgtagtacgtccaacccgtgtacgttacgttttgaacttagttttacttactagtcagtaccgtaaggttccgacgtccgtacggccttaaactcccgtaccgttacggaaccggtaacggtaccgtaccggtacgttagggaacgttaaacgtaccggtaaaaacggaacccgttgggtaaaccggccttacggtaacccaacgttacgttaccgttaccggttctttaaccccg

SEQ ID NO: 48313 - DNA, 632 bp, Homo sapiens
  misc_feature: GYAE6OF01AMVAI.23.23.C01.1.454.CMB.1.raw
  modified_base (234)..(234): a, c, t, g, unknown or other
  misc_feature (234)..(234): n is a, c, g, or t
  modified_base (574)..(574): a, c, t, g, unknown or other
  misc_feature (574)..(574): n is a, c, g, or t
  modified_base (623)..(623): a, c, t, g, unknown or other
  misc_feature (623)..(623): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgccaccctctcctgcgaggccagtcagngtgttcgccgtactcgtcggccgtacggtaaccaaaaccaaaaccgtcggacccacggaccctcccgaaggtcctacgtctattacacgtcggaccacgactaccgaacggacggaccctacgtcggactacctcccgaggcgtacggttcagggtcgcgtagggtcgtcgtgtacgggactagtacttaccgacttcgtaccgaacgactaccgagtcgtaggtccgtaccgaccgttagtaccgtttatttacggacttacgtttactacgtcgtactagaccgtacgcggtctacgtcgtacctactccgtacggtccgacgtacggtcacggtagnggaacgtacgaacggtaacggctcgggacgtcacgacctacgattcgtntcctaaccg

SEQ ID NO: 48314 - DNA, 661 bp, Homo sapiens
  misc_feature: GYAE6OF01CRY3E.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagacgaccaccggagattattcttttgacacagtctccagacatcgtgtctgtgtctccgaggggnagacgccacctctcctgcgacgggccagtcagtagtgttcgccgtactccgttggcctaggtaacccaaaccaaaaaccgtcggacccacggtcccctacccgaaggtccttccggtactagtttccaagttcgggacctacactacccaaacgacgggtccaacgtcggactacgtcccgaggacctagggttcaggtcggacgaggttcggctcggtaggacacgtacctcgacttcacgacgatcgagtcgagtcgtaccgaacccgtgtacgttacgtttacgaccgtttagttttacgttaacgtcgttacgtacggtacgtaacggttcggccgttacctcgggtacctacgtccgtaccgttacggaccgtagggtcctacggacgtagggaactagtaacgaaacgtacgtgggcgtacgtacgaccgtaactgttacgtgttcttaccg

SEQ ID NO: 48315 - DNA, 820 bp, Homo sapiens
  misc_feature: GYAE6OF01DBQEN.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgtccactcccacgaggaattggtgcagtcgtgggcctgaggtagaagagccgtggggcatcagtagaaagtcacctgacgaaggcttacgaggatacaccttacaacctaaatttgaatatactaacgtgggtacgaccgaccgacgggtacccccggtaagggaaaaacgggtccgtacggaacggtagggtacggttggggcggttaggggtgtaacgggttcccgtaagggttggttaggaaacggtaaacggtacccggggtacttacgtttacgttacgtaaggtaaacggttacggaaacggacccgaacgggtactaccggaaccgtacccgttaggtaacccgttaacgggaaacccttaaccgttaccggaaaaggaaaccgaaaccgaacggtaaccctaaggtttacggaaaccgttcggacccggtccggtacccgttacggacccgttcgacggaaccgaccggtaccgggtacgtttacgttaagtttacgttcggtcggtaacggtaacgtacgggtcgggacgggtaccggggtacccggttaagggttttaagggtttttaacggggtaaattttaaggttaggttacgggttaaacggttcggggttaacccggttcgggggtcccgggggtaaacccgggg

SEQ ID NO: 48316 - DNA, 574 bp, Homo sapiens
  misc_feature: GYAE6OF01DQ24V.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcagggccagtcagagtgttgccgactccgttggcctaggtaaccaaacaaaaccgtggccacgccctccgaggctcgtctacttcatggccacactaccaacgacgggccacgtggccactcccgaggcaggttcaggtggcaggtcggctcgtagggacagtacttcactctacacgatcgagtcgtagtcgtccgaccctgacgttatttgacttagtttatcgtgtcagtctacgtgcgtcctggacctagtcctaccgttccggactagggactcgacgtacggagtacgtacggtaaaacgacgttcggacggtctaccggcctaaccgtattcgttcgttccttaccg

SEQ ID NO: 48317 - DNA, 608 bp, Homo sapiens
  misc_feature: GYAE6OF01DLGEE.23.23.C01.1.454.CMB.1.raw
  modified_base (361)..(361): a, c, t, g, unknown or other
  misc_feature (361)..(361): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagccgtggggcatcagtgaaagtcacctgcaaggcttcaggatacaccttcacctaaatttgatatcaacgtggtgcgacacggccccgtagggaaaacgggctacggaggtggagtgggacgtgggtgagtcctagtggttgagaacgtccgggntagttctagaagtaagttaccgaaggccaggcctcgagtcccgtgacctacggaacctaccgttaccgaagaaacgaacgacgccctaagtttacgggaactcggccgcggtcctacgtacctcgtacgaccgacaccgggccgttgtattagttgtcgacggaggcgggacggagggtccgtacggtagttttaggaattagttagtaggttagtacgggtagttcggtggggccgtaaccggggg

SEQ ID NO: 48318 - DNA, 696 bp, Homo sapiens
  misc_feature: GYAE6OF01ALC98.23.23.C01.1.454.CMB.1.raw
  modified_base (599)..(599): a, c, t, g, unknown or other
  misc_feature (599)..(599): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagccgtggggcatcgagtgaaagtcacctgcaaggcttcgaaggatactaccttcaaccgtaatttagatactacaacgtcgggtcgcggaaccgacgggtacccccggtagggaaaacggggcctacgggtagggtacgggaaggtcggggtacggttcggggtacgtacggtttacccgttaggtggtttacggaaacgtaacggtaccgggtactacgtttacgtaccgtaagggtaaacgttccgaaaggggtccccgtaagggtcccttacgacggtcccggtagtacccggtacgtaactacctacgaaagtaacgaacacgtcctaggtacgacgtggccgtcggcctcgtacctcgcgacgtacgccggcgttatacttggtcgngacggtaggacgccgggtggaccggtcggtttaaggttggttaacttgtaacggttggtacggtacggttacggtcggaccgggggtcgaaccgggg

SEQ ID NO: 48319 - DNA, 822 bp, Homo sapiens
  misc_feature: GYAE6OF01DDBXP.23.23.C01.1.454.CMB.1.raw
tcagacgcgagtatcacgaccggtgctcgatttagtacacgtgattagggattgggggaggaactgctcagtttggacccagagggaccatggaagccccagctcagcttctcttcctcctgctcctctggctcccagagaccaccggagatattcttttgacacagtctccagacatcgtgtctgtgtctccgaggggagagacgcccaccctcctccgtgccacgggccagtccaggtagtcggttcgaccgtacttccgttcggccgtaggtaaccaaaaccgtaaaaaacccgtcgggacccacggcccctacccgaacggcctaccggttactacgtttccaacgtcggaccaacgtactacccgaaaccggacggggaccctaacgtcggacctaacgtaccccgaagggtccgtacggttcgaaggttcggaccgtaggtcggtcgtacggtacgggaactaacggtaccttcgaaccttcgtaccgacgtactacgacgacgtacggttaccgtaccggtaacccgtacggtaacggttacgtttttacgaccgtttaaggtttttaacgttacccgttaggttaccgtaacggaccggtaaaccggttcgggtacccggtcccgttaccgggtacccttaccggttacccgtaacccggttttacccgggaacccggtaaaccggggtaccgttacccgggtaaccgtacggggtaacggtaaccggttaaacggaaaacccggttaaccggttgggttccggtacgttaccggacccttaaacccgtagttccgtacgtttcccttaacccg

SEQ ID NO: 48320 - DNA, 805 bp, Homo sapiens
  misc_feature: GYAE6OF01E40AJ.23.23.C01.1.454.CMB.1.raw
  modified_base (204)..(204): a, c, t, g, unknown or other
  misc_feature (204)..(204): n is a, c, g, or t
  modified_base (788)..(788): a, c, t, g, unknown or other
  misc_feature (788)..(788): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagattatttcttttgacacagtctccagacatcgtgtctgtgtctcgagggganagacgccaccctctcctgcgaggggccagtcaggagttcggttcgcccgtaccttccgttcgggcccttacgggtaaacccaaaaccgtaaaaaacccgttcgggaccccaacggtccccttacccggaacggtcccttccggtacctaatttccgaacgttcgggacctaaccacgtaccccaaacggaccggggacccaacgtcgggacctaaccgtccccgagggtaccgtaacgggtttaccagggttcgggaccgtaagggtcgggtaccttacggggacggggaaacctaaccggttaccgttttacccgaacccgtttccgtaaccgtaccgtaacgttaccgaacggtaccggtaaacggtttccgggtaaccccgttaccccggttaaggttaaaccgttttacgttttacgaacgttttaacggttttaacttaccgttacgtaaccgacggtaaccgtaacgggtccggaccgtcgttccggaccttacgtccgttaccggttacggaccgtacgggtacctcggtacgtagggacgtagtacgaaccggtagtcggtacgacgtcgacctanacgttctcgtcttaccg

SEQ ID NO: 48321 - DNA, 626 bp, Homo sapiens
  misc_feature: GYAE6OF01B6WYS.23.23.C01.1.454.CMB.1.raw
  modified_base (370)..(370): a, c, t, g, unknown or other
  misc_feature (370)..(370): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagccgtggggcatcagtgaaagtcacctgacaaggtcttacaggatacctaccttcaacctaaatttgattatacaacgtgggtgcgacgacggccccgtaggaaaagggctacgaggtggagtgggtcgtgggtgagtcctaggtgttagagtagtaccgggntagttcagagtaagttcgaaggtccaggtctacgacgtccgtacgaccgtaggaacctacgttaccaagaaacgaacgtacgacccgtaagtttacggaacgtcggaccggcggccgtacgtacctcgtacggaccgtaccgaccgggtccttagttactttagttcgtgacggaggacgggcgggtacggtccggtcgttagttttacgggaattagttagtggtagtagggacgtcggtgggaccgtaacgggg

SEQ ID NO: 48322 - DNA, 589 bp, Homo sapiens
  misc_feature: GYAE6OF01DYALZ.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttcgccgactccttggcctggtaccaacaaaacctggccagccctccaggctcgtcattcatggcacatccaacgagggccactggcatcccaggcaggttcagtgcagtggctcgtgggacagtacttcactctcacgatcagcagtcgtccgaccctgacgtattttcgactagtttactactgtcacgtcgaacggtggacgccgtcggaccttactcccgtacccgtttcgggacccgtaacggggtacctccggtaacgtcgggaacgtacgtaacggtaaaaccggtaacgttcgggtacggtcgtaccggtaccaaccgtagtttaccgtcggtttccttaacccgg

SEQ ID NO: 48323 - DNA, 728 bp, Homo sapiens
  misc_feature: GYAE6OF01ATJ2H.23.23.C01.1.454.CMB.1.raw
  modified_base (206)..(206): a, c, t, g, unknown or other
  misc_feature (206)..(206): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggcctcccagacgaccaccggagattattcttttgacacagtctccagacatcgtgtctgtgtctccgagggganacgacgcccaccctctcctgccgagggccagtcagagtgttgccgtactccgttggcctacggtaaccaaaccgaaaaaccgtcggaccacggccctacccgacggccttcgtcctattcgagtcggccaacactaccgaaacgcgggacccacggtggccactcccgaggtctaggttcaggtggctaggtcggcgtacgcgggactacgtaccgttacctaccttccgtaccacgactaccgagtacgtacggtcgtacccgtacccgttaggtaaccgtttacgttttcgacgtttaagttttacgttaccgtcgtaccgacgtacgtaaccggtcggtcccgtccgtcggtaccttacgtacccgttaccggttacccgggaccggtaaacggggtccttacgggaaccgttacggggaaacgtacgtaaaccgggaaacgtaaccgggtttgggtaccggtacgttacccggaaccgttaaccggtagttttaccccggtgtttaccccgttacccg

SEQ ID NO: 48324 - DNA, 813 bp, Homo sapiens
  misc_feature: GYAE6OF01BBAHT.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcgagggccagtccagagtgttcgcccgtacttccgttggccgtacggtaaccaaaacctaaaaccgtggacccacgcctcccgaggcctcgtcattcgagtcggacacactacccaacgtcgggaccacgtggacctacgtcccgaggcgtaggttccaggtcggacgtaggtcggcttacggtacgggaacctacggtaccttccgtacgttcctaccgacgtacttacgacgtacgtacggttccgtacccggtaacccgttaggtaacgtttaacgtttcggttaccgttttagttttaaccgtttacgttacgttacgtaacggtaacccgttaacgggtcccggtaccggtacccggttccgggtacccctttaacgttaccccggttaccccggtttaacccggggaaccccggttaacggggtaacccgttacccggggttaaacgggtacgggtaaacccggttaaacggttaacccgggtaaaaccgttacccggggttcgggttaaccgggttaccccgtaacggtaccccgttaaaccgtttaccggtttaccgttttacccggtttccccgtttaaccccg

SEQ ID NO: 48325 - DNA, 739 bp, Homo sapiens
  misc_feature: GYAE6OF01CQ1MY.23.23.C01.1.454.CMB.1.raw
  modified_base (671)..(671): a, c, t, g, unknown or other
  misc_feature (671)..(671): n is a, c, g, or t
tcagacgcgagtatcacgaccggtgctcgatttagtacacgtgattagggattggggggaggaactgctcagtttggacccagagggaaccatggaacgccccagctcagcttctcttcctcctgctcctctggcctcccagagaccaccggagtattattcttttgacacagtctccagacatcgtgtctgtcgtcctccgaggggagagacgcccaccctctccgtgcgacgggccagtcagagtgtcgccgtactcgttcggaccgtacggtaacccaaaactaaaaccgtcggaccaacgtccctccgacgggtccttaccgactattcgaacgtcggacctactaaccgacccgaaacgaccgggaccaacgtcggacctaccgtcccggagcgtaacggttacgagggttcggacgtaggtcggaccgttagggtacgggtaacttacgtaacctttcaacccgttcaccgaaacggtactaccgaacggtacgtacggttcccggtacctaaccccgttggtaaccgttttaagtttcggactttaagttttactacgtcgtacgaacgtacccgtaaggtccgtacgtccgttacggtaccttacgtacccgttaaccggttacgggaacccctaaggggtaccctacggtacgacgggtaanaacggtaacgaaacggttcggtcgggtacggtacctcggaccctacgtagttcccgttgtacttcccg

SEQ ID NO: 48326 - DNA, 656 bp, Homo sapiens
  misc_feature: GYAE6OF01BWIG0.23.23.C01.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (452)..(452): a, c, t, g, unknown or other
  misc_feature (452)..(452): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctcgagggganagacgccctaccctctcctgcacgggccagtcagngtgtgccgtactctggcctaggtaaccaacaaaacctggccacgccctccagtctcgtcatcagtcggacacactaccgaagcggccacgtgaccactccgaggcgtaggttcaggtgacgaggtggccttcggtacgggaactagtaccttacgaccttcgtacgacgtactcgagtcgtaggtcgtccgtacccgttggtaacgttgttttanaccgtttagtttacttaacgtcgtacgtagactacgggtcgtccgaccgttcggaccttacgtaccctaccggttacgaaccccgggaagggttacccctacgggtaacggttccgggaaacggtacgttaaaccgggaaaacggttaccggtcggacgtaccgtaccgacccgttactacgtttaccgtgtttcccggttaac

SEQ ID NO: 48327 - DNA, 623 bp, Homo sapiens
  misc_feature: GYAE6OF01A8X2Z.23.23.C01.1.454.CMB.1.raw
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttaacacagtctccagacatcgtgtctgtgtctccaggggagagacgccaccctctcctgcagggccagtcanaggggtnttcgccgactccttggcctggtaaccaaacaaaaacctcggaccacgccctcccgaggctcgtcacttcatggcacactccaacgacggccactggcactcccgaggctaggttcgaggtggcgtagtggtctcggtacgggactacgtacttacactctcacgtactacgacgctagttcgtaccgtacccgtgtacgttatttcgactttagttttacttaacgtgtacgacgtccgtacgggtcggccgtccgtacggtccttacctccgttacccgttccggacgtaacgggtctacggtacgtaggaacgtagtaacggaaaccggtagttcggtggtacctggtaccctacgacttccggtctttccgttcgtacccg

SEQ ID NO: 48328 - DNA, 599 bp, Homo sapiens
  misc_feature: GYAE6OF01ALYEE.23.23.C01.1.454.CMB.1.raw
  modified_base (440)..(440): a, c, t, g, unknown or other
  misc_feature (440)..(440): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccgaggggagagagcccaccctctcctgcagggccagtcagagtgttcgccgacttccgttggcctggtaaccaaacaaaaccgtggccacgccctcccgaggctcgtctacttcagtggccacactaccgaacgacgggcccacgtcggcacgtcccgaggcctagggttcaggtcggcgtaggtcggcgtcgtgggacagtacttcactctcgacgtatcagcgtagtcgtccgaccctgtaccgtntttcgaccttagttttactactgtcacgctacggtcggcgtccgtcggacccttagtcccgtaccgttccgggaccgtaacgggccttcggacgtcgggaacgtacgtacggaaacgtaacgttggtacggtctacggacctactagttctcgttctcg

SEQ ID NO: 48329 - DNA, 726 bp, Homo sapiens
  misc_feature: GYAE6OF01CABD0.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgaggggganagacgccaccctctcctgcgagggccagtcagagtgttcgccgacttccgttggcctaggtaacccaaacaaaaccgtcggaccacgccctaccgaggcctcgtctattcagtcggacacactaccaacgcgggccacgtcggacactcccgaggccgtaacggttcgaggtcggcgtaggtcgggtctacggtacgggaacctagtacttccgaacttccgtaccgaccgtatccgtacgcgttaacggtccgtaccggtaccccgttagtacggtttacgtttacgacgttaagtttttaaccgttacgtgttaccgaaggtaacccgtaaccgggtttccgggtaccgtaccgggttaccgggtacccttaacgtttaccccgttacccgggtttaacccgggacccggttaacggggacccttacgggacggttacgggtaaagtacgtaaacgggtaaaccgtaacggttcgggtacgtacgttcggacccttacgtacttcgttcgttaccttccg

SEQ ID NO: 48330 - DNA, 693 bp, Homo sapiens
  misc_feature: GYAE6OF01DTQUG.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgcccaccctctcctgcgacgggccagtcagtgtgtcgcctactccgttggccgtaggtaaccaaacaaaaccgtcggacccacgccctacccgaggcctccgtactattcagtcggaccacactaccgaacgacgggcctacgtcggacactaccgaggtcctacgggttcaggtcggacgagtcggcgtcggtgggactacggtacttcgtactcgtaccgacgtactaccgagtacgtacggttaccggtaccgtaacccgtagtaaccgtttagttttacggtacttaacgttttattacgtcgtacgtacggtacctaacggtcgggacggtccgtccggtacctacgtacccgttcccggtacggaacccggagggttaccctaccgggtagtcgggaacgtaaccgggtaacgtaaaccggtacggttagggtaccgtcgtaccgtaccgaaccttcgttacccgttgttcctttaacccg

SEQ ID NO: 48331 - DNA, 722 bp, Homo sapiens
  misc_feature: GYAE6OF01C4PE0.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagattatttcttttgaacacagtctccagacatcgtgtctgtgtctccgaggggagagacgcccaccctctcctgcacgggccagtcagagtgttgccgtactccttggcctggtaaccaaacaaaacctgaccacgccctccgaggctcgtcattcatggccacactcccgaaacgacgggccacgtcggaccactaccccgaggcgtacggtttacgaacggtcggccgtaaggttcgggccgttcggtacggggaactacggttaccttactaccgttacctacgtaaccgtacgttaccgaacggtaccgtacggttacgtaccccggtaccccgttaggtaaccggtttaagtttttaccggacgttttaaggttttaacctttaccggtttacgtacgtaacgtcgtaaccggttcgggacccgtaccgttccggtaccgttacgttaccgtacccgtttacgggacccgtacgggtaccgtccggtaacgtcggtaaggtacgtaacggtaaacgtacggttcggtacggtactacgtaccacgttattccgttcgttcttaccg

SEQ ID NO: 48332 - DNA, 817 bp, Homo sapiens
  misc_feature: GYAE6OF01BORPX.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccacggagatattcttttgacacagtctcagacatcgtgtctgtgtcctccgaggggagaggacgcccaccctctaccgtcgacgacgggtccagtacgaggtacggttcgttcggacccgtaaccttcccgtttcggggtacccgttacgggtaaacccctaaaaaccgtaaaaaaacccgtcgggaaccccaacggacccccttaccccgaacggggtacccttaccggttacctacgtttaccgtacgttacgggacctaacctaactaccccgaaacggaccgggaccctacgtacgggacctacgtacccgaggaccgtaggtacagggtacggcgtaacgggtcgggcgttaccggtggggaacctaggtaacccttcgaccttcgtacaaccgtatacggaacgcggtaacggtccggttaacccgtaacccgtagggtaaccgtttacgttttcgaacgtttaacgttttaattaccgttggtaccgtaacgtaacggttacgggtacggtcccggtacgaccgggttacctaccggttaccgtaccccggttacggaacccggtaacgggtccgtacgggtacgtagggaacgtacgtaaacggaacggtacgtcgggttacgtaccttaccggactaccctacgtttcgttcgtcccgttaaccg

SEQ ID NO: 48333 - DNA, 715 bp, Homo sapiens
  misc_feature: GYAE6OF01CWJB6.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatccctcttcttggtggcagcagccagaagtgcccactcccacgaggaattggtgcagtctgggcctgaggtgaagagccgtggggcatcagtgaaagtcacctgacaaggcttcgaggatactaccttacaacctaaatttgaatatactaacgtgggtgcgacgacggccccgtagggaaaacggctacggagtggagtgggcgttggggtgtacggtccgtaggttcggttaggtaaggtaacgtaccgggctagttcgtacgaagtaacgttcgtaacggccaggcctcgacgtccgtacgaccgtaggaacctaccttaccgaaaggaaacgaaccgaacgtacccgtagtttacgggaactacggccggccggtccgtacggaccctcgtcggtaaccggaaccgtacccgggtcccgtttaggttaactttcgttacggtcggtacggaaacgggtacgggaccggggtacggtcccgggacgggtttaaggtttttcggggttaaagtttaggtttaacgttagggttacgttagggtaccgtttcggggtccggggtaacccggtaaaccgggggg

SEQ ID NO: 48334 - DNA, 791 bp, Homo sapiens
  misc_feature: GYAE6OF01EU0CU.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctcggctcccagagaccaccggagattattcgttttgacacagtctccagacatcgtgtctgtgtctcgagggganacgcgccctaccctctcctggacgacgggccaagttccgaggtagtcggttcgcccgtaccttccggttcggacccgttaggtaaacccaaaaccgtaaaaccgtcggacccacggtccctacccgacggtccttcgtactacttacgagtacggacctaaccacgtaccccaacggtaccgggacctaaccgtcggtaccaccgttacccgacggtccgtaacgggtcgaggtcggtactagggttcggcttcgggacgggaactactaccgttacacttacgtaccgacgtacttaccgaggtccgtaagtccgtaccgtaaccgttaggttacgttaacgtttcgtaacgtttagttttaaccgacgttccgtacgtacgtaccgtaacccgttgaaccgttaaccgtacccggttacccctacccgggtttaaccgggtcccggtaacggaacccgttacgaccggtacggtaacctacccgttaacccgaaacgggtttcgtacgggttccgggtacctacggtaaacccgtaacccttcgttacccgttaccggttttctacccgtaaccttttcccccgg

SEQ ID NO: 48335 - DNA, 872 bp, Homo sapiens
  misc_feature: GYAE6OF01DGB1W.23.23.C01.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
tcagacgcgagtatcacgaccggtgctcgatttagtacacgtgattagggattgggggaggaactgctcagtttggacccagagggaaccatggaagccccagctcagcttctcttcctcctgcctcctctggcctccagacgaccaccggagtatattcttttgacacagtctaccagacatcgtntctgtcgtctccggagggganagaccgccaccgttctccgtagcgagggccagtcgaggagtgttcgacctacgttccgtcgggcctaacggtaacccaaaaccgtaaaaccgtcgggacccacggtccctacccgaggtcctacgtctacttcaacgtggaccacgaacctaccgaaaaggtccgggacctacacgggaccacgttcccgaacgggtacgtacggttacgtcgacggacgaggttcggacgttcgggacggacgacgtacttaccgactaccgtacggtaacgtacaccgaggtaccgttaacggtaccggttacccgtacccgtaaacggtttacggtttacgttttaaccgggaacttttaaccgggttttaactttaccggaacggtttaccggaaccggggtaacccgtttaaggggttccccgccgggttccccgttaaccggtacccgttccttacccgggtttaacccccggtacgggggtaaccccgtaaaaccggggtcgtttaaccccggtaaggaaaccggggtttacgtaaaaccgtaaacccggggggtaaaaacgttccggttccgggggtaaccccgttacgttaacccgggtaaacccctacccggtttaacgtttttacccgggtttaccccgtttaccggtttttaaacccccccg

SEQ ID NO: 48336 - DNA, 703 bp, Homo sapiens
  misc_feature: GYAE6OF01EGM2O.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagatattcttttgacacagtctccagacatcgtgtctgtgtctccgagggganagacgcccaccctctcctgcagggccagtcagagtgtgccgactccttggcctggtaaccaaacaaaaccgtggaccagccctccaggcctcgtcattcatcggacactactcccgaacgacgggcctacgtcggactacgtcccgaggctacggttcaggtcggcgtaaggtcggctcgtcgggaactacgtacttacgaccttactacgaacgtaataccgacgtccgtaacggttacgtacccgtaacccgttaggtaacgttacgtttttacgactttaaggttttaacttaccgtaggttaccgaacggtaccgtaacgggttcgggacccgtccggttaccggacccttaacgtccccggttaaccccggtttacgggaacccgtaaacgggggtacccttaccggggtaaccgttagggaaacgtacgttaacgggaaaacgtaacggttggtaccggactacggacctaacgtacttcttggtccttaaccg

SEQ ID NO: 48337 - DNA, 677 bp, Homo sapiens
  misc_feature: GYAE6OF01BRH3U.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggagttgggggaggaactgctcagtttcggaccagagggaaccatggaagccccagctcagcttctcttcctcctgctcctctggctccagagaccaccggagatattcgttttgacacagtctccagacatcgtgtctgtgtctccgagggganagacgccaccctctcctgcagggccaggtcagagtgttcgccgactccgttggcctggtaccaacaaaacctggccagcctccaggctcgtctattcatggcacactaccaacgacggggaccctaacgtcgggactacgtaccccgaacgggccgtacgggtttaccaagggttcgggaccgtagggtcggggacccttggtacgggggaaccctaaagggtaaccttttcccggtaaaccttcctaacccgaaaccgggtaacttaccgtaaacggcccttaagttccggtacccgttacccgttacggtaacgttaacgttttcgtaccttagttttaacttcgttagtccacgtcaaggtcggacgtcctacgggtctacgtccttacccgtcgacggacggtctcggaccgtggaactgtaagtaaccgagttacgcggtctacggactactagttcacgttctaaccg

SEQ ID NO: 48338 - DNA, 681 bp, Homo sapiens
  misc_feature: GYAE6OF01EBS8Z.23.23.C01.1.454.CMB.1.raw
  modified_base (382)..(382): a, c, t, g, unknown or other
  misc_feature (382)..(382): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcagtcagtgaaagtcacctgacaaggcttcaggataccaccttccaacctaaatttgaatatacaacgtgggtcacgacgacggccccgtagggaaaacgggcgtacggaggtcggagtggggacgtggggtagacggtccgtagtggttagaagaacgtaccgggntaacgttctacgaagtaacgttacgaaggccagggcctacgacgtccgtacgaacccgttaggaaacctaccgttaccaaaggaaacgaacgaacgtacccgtaagtttacggaaacgtcggaccgccggtccctcgaccctacgtcggaaccgaccgaccgggtccgttagttactttacgtgtcggacggagagggaccgggaggtcccggtacggtttaagttttagggaaactttaagttaggttacggttaggttacgggtaccggttacgggtggggcccgtaaaacgggggg

SEQ ID NO: 48339 - DNA, 679 bp, Homo sapiens
  misc_feature: GYAE6OF01BIJ0X.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcagggccagtcagagtgttcgccgactccgttggcctaggtaaccaaacaaaacctcggaccacgccctaccaggctcgtcattcatcggacacactaccaaacgacgggaccacgtcggacactccccgaggcctacgggttcaaggtcggacgtaggtcggtacctcggtagggaactacggtaccttaccaaccttccgtaccaacggtactaccgagtccgtaaggttccgtacccggtaacccttaggtaaccggttattttacgacgtttaagttttacttacgtgtacaacgtacgtaacggttcgccgtaccgtcggtacccttagtacccgtaacccgttcgggaacccgtaaagggtcctaccggacgttagggaacgtacgtaacggaaaaccgtggtcggacggtacctcggacctaaccgttattccgttaaccgttcttaaccg

SEQ ID NO: 48340 - DNA, 581 bp, Homo sapiens
  misc_feature: GYAE6OF01BD3BS.23.23.C01.1.454.CMB.1.raw
  modified_base (202)..(202): a, c, t, g, unknown or other
  misc_feature (202)..(202): n is a, c, g, or t
  modified_base (421)..(421): a, c, t, g, unknown or other
  misc_feature (421)..(421): n is a, c, g, or t
  modified_base (551)..(551): a, c, t, g, unknown or other
  misc_feature (551)..(551): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgcccaccctctcctgcagggccagtcagagtgttcgccgactccttggcctacggtaaccaaaccaaaaaccgtggacccacgtccctcccgaaggtcctcgtcctattccagtcggccacgtactacccgaacgacgggcccacgtcggaccactcccgaaggccgtaggttcagtggctagtcggctcgtagggactacggtacttcgactcncacgactcagctgtcgtcaacccgttgacgttacgtttagcttaagttttacttactcgtacagactaacggtcggctccgtgcctatccgtccgtcggactaggcctcgagtgagactacggaactagngtacgctacgcctactatcctgttctaccg

SEQ ID NO: 48341 - DNA, 543 bp, Homo sapiens
  misc_feature: GYAE6OF01E1RJY.23.23.C01.1.454.CMB.1.raw
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaaccaaatttgatatacaacgtggtgcgacacggcccctagggaaaaggctacggagtggatgggctgggngagtctagtgtagagaagtacggnattcncagtaagttcgaagccgagctcagcgtcgacgtgaacctacttacgaagaagaacacgtccaagttacggactgccgcggcctgacctcacgacgacgacggccgtagtattattgcgcgaggacggcggacggcgtcgtaggttttaggattagtagtggtataggacgtcgtagggcgtaacggg

SEQ ID NO: 48342 - DNA, 771 bp, Homo sapiens
  misc_feature: GYAE6OF01DYO5M.23.23.C01.1.454.CMB.1.raw
  modified_base (151)..(151): a, c, t, g, unknown or other
  misc_feature (151)..(151): n is a, c, g, or t
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (412)..(412): a, c, t, g, unknown or other
  misc_feature (412)..(412): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctgcctccagacgaccacgganattatttcttttgactactacgtctaccagtacatcgtgtctgtcgtcgtccggagggganaggcgcccaccctctccgngccgacgggccagtcgaggtaggttcgtacggccgtaccgttccggttcggacccgttaacggtaaaaccccaaaaccgaaaaccggtcggacccacgtaccctccggacggtcctcgtactacttcgacgttcggaccacgtacctaaccgaacggacgggtaccaggtcggacctaccnccggtaggacgtacggttgacggtcggaccggtggtcggtccgtacgggtacgggaaacctacgttacccgttaccaccgttcgacccgtaacgccgtacgacgtaccgtcgttacccggaccgttaacccggtaggttaccgttagttccggtactttaagtttaccgttacgtacgtacgtaagtaccggttacggccgggcccgttacggtaccttacccgtaaccgttccggtaacccgggtacgggtaacccgaacggtacctaccgggtaggtaccgaagtaacgtaaaccgtaaggttacggtcggtacggtctacccgaaaccttacagtttccggtaccgtcctttaccg

SEQ ID NO: 48343 - DNA, 560 bp, Homo sapiens
  misc_feature: GYAE6OF01CBKGF.23.23.C01.1.454.CMB.1.raw
  modified_base (202)..(202): a, c, t, g, unknown or other
  misc_feature (202)..(202): n is a, c, g, or t
  modified_base (367)..(367): a, c, t, g, unknown or other
  misc_feature (367)..(367): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccgttggcctggtaaccaaacaaaacctggaccagccctcccaggctcgtcattcatggcacactaccaacgacgggaccacgtggcactcccgaggctaggttcaggtggcaggtgctcgngggacagtactcactctcgacgatcagctagtcgtaccgacccgtgtaacgttatttcgacttagtttatacgtgtacaggtcaacggtcggcgtccgtcggtacccttagtccgtaccgttccggacgtacgggtcctcgacgtggaagtagtacgaaacgtacgtggtcgctacgctacagtctgtcctac

SEQ ID NO: 48344 - DNA, 630 bp, Homo sapiens
  misc_feature: GYAE6OF01CB3G1.23.23.C01.1.454.CMB.1.raw
  modified_base (607)..(607): a, c, t, g, unknown or other
  misc_feature (607)..(607): n is a, c, g, or t
  modified_base (617)..(617): a, c, t, g, unknown or other
  misc_feature (617)..(617): n is a, c, g, or t
  modified_base (622)..(622): a, c, t, g, unknown or other
  misc_feature (622)..(622): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcgagggccagtcagagtgttgccgactccgttggcctaggtaccaaacaaaacctggaccagcctccgaggctcgtcattcatcggcacactaccaacgacgggccacgtcggcacgtcccgaggcaggttcagtcggcaggtcggctcgtcgggactacggtactcacgtctacaacgtactcgagactacgtcggtaccgtacccgttggtaaccgttacgttttcgacctttaaggtttttaacttacgttcggtacctaacggtaccgtaaccgggtttcggacccggtccggttacggtaccccttagtacccgtacccgttaccggaccggtaaccgggtactcggtacgtggaagtacgtaacgaaacgagtcgtcggtcncgaccacgtnttctnttcgtacc

SEQ ID NO: 48345 - DNA, 737 bp, Homo sapiens
  misc_feature: GYAE6OF01BBRAI.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgaggggagagacgcccaccctctcctgcgagggccagtcagtagtgttcgcccgaccgttccgttggcctacggtaacccaaacaaaaccctggccacgccctcccgaggcctcgtctattcatcggcacactaccaacgacgggacccacgtggacctacgtcccggaggtacgtacggtctaggtcggccgtaggtcggtcgtacggacgggtactacgtacctttaccacttcgacctacgataccgagtcgtacggtcggtacccgtacccgttaggtaaccgttagttttcgaacgtttacgttttaactttacgtagttaccgaacgtaccggttaacggtccgggtaccggtcccggttaacggttcccgtaccgttaccccggttaacccggttcccgggaacccggtaacgggttacccgtaccgggacggttaacgggaacggtaaacggtaacggaaaacccgtttacgggtgggtaccgggtacttaacccggacctaaccggttattaccgtttccggttccttacccg

SEQ ID NO: 48346 - DNA, 964 bp, Homo sapiens
  misc_feature: GYAE6OF01AV1TX.23.23.C01.1.454.CMB.1.raw
  modified_base (155)..(155): a, c, t, g, unknown or other
  misc_feature (155)..(155): n is a, c, g, or t
  modified_base (211)..(211): a, c, t, g, unknown or other
  misc_feature (211)..(211): n is a, c, g, or t
tcagacgcgagtatcacgaccggtgctcgatttagtacacgtgattagggattgggggacggaactgctcagtttggacccagagggaaccatggaagcccagctcagcttctcttcctcctgctcctctggcctcccagacgacccaccggganacttacttccttttcgacacagtctccagacatcgtgtctgtgtctccgagggganacgacgcccaccctctccgtgccacggggcccaggtcaggtacgtgttacgcccgtacttccgttggccttacggtaaccctaaaaccaaaaaccgtggacccaacggtaccccttaccccgaaggggtccttaccgggtcctaacgttccaacggttacgggacctaaccgtaacttaccccgaaaaacggtaccgggggacccctaaaccggttcgggaaccctaaccgttacccccggaaagggtacccgttaaacggggttttaccgaacggggtttcggggaaccgtacggggtttccgggccgtttaccgggttacgggggtaaccgtaacggttacccttttaccgaacccgtttacccgttacccgaaaccgggttaacttaccggtaacggtcccgtaaacggggtttacccgggttaaccccgtaaccccccggttttagggtaaaccggttttaacggtttttccggaaccgttttaacggtttttaaccgtttaccgtcggttaaccgtaacggtccggtaaacggtttcccggggaacccgtttcccggttaacgggttcccctttaacgggttcccgttaacccggtttaccggggaacccggtaacggggtaccctacgggtaaccgtaccggggtaacggtaacgtaaaccgggaaaaccggttacggttccgggtacggtacccggttacggtaacccctacgttagttccggttaccggtttcccttaaacccgg

SEQ ID NO: 48347 - DNA, 793 bp, Homo sapiens
  misc_feature: GYAE6OF01BL99H.23.23.C01.1.454.CMB.1.raw
  modified_base (529)..(529): a, c, t, g, unknown or other
  misc_feature (529)..(529): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgggagatattcttttgacacagtctccagacatcgtgtctgtgtctccgaggggagagacgcccaccctcctcctgcgagggccagtcagagtgttgccgacttccgtggcctcggtaacccaaaccgaaaaaccgtcggacccacgccctacccgaggccttcgtactacttcagtcggaccacactaccaacgacgggcccaacgtcggacctacgtcccgaggtaccgtaggttacacgggtcggacgacggtcgggtcctcgggtacggggaacgtaacgttaccgtttaccctaaccgttccgtacccgtaaaccggtacttacccgacggtaccgtacgggttccgggtaccccgtaacccgttggaaaccgtttnttttacgggacctttaagttttaacctttaccggttagttaccgtaacggtaaccgtacgggtacgggccgttacccgtaccggtacccttaaccgttacccgttaacccggtttcccgggtaacccggtaaccggggttaacccgtaccggggttaaccggtacggggtaaacgtaacggtaaaccgggtaaaacggtacggttgggtccggaccgttacgtaaaccgtacgtacggtttccgtttacggttccgtttacccg

SEQ ID NO: 48348 - DNA, 653 bp, Homo sapiens
  misc_feature: GYAE6OF01AP38N.23.23.C01.1.454.CMB.1.raw
  modified_base (364)..(364): a, c, t, g, unknown or other
  misc_feature (364)..(364): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgccaccctctcctgcagggccagtcagtagtgttcgccgactccgttggccttacggtaaccaaacaaaaacctggaccacgcctccgaggctcgtcattcagtcggcacactccaaacggcggcccagtcggacacctcccgaggtactaggttcgnggtacggcgtaggtcggcttcgagggacctacggtaccttccacgttccgtacacgtatccaagcgtaacgtcggtacccgaccgttagtaacgttactttcggactttacgttttactacgtgtacacggtacgtacggtccggcgtccgtacggtccttactccgtacccggttcggaacccggtaagggtccgtaccggtaggtcgggaactaacggtaacggtaaaaggtaccggtgggtaccgtacgttacgaccgttaacctagttccgttcgtacttacccg

SEQ ID NO: 48349 - DNA, 677 bp, Homo sapiens
  misc_feature: GYAE6OF01CEZYB.23.23.C01.1.454.CMB.1.raw
  modified_base (469)..(469): a, c, t, g, unknown or other
  misc_feature (469)..(469): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgaaggggagagacgccaccctctcctgcgacgggccagtcaggtagtgtcgccgactccttggccttaggtaaccaaacaaaaccgtcggccacgccctcccgaggcctcgtctacttcgagtcggaccacactacccaacgacgggccctacgtcggacctacctccccgacggccgtagggttccacggtggcgtaggtggcctcgtagggactagtaccttcacctctcgacgtactcgacgcgtacgtcgtacccgtaccgtggtaacgttntttcgtacttagtttacttctgtacacgtactaacggtcggccgtcgtcggtacctacgtcccgttacccgttaccgggaccgtaacggggttccacggtaaccgtacgggtaacggtacgttaacgggaaaacccggtacggttccgggtagggtacccttacgggtaaccccacccggtatttccggttcgtttcccgttaacccg

SEQ ID NO: 48350 - DNA, 819 bp, Homo sapiens
  misc_feature: GYAE6OF01BY8UE.23.23.C01.1.454.CMB.1.raw
  modified_base (155)..(155): a, c, t, g, unknown or other
  misc_feature (155)..(155): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (763)..(763): a, c, t, g, unknown or other
  misc_feature (763)..(763): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccgagacgacccaccgganattactttcttttgaccacacgtctccagactatcgtgtctgtgtcctccgagggganacgacgcccaccctctccngcgagggcctagtcaggtagttcggttacgcccgtacgttcccgttgggacccgttacggttaacccgaaaaccgtaaaaaccgttccgggaacccgaaccgaccccgttacccgaacggtcctaccggttacctacttaccgtacgttacgggacctaaccgtaacctacccgaaacggaccgggtacccaacggttccgggaccctacgtaccccggaacgggtaccgtacgggttaccaacgggttcggaccgtaacgggtcgggtccgttacggtacgggaactacgtaccgtttaccacgttacccgtacgaacgacgttcgaacgccgttacggtccgtaccgacccgttagtaaccgttgtttcgaacgtttagtttaacttccgttagtacgtaaccgtaccgtaacgggttcggaccgttcccgtaaccgggtacccttaacggtccccgttaacccgtttacccgggaacggttaaaccgggccttaaccggacggacggtaacgtacgtacggtaaaacncggttacgtacggtcccgtactacccggtcaagttacccttcgttcccgttaaccg

SEQ ID NO: 48351 - DNA, 722 bp, Homo sapiens
  misc_feature: GYAE6OF01DY5XM.23.23.C01.1.454.CMB.1.raw
  modified_base (243)..(243): a, c, t, g, unknown or other
  misc_feature (243)..(243): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttnaggatacaccttcacctaatttgatatcaacgtggtgcgacacggccccgtagggaaaacgggcctacggaggtggagtgggcgttggggtgtacgttccgtaggttgttaggaagtaacgtaccggggctacgttctacgaagtaacgttacgaacggccgaggtccttacgacgtcccgtacgtacccgtacggaacctaccgttaccgaaggaaacgaacgacggtacccgtagttttacggaaccgttggaccgtccggtccgttacgacccttacgtacggaaccggaccgtaccgggtcccggttagttacgtttagttcggttacggaccgggtaagggtacgggaccgggtaacgggtcccggttaacgggttttaaggtttttaggggtaaagtttaacgtttagggttacgggttaacggttacggggttacggttaccgggtacgggggtacccggtaaaccgggggg

SEQ ID NO: 48352 - DNA, 726 bp, Homo sapiens
  misc_feature: GYAE6OF01BHRC9.23.23.C01.1.454.CMB.1.raw
  modified_base (184)..(184): a, c, t, g, unknown or other
  misc_feature (184)..(184): n is a, c, g, or t
  modified_base (202)..(202): a, c, t, g, unknown or other
  misc_feature (202)..(202): n is a, c, g, or t
  modified_base (322)..(322): a, c, t, g, unknown or other
  misc_feature (322)..(322): n is a, c, g, or t
  modified_base (703)..(703): a, c, t, g, unknown or other
  misc_feature (703)..(703): n is a, c, g, or t
  modified_base (714)..(714): a, c, t, g, unknown or other
  misc_feature (714)..(714): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagtatattcttttgacacagtctccagacatcgtntctgtgtctcgagggganagacgccaccctctccgtgcgagggccagtcagagttgttcgccgactccttggccttacggtaacccaaaccgaaaaccgtcggacccacgccctacccgacggtctcgtcctattccngtcggcacactacccaaacgtcggtaccacgtacggcaacgttccccgaggtaccgtacgggttacacgggttcggacgtacggtcggtaccgttacggtacggggaacctaagttaacccgtttccaaaccgttccgtccgtaaaccggtacctacggtaacgtaccggtaggttaccgggttaccccgtaaccggtacgtaacgttacgttttacgacgtttacgtttacgttaactggttaccgacgtacgttaacggcgtccgtaccgttacgtacctacgtccgtaaccgtttcggaaccggtaacggtacccgtaggtacgtagggacgttaacgacggtaaacagggttacgcggtacgacgtacctaaccgtnttacccggttnttcccggttaac

SEQ ID NO: 48353 - DNA, 813 bp, Homo sapiens
  misc_feature: GYAE6OF01C7Q3B.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgcccaccctctcctgcgagggccaaggtcagagtgttcgccgtactccgttggccgtaggtaacccaaacaaaacctggacccacggaccctcccgaggtcctcgtacctattcaagtggacctacacttaccgaacgacgggacccacgtacggacctacgtcccgacgggacgtacgggttaccgaggtcgggaccgtaggtacggtccgtcggtacgggactacggtaaccttccgaccttaccgtacgtaaccggtacttaccgagtaccgtaacgggttccgttaaccccggtaacccgttacggttaccgttaacgtttttaccggaacgttttaactttttacgtttaacgttcggtaccgtaacggtacccgtaacgggttcggtacccggttacccggttacgggttacccttaaccgttcccgttaccccggtttaccggaacccggggtaaccgggttaacccgttaccggtaacgggttaccgggtaaaggtaccgggttaaaaccgtaaacccgggttaacggttacgggaacgggtacccttacgggtaaaccccaccgtttagttccccgttgtttaacccgtttaccccgg

SEQ ID NO: 48354 - DNA, 774 bp, Homo sapiens
  misc_feature: GYAE6OF01CGRTF.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctccagagaccaccggagatattcttttgacacagtctccagacatcgtgtctgtgtcctcgaggggganagacgccaccctctccgtgcagggccaagtcagagtgtcgccgactccgttggcctaggtaacccaaaacaaaaccgtcggaccaagccctacccgaaggcctccgtactacttcacgtcggaccacctactacccgaaacgacggggaccctaacgtcgggacctaccgttccccggaaggtccgtaacggtttccgaacggttcggaccgtagggttcgggccttacgggtagggaacctacggtaacctttccgaacctttccgtacgaacgacgtacgacgtacgtaaggttccgtacccgacccgttaggaacgtttagtttacgactttaagggttttactttaacgtggttaacaacggtaccgtaaggttccgggaccgtacccgttcgggtacccttacgttacccggttaaccccgttccgggaacccgttaaacggggacccgttaccgggtaacgtaggggtaaactaaacggtaacgggaaaaacccgttacggttacggaccgggtaccgttacgacccgtaaaccgttagttcccgttggtttacctttaaccccg

SEQ ID NO: 48355 - DNA, 558 bp, Homo sapiens
  misc_feature: GYAE6OF01BOJYU.23.23.C01.1.454.CMB.1.raw
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcacctaaatttgatatcaactgggtgcgacaggcccctagggaaaaggctcgaggtggatggggctgggtgagtccgtagtgtgagaataccgggnattcnaggtaagttcaaggccaggctcgagcctgaccgtaggaacctaccttacgaagtaaacgaaacacgaccctagttacggaactgccgcgcctgaccctcgtgacgacacggcgtgttacttagttcgngcgaggnggcggaaggccggtacgtagttttagggaattattagtggtagtggacgtcggtggggctaacgggg

SEQ ID NO: 48356 - DNA, 564 bp, Homo sapiens
  misc_feature: GYAE6OF01B2FS0.23.23.C01.1.454.CMB.1.raw
  modified_base (243)..(243): a, c, t, g, unknown or other
  misc_feature (243)..(243): n is a, c, g, or t
  modified_base (407)..(407): a, c, t, g, unknown or other
  misc_feature (407)..(407): n is a, c, g, or t
  modified_base (469)..(469): a, c, t, g, unknown or other
  misc_feature (469)..(469): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttnaggatacaccttcaccaaatttgatatcaactgggtgcgacaggcccctggaaaacgggctcgagtgggatgggctgggtgagtccgtagtgttgagaataccggggcagttctctaggaagttcaaggccaggctcgacgctgacctggaaccacttcagaanaacagccagttgaactgcgcgcctcgacctctgacgacacggccgtagttattattggtcgnggtacgacgggacggacgggccggcggtaggtttttacgggaaattagttagtagggttagtagggtacgtcggttaggggcccgtaaacggggg

SEQ ID NO: 48357 - DNA, 807 bp, Homo sapiens
  misc_feature: GYAE6OF01CRQY9.23.23.C01.1.454.CMB.1.raw
  modified_base (228)..(228): a, c, t, g, unknown or other
  misc_feature (228)..(228): n is a, c, g, or t
tcagacgcgagtatcacgaccggtgctcgatttagtacacgtgattagggagttggggggaggaactgctcagtttggacccagagggaaccatggaacgccccagctcagccttctccttcctcctgcctcctctcggcctccagacgaccaccggagtatatttctttgacactagtctcagacagtcgtgtctgtcgtctacgagggagagacgccacctctccngcgaggcagtcagtgtgtcgccgtactccgtcggaccgtacggaacccaaaaaccaaaaccgtcggacccaacggccctacccgaggtcccttacgtacctacgttaccagtcggaccaaccacaaccgaaacgaccggggacccacgtcggacaaccgtcccgaagggtaccgtacgggtacagggtacggacggaggtcgggcctaggtacgggaactacgtaccttcgaccttcgaaccgaacgtactaccgaggactaggtacccgtaccgtaaacccttggttaaccgtttacgtttttaacgaccgttttaaagtttttaaccgtacgttacggtacgtaaccggtaacgggttaaccggggtccgggaccgttaaccccgggtttgtaaccccctttaacgtacccggtttaaccccgggttacgggtaaccccgaaacgggggtacccttaacggggtaacggaaccgggtaaacgggttaacgtaaaaccgggtaaaacccggtcgggttcggggtaacgcccgttacggtaccccttaacgtagtttcgttaccggttaccctttaccg

SEQ ID NO: 48358 - DNA, 639 bp, Homo sapiens
  misc_feature: GYAE6OF01A7VRO.23.23.C01.1.454.CMB.1.raw
  modified_base (207)..(207): a, c, t, g, unknown or other
  misc_feature (207)..(207): n is a, c, g, or t
  modified_base (321)..(321): a, c, t, g, unknown or other
  misc_feature (321)..(321): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
tcagacgcgagtatcacgaccggtgctcgatttagtacacgtgattagggattgggggagaactgctcagtttggacccagagggaaccatggaagccccagctcagcttctcttcctcctgctcctctcggcctcccagacgacccaccgggagatattcttttggacacagtctccagactatcgtgtctgtgtctccagggganagacgccaccctctccgtgcgagggccagtcagagtgttcgccgactccttggcctggtaccaacaaaacctggccagcctccaggctcgtcattcatcggcacactccaacgngggccacgtcggcactcccgaggcgtacggttcagtcggcgtagtcggctcgtagggcacgtctcactcncacatcacgngacgtcgtccgtacccgtgaccgttatttcgacgttagtttactttaacgcgttacagtcgaacggtggaccgtccgtacggcccttacgtccgttacccgttaccggaaccgtaacgggtaccttcgggaacgtttagggacgtaacggttaccggaaaacggttaaccgtcgggtttacggacccgttagggtaccctaacccgttaaggttccctttacgggttcccgtttaccc

SEQ ID NO: 48359 - DNA, 682 bp, Homo sapiens
  misc_feature: GYAE6OF01BZAFP.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagccgtggggcatcagtgaaagtcacctgcaaggcttcaggatacaccttcaacctaaatttgatatcaactgggtgcgacacggccccgtagggaaaacgggctacggaggtcggagtggggcgtgggtgacgttccgtagtgttgagtaacgtaccgggctacgttctcgaagtaacgttacgaaacgggtcccgaggtctaccgacgtccctacggtaaccgtgggaaacctaccgttaccgaagaaacgaaacacgtaccctagtttacggaacctggccgtacggtcctacgaccctcgtacgaaccgaccgtaccgggccgttagttaatttacgttggtaggaccggtaagggtacgggaccgggtaacgggtcccggtacggtttacggtttttaggggaactttaaggttagttagggtacgttacgggtaaccgttcgggttacgggggacccgtaaaccgggggg

SEQ ID NO: 48360 - DNA, 808 bp, Homo sapiens
  misc_feature: GYAE6OF01C0D0U.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgcccactcccacgaggaattggtgctagtcgtcgggcctggaggtgaagaagccgtggggcatcgagtagaaacgtccacgtgacgtaggctacgaggaactacgtacctacgtaacctaattacgtataactacaacggtggtcgacgacgaccggtaccggtaggaaaggccgtaggaggtaggaggtgggtcggtgggtacgacggttaccgtagggttagtaggaacgtacggtaccggactacgttcgaacgtaaggttaacgtacgaacggccgaggcctacgacgcgtacgacgtacggacctaccgttaacaacggtaaacaaccgtaaccgtaccgttaacggttacggtaacgtcccggaccggtacccggtacccgtaccgtaccccgtcggtaacccggtaaccggtaaccggtacccgggttacggttacggttaattttacggttaacggtcgggtaaccgggtacggggaacggggtaccgggggtaccgggtacccggggtttacgttttaacggggtttttaagggttaaacggttttacggtttaaacgggttacgggtttaacgggttacggggttaacccgggtttaccgggggtaaccgggggtaaccccggggtaaacccggggg

SEQ ID NO: 48361 - DNA, 713 bp, Homo sapiens
  misc_feature: GYAE6OF01A8AI5.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctcccagacgaccgaccggagattatttcttttgacacacgtctccagacatcgtgtctgtgtctacgaggggagagacgcccaccgtctcctgcgtacggccagtcgagagttcgttcgccctacttccgttcggaccgtacggtaacccaaaaccgtaaaaccgtcggacccaacggtcccctacccgaggtccttacgtccgtacttcgtagtcggaccaactacctaccggaaacgtccgggacctacgtcgggtaccaccgttacccggaggtaccgtacgggttctagggtccggagtacgggcggtcgtacgtaggaacctagtacccttcgaccttcgtaccgacgtacgtcgagtcgtacggtccgtaccgaccgttaggaactttgtttaccggattttaacgtttacgtacgcgttaacgacgtacgtaccggtggcctacggtcctacgtacgtccctacgggcgtaccggacggtaccacggtcgtaaggacttaacgggacgtaaccggtacgttggtaacgcccgtaaggtacccgtaccttattcccggtattccgttaccccg

SEQ ID NO: 48362 - DNA, 804 bp, Homo sapiens
  misc_feature: GYAE6OF01BZIX7.23.23.C01.1.454.CMB.1.raw
tcagacgcgagtatcacgaccggtgctcgatttagtacacgtgattagggattggggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgcccaccctctcctgcagggccagtcagagtgttgccgactcctggcctaggaaccaaacaaaacctggaccagccctaccacggcctcgtctagttccagtcggacaacactaccgaaacgagggacccacgtcggactacgtccccgtagggcctaagggttaccgaaggttcgggacgtaagggtcgggtccttacggacggggtaacctaggtaccgttaccgtaacttccgtaccgaaacgtacgttaccgaaggtaccgtaagggttccggtaaccccgtaaccccgttaagggtaaccgttagtttttacgaaccgtttaaggttttttaactttaccgtacggttaaccgtaacggtaccggttaaacgggttccgggacccgtcccggttaccggaccctttaacgtacccgtaacccgggtttacgggaacccgtaacggggtacccgttacggtaaacgggtacggaaagggttaaaccgtaaacgggttaaaaacccggtaacggtttcggggttaaccgggtacccgtacgggtaaccctaaacccgtttagttacccggtttaccgtttacccgtttaacccg

SEQ ID NO: 48363 - DNA, 617 bp, Homo sapiens
  misc_feature: GYAE6OF01AT9EZ.23.23.C01.1.454.CMB.1.raw
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgagggganagacgccaccctctcctgcagggccaggtcagagtgttgccgacttcttggcctggtaaccaaacaaaacctggccacgcctcccaggctcgtcattcagtcggcacatccaaacgcggccactcggacactccgaggctaggttcagtggcaggtgctcgtggacngtactcactcncacgancagctagtcgtacgaccgtgacgttacgtttgaccttaagttttactactcgtacgagtccgtaaggtccggacgtcccgttaggtccctaacgttcccgtaacccgttcgggaacccggtaagggtacccgttcggaaccgtcgggaacgtaacggtaaccggtaaaaccgtaggttcgggacggtacctacgggaacctacccgtatttccgtcgtttccttaaccgg

SEQ ID NO: 48364 - DNA, 718 bp, Homo sapiens
  misc_feature: GYAE6OF01EDRJZ.23.23.C01.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagaaattgtgttgacacagtctccagcccacccttgtctttcgtccccgaaggggaanacgccaccctntcttgcaggccagtcaagacagttacggaactacttagcctaggtaccaagagaacgccgtggccaaggcctcccgaggcctgctacacttctatgatgcatccgagccgagggccacgtggcctactcccgagtccgtacggttcaggtcggacgtagggtacgggttccgaggggtaactacgggtacctttaccgaccttccgacctaaacccgtacgtcccgacgaccgtaccgttaacggacgtaccgtacggtaacgttacgtttcggttacgtttaacttacgtcgtaaaccaaccgtaaccgttaaccagttccggtaccctttacgttcgtaccggtaccggtttccgggaaccggtaagggtaacccgtaaacggggttacgtaaacggtaaccgtaaaaccgggtacgttacgggtacggtcctacgacccgttaaccgacgttccgttacgttctttaccgtaccctttccgtaccccgtacttaacg

SEQ ID NO: 48365 - DNA, 638 bp, Homo sapiens
  misc_feature: GYAE6OF01A0XFM.23.23.C01.1.454.CMB.1.raw
  modified_base (335)..(335): a, c, t, g, unknown or other
  misc_feature (335)..(335): n is a, c, g, or t
  modified_base (363)..(363): a, c, t, g, unknown or other
  misc_feature (363)..(363): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgagattggtgcagtctgggcctgagtgaagacgccgtgggcatcgagtagaagtcactgacaaggtctacaggataccaccttacaactaattgactatcaacgtggtacgcgacgacggacccctagggaaaagggctacggaggtggagtgggcgtgggtntacgtccgtagtgtagagtaacgtccgntattactcaaggtaacgttcgaacggtccaggtacctcgtacgccgttacgacgtacggaacctactaaccgagtaaacgaacgacgacccttagttaggaaccgtggccggtccggtccctagtaccctacgttacggaccgaccgtaaccggccgttagttaacgttagttagcgacggaggacggacgggaccggtccggtagtttaggttttaggaattagttaggttacgtacgggtaggtaccggtcgggtaggggcccgtaaccgggg

SEQ ID NO: 48366 - DNA, 745 bp, Homo sapiens
  misc_feature: GYAE6OF01DSOSY.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggagttgggggaggaactgctcagtttggacccagagggaaccatggaagccccagctcagcttctcttcctcctgctctctggctcccagagaccaccggagatattcttttgacacagtctccagactatcgtgtctgtgtcgtcgagggganagacgcccaccctctccgtgcgacgggcctagtcaggtagtggttcgccgtacttccgttcggcctaggtaaccaaacgtaaaaccgtcggaccacgccctccgacggtctccgtctacgttcagtacggacaccgtactacccgaaacggtaccgggccctaacggtccggactaccgtacccggaggtaccgtaggtttaccgaggttcggaccggtagggttcggccgttagggtacgggtaacgtacgtaacccgtttaccaccttacgtaccaacggacttcggaacgtacgtacggtccgtccgtacccgtacgttacgttacgttttcgactttaacggttttactaccggttggtaacctaggaccgttacgggtccggtaccgaccgttccggtcccttaaccggttccgtaaccgggttacccggaaccgtacgggtaacccgtacgacggtaagacggtaacgtaaacggaacgggttacgttcgggaccgttcacccggtaacttaccgtattccgttccgtgttacccg

SEQ ID NO: 48367 - DNA, 768 bp, Homo sapiens
  misc_feature: GYAE6OF01BDTJI.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcgacgggccagtcaggtagtgttcgccgtacttccgttggcctaggtaaccaaaactaaaaccgtcggacccacgtccctacccgaggcctcgtactacttacagtcggacacactaccgaacgcgggaccacgtcggcacgtccgaggctacggttcaggtcggacgaggtcggcgtacggacgggtacaaggtccttacgactctacgaacgtacttacgaacggtactacgggttacgtaccgtaacccgttaggtaacggttttaacgttttcggaacttttaacggtttttaacgttaaccgttgggttaaccctaacggtaacccgttaacggggttcgggtacccggtacccggttccgggtaaccctttaccggtacccgttacccgggtttaaccgggacccggtaaacggggtacccgttaccgggtaaacggttacggggaaacttaacggttaaaccgggaaaccgttaacggttcgggttacccggtacttaccgggtacccttaacttacggttcctttcgttacctttacccg

SEQ ID NO: 48368 - DNA, 651 bp, Homo sapiens
  misc_feature: GYAE6OF01CDZ1Z.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctggaggtgaagaagccgtggggcatcagtgaaagtcacctgcaaggcttcgaggatacaccttcaacctaaatttgaattactactaacgtgggtgacgacgacggcccccgtaggaaaacgggcgtacgagtaggacgtgggacgtggggtagagttccgtagtgttagaagtaacgtacgggctagttctacgagtaagttacgaacggcgaggtctacagtcctagaccgtaggaacctacttaccgaagtaaacgaacaacgacctagttacgaactcggacgcgcccgtgaccctcgtacgaccgtaacgaccggtaccgttagttacgtttagttacggtcgacggagggacggccgggacggtccggtacggttaggtttttagggtaactttaaggttagtagggtacgttagggtaccggtacggttcggggaacggtaacccgggg

SEQ ID NO: 48369 - DNA, 715 bp, Homo sapiens
  misc_feature: GYAE6OF01EN9UR.23.23.C01.1.454.CMB.1.raw
  modified_base (184)..(184): a, c, t, g, unknown or other
  misc_feature (184)..(184): n is a, c, g, or t
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttagacacagtctccagacatcgtntctgtgtctccgagggganagacgccaccctctcctgcgacgggccagtcagagttgttcnccgtactccgttggccttcggtaaccaaacaaaaccgtcggacccacgtccctccaggcctcgtacacttcagtcggactacacttaccaacgtacgggccaacgtcggacacgtcccaggacgtacggttacaggtcggccgtagggtcgcgttcgacgggaacacggttactccgtacttacctcgtaacgtactccgagtaccgtagttcggtacccgtacccggttagtacgtttacttttacgacgtttaacgttttcttaacgtacgtaccgtaacgtaccggttaacccgttggacccggtccgttacggtaccctttccgttaacccggttacccgttacccgggaacggtaaccggtacctacggaccgttaggaaaccgtaacggtaaacggtaaaccggttacgtacgggtcgtaacgaccgtaaccgtacctagttcccgttacggtttctaaccccg

SEQ ID NO: 48370 - DNA, 779 bp, Homo sapiens
  misc_feature: GYAE6OF01D14AM.23.23.C01.1.454.CMB.1.raw
  modified_base (206)..(206): a, c, t, g, unknown or other
  misc_feature (206)..(206): n is a, c, g, or t
  modified_base (268)..(268): a, c, t, g, unknown or other
  misc_feature (268)..(268): n is a, c, g, or t
tcagacgcgagtatcacgaccggtgctcgatttagtacacgtgattagggagttgggggaggaactgctcagtttggacccagagggaaccagtggaacgccccagctcagcttctcttcctcctgctcctctggcctacccgagacgaccgaccggagtattactttcttttacgaacactacgtcctaccaagactattcggtntctgtcgtcctacgggaggggacaggacgccctaccctctccgcgcgacggcctagtcgagnggtcgtcgaccgtaccgttcgttcgaccgttacggtaaaccaaaaaccgtaaaccgcggaccctacgacccgtaccgaggtccgttccgtactacgtacgtaacggtccggaaccaacttaaccgtaaccccggaaacggtccgggtaacccacgggttaccgaacgtaacccgttacccggacgggtaaccgtaacgggttccaaggggcggtaacgacggttcggaccgtcggggtaacggaccgttaaactcgtttaccgaaccgtcggtaaccacggtactacggtaccgacgtacggttacgtacccgtaaacgtcggttaattacgtttacgtacgttaagttttacctggacgtactaaggacgtacggtcgtacgacctagtacctagtacccgtacgggttaccaacgaacggttccgaacggtatacgggaacgttaagaaacccgttaagggcttaacgggccgttcgaacttacggacttagtacgtttctacgtaccc

SEQ ID NO: 48371 - DNA, 828 bp, Homo sapiens
  misc_feature: GYAE6OF01ET4YF.23.23.C01.1.454.CMB.1.raw
  modified_base (207)..(207): a, c, t, g, unknown or other
  misc_feature (207)..(207): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggcctcccagagacccgaccggagattattcttttgacacagtctccagacatcgtgtctgtgtctccgagggganagacgcccaccctctccgtgacgacgggacagtcgagagtgtcgccgactccgttcggtcctacggtaacccaaaaccgtaaaaccgcggtacccacggtcccctacccgacggtccttccgtctacgtttacgtacgtcggtaacctaacacgttaacccgaaaaccggaccggggtacccaccggtcggacctacgtaccccggaaggtccgtaaggttaccgaggtcggacgtagggtcggtaccgttacgggacggggtaacctaggtaccctttaccgaccttccgtacgtaaccgtactaccgagcgttacggtccggtaacccgttacccgtaggtacgttttactttacggacgttttaacttttacgtaccgttacgttaaccgtaacgtacccggtaaccgggtcgggtaccccgacccgtttaccggaacccctttacgtttaccccgacccggggtttacccgggaaccggtaacccggggttccaacgggttaccggtaagggtaaacgtaaccgggttaaacgtaaaacccgggtggttaccgggtacgggtacctacccgggtaacctacccggttaccgtttaccgtttcgtccctttaaaccgg

SEQ ID NO: 48372 - DNA, 634 bp, Homo sapiens
  misc_feature: GYAE6OF01AZS8U.23.23.C01.1.454.CMB.1.raw
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (418)..(418): a, c, t, g, unknown or other
  misc_feature (418)..(418): n is a, c, g, or t
  modified_base (450)..(450): a, c, t, g, unknown or other
  misc_feature (450)..(450): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgaggggagagacgcccaccctctcctgcgagggccagtccagtagtgttcgccgacttccgttggccttggtaacccaaactaaaaccgtggccagccctccgaggctcgtacattcagtggaccacactaccaacgacggcctacgtggcctacnccgaggctaggtccaggtcggntaggtggctcggtcgggacaagtaccttacactcctacgacgtanccgagctagttcgacccgacccgtgaccgttntttgcgttagttttacttacgcgtacacgtctaacggtggcctaccggtcggtacctacgttcccgtaccggttacgggacccgtaaaggggtccctccgggtactagggaactaacgtaacggaaacgttaaccgtgggtacgacctagaccccgtaacgtgtttcccttcgttctttacccg

SEQ ID NO: 48373 - DNA, 712 bp, Homo sapiens
  misc_feature: GYAE6OF01DE5SB.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgcccaccctctcctgcagggccagtcagtgtgttcgccgtactccgttggcctaggtaaccaacaaaaaccgtcggaccacgccctcccgagtcctcgtcattcagtcggacacactaccaacgacgggcctacgtgggacctacgtaccccgacggccgtacggttcgaaggttcggacgtagggtcggccgttcggtacggggaacctaacgtaccgttaccgaccttcgtacgaacgtactcgaagccgtacggttccgtaccgtacccgtaggtacgtttaagttttcgaccgtttaagttttacttaccgtacgtaccgtacggtaccgtaacgggtcggaccggtcccgttcggtacccgttacgtacccgttacccgttccgggtaacccgtaacgggtccgtaaccggtacggtacggtacgtaacggtaaacggaaaccggtaacgttgggtaccggtcgtacgtaccgtaacctgttaccgttcgttccgttaccg

SEQ ID NO: 48374 - DNA, 771 bp, Homo sapiens
  misc_feature: GYAE6OF01D9TXU.23.23.C01.1.454.CMB.1.raw
  modified_base (514)..(514): a, c, t, g, unknown or other
  misc_feature (514)..(514): n is a, c, g, or t
  modified_base (564)..(564): a, c, t, g, unknown or other
  misc_feature (564)..(564): n is a, c, g, or t
  modified_base (617)..(617): a, c, t, g, unknown or other
  misc_feature (617)..(617): n is a, c, g, or t
tcagacgcgagtatcacgaccggtgctcgatttagtacacgtgattagggattggggggaggaactgctcagtttggacccaggagggaaccatggaacgccccagctcagcttctcttcctcctgcctcctctcggtcctccgagacgaccgaccggagtattactttcttttacgactacgtagtcctaccaagtactagttccgtgtcttggtcgtaccgtcggaaggggacacggaccgtccccacccttccgtcccgtggaccggaaccggggtccctaaggtccgtaagggttacggttccggttaccggccccgttaccgttccggttaccggggtaccttaaccggttaaacccaaaaaccgtaaaccccggtggaccctaccggtacccctccggtaagtcccggtttactcctagttaccgtagtccggacctaactaccgtacccggaacgtaccggggacctcggttacggcctaacgcccggtaggtccgtaggttacggnggtacgtgtccggaggtcctagggacggtacttacgacgttacacgtccncgaccgtagcgacgtccgtaagttccgaccgtacgtgttacgttacttacgtnttcgttaactgtactcgagtccgtacgtcgggcctcggttcaccgtacttacgggtacccgtaggaacgtccgttaacggccgtagacggtaacttaacgaccggtaggactttcgggaccttcgagtcctacggttcacggttcctacttacg

SEQ ID NO: 48375 - DNA, 738 bp, Homo sapiens
  misc_feature: GYAE6OF01DLD55.23.23.C01.1.454.CMB.1.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
tcagacgcgagtatcacgaccggtgctcgatttagtacacgtgattagggattgggggaggaactgctcagtttggacccagagggaaccatggaagccccagctcagcttctcttcctcctgcctcctctggctccagacgaccaccggagatattcttttgacacagtctccagacatcgtgtctgtcgtctaccgagggganagacgcccaccctctccngcgacgggccagtcagtagtcgttcgccgtactccgttggcctaggtaacccaacgaaaaccgtcggaccacgcctacccgaggtcctcgtcacgttccagtcggaccacactaccaacgacggccacgtcggactaccgtccgacggaccgtaggttcgacggtcggacgacggtcggtcctacggtacgggaacctacggtaccttcgaaccgttccgtaccgaccgtaacgtccgaacgtccgacggtttaccggacccgtacccgtacggttaaccgtacgttttaccgaccgtttacggtttacttaccgtcgttacgtaaccgggtcctaaccgggtcggtaccgtccgttacggtacccttaacgtcccgtaacccggttccggaaccgtacgggtccgtaccggtacgtacggggtaacgtacggtaaaccggtaaaccgggtaccgttcggtacgggtaccctacgggtaccctaaccgtacgttaccggtcgttccgttacccgg

SEQ ID NO: 48376 - DNA, 790 bp, Homo sapiens
  misc_feature: GYAE6OF01DHC3G.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattatttcttttgacacagtctccagacatcgtgtctgtgtctccgagggganagacgcccaccctctccgtgcgacggccagtcagtagtgttcgccgtactccgtggccgtaggtaacccaaaactaaaaaccgtcggaccacgcccctacccgaggtccttaccggtctattccagtcgggtaccaactactacccaacggacgggcccacgtcggaccacctacccgaggaccgtagggttacgacggtcggacgtagggttcggcgttcgggtacggggaacctaacggttaaccttcctacctttaccgtactaacggtaacttccgaacggtactacgggttccgtacccgtaaccccgttaggtaacctttacggtttttacggaccttttaagggtttttaactttacgttacggttacgtaaccgtacggttaaccggtccggggtcccgtacccgtttcgggtacccctttacggtacccgttaccccggtttacgggaacccgtaacgggttccggtacccggtaacggtcgggtaagtacggtaaaacggtaaaaccgggttcgttacgggaccgggtactaccgaacccgttaaccgttactttcgtaccggtttccttaacccg

SEQ ID NO: 48377 - DNA, 534 bp, Homo sapiens
  misc_feature: GYAE6OF01BQJYG.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgcgactcttggcctggtaccaacaaaacctggccagcctccaggctcgtcattcatggcacactccaacgacgggccacgtggccacgtcccaggcaaggttcaggtcggcagtcggctcgtggacagactcactctcacgatcagcagtcgtcaccctgacgtatttgctagtttatacgtgtcagtcaacggtgcgctgcctatcctaccgttcgccgtaagggcctacggactgggatacgtacgaaacgtacgttggacggtactacggtacctacagtccttgtccgttacg

SEQ ID NO: 48378 - DNA, 751 bp, Homo sapiens
  misc_feature: GYAE6OF01CKI3A.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgaggggagagacgccctacccgtctccgtgccgacgggccagtcgaggtagttggttcggccgtacctcccggttggcccttacggtaaaccctaaaaccgtaaaaaccgtcggacccaacgccccgtacccgacggtcctccgtactacttacgagtcggaccaactacgtacccgaaacggaccgggaccacgtcggacctaccgtacccgaggtacgtacggttcgaggtcggacgtagggtcggcgtacggtacggaacgtacgtacctaccgaccttactaccgaacgtacgtccgagtccggagttccgacccgtccgtagtacgtttactttcgaacgtttagtttaacgttacgtacgtacgaaccgtaccgtacgggtcggtcccgtccgttcggtacccttaccggttcccgtacccggttaccgaacccgggtaaggtccctacggacggtacgggaacttaacgggtaacgaaaacggttacggtccgggttacggacccgtacgtacccgtacgttacgttcccgttcgtttcccgttacccg

SEQ ID NO: 48379 - DNA, 669 bp, Homo sapiens
  misc_feature: GYAE6OF01BOETT.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcacctaatttgatatacaacgtgggtgcgacacggacccccgtaggaaaagggtcgtacgaggtggagtgggcgtgggtaggtaggttccgtaggttggttagaaggaacgtaccgggactattcgtacgaagtaacgttacgaacggacccgaggtcctacgacgccgtacgaccgtacggaacctacttaccgaagtaaacgaaccgacgaccctaagtttacgaacgtcgccgccggtcctcgaccctcgtcggaaccgaccgaccgggtccgttagttacgtttagttcggtaggacggtacggacgggccgggacgggtccggtacggtttagggtttttagggaagtttacggttagttaggttaggttacgggtaccggttcgggttacgggggccgtaaacggggg

SEQ ID NO: 48380 - DNA, 727 bp, Homo sapiens
  misc_feature: GYAE6OF01D89BC.23.23.C01.1.454.CMB.1.raw
  modified_base (184)..(184): a, c, t, g, unknown or other
  misc_feature (184)..(184): n is a, c, g, or t
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttggtggcagcagccagaagtgcccactcccacgaggaattggngcagtctgggcctgaggtgaagaagcctggggcatcagtagaaagtcacctgacaggcttcaggatacaccttcaccaattgatatcaactggtgcgacacggcccctaggaaaaggctcggaggtgggatgggctgggtgagtccgtagttgtgaagtaagtaccgggactagttctcagtaagtacaacggccaggtactcacgtccgtacggacctacggaacctacttaccgaagaaacgaaaccacggtaccctaagtttacgggaaacttcggaccggtccggtacccgttacgtacccgttccgttacggaaaccgggtaacccgtaccggggtacccggtttacggttaacttttaacgttacgggtttcgggaccggtaaagggtaccggggtccgggggaaccgggtccccgggtacgggttttacggttttttaaggggaaactttaacggttttaagggttacggggtttaaggtacgggggttaacccggtttccgggttaacgggggggtccccgtaaaaccggggggg

SEQ ID NO: 48381 - DNA, 793 bp, Homo sapiens
  misc_feature: GYAE6OF01AID3U.23.23.C01.1.454.CMB.1.raw
  modified_base (437)..(437): a, c, t, g, unknown or other
  misc_feature (437)..(437): n is a, c, g, or t
  modified_base (483)..(483): a, c, t, g, unknown or other
  misc_feature (483)..(483): n is a, c, g, or t
tcagacgcgagtatcacgaccggtgctcgatttagtacacgtgattagggagttggggagtcaacaaccacatctgtcctcgagaggacaccctgtgaccacagctcctcaccatgactggacctggacgatcctctttcgttggtggcagcagccagaagtcgcccactcccgacgaggaattggtgctagtcgtcgggcctggacgggtgaaggaagcccgtggggcatcgagtgaaacgtccaccgtggacgtaaggtcttacgaggtaactacctacccttaaccgaaccgtaaatttgtaacttactaacctaacggtaggggcgtacggaccaccggggtaccccgtaaggggaaaacggtcgttacggaggttcgggagtccgggagtgggtacgacgttacgtaggttgttacggaagtacgtaccggnttactacgtacgaggtaacgttacgaaacggtccgtaagtcctaancccggtcgtacgtaccgtacggactaccgttacgaacgtaaacgaacgtaacgtaccgtaacggttacggtaacctcggtccggaccggtccgtaacggtaccgtcgttaaccgggaccgaaccggtaccggttaccggttacgttaacgttaacgtttacgggtacgtcgggtaagggtaccggaccggggtaaccggtaccggtttaaccggtaggtttttaaccgggtaaatttacgggtttaacgttacgggttaacggttacgggtaacgggtttccgggaggggtaacccgggggtaacccggg

SEQ ID NO: 48382 - DNA, 582 bp, Homo sapiens
  misc_feature: GYAE6OF01BRB9A.23.23.C01.1.454.CMB.1.raw
  modified_base (371)..(371): a, c, t, g, unknown or other
  misc_feature (371)..(371): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcagggccagtcagagtgttgccgactccgtggcctggtaaccaaacaaaaacctggaccacgccctccgaggctcgtcattcatggcacactccaacgacgggccacgtggaccacgtccccgaggcctaggttcaggtgcagtcggctgnggacagtactcactctacacgactcgagctagtcgtaccgaccttgacgttatttcgacttagttttacttacgtgtactagcctaacggtggccgtctacggccttacgtcctaccgttccgggacgtaaagggaccgtacggacgtgggtaaacgagtaacggaaacgtacgtggacggtctcggaccacgtattcgtagttccttacg

SEQ ID NO: 48383 - DNA, 545 bp, Homo sapiens
  misc_feature: GYAE6OF01D6JFL.23.23.C01.1.454.CMB.1.raw
  modified_base (377)..(377): a, c, t, g, unknown or other
  misc_feature (377)..(377): n is a, c, g, or t
tcagacgcgagtatcacgaccggtgctcgatttagtacacgtgattagggattgggggaggaactgctcagtttggacccgagagggaaccatggaagcccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggccctggtaccaacaaaaacctggaccagcctcccaggctcgtcattcatggcacatccaacgacgggccacgtggcactcccgaggcaggttcagtggcagtggctcgtggacagacttcactcncacgatcagcagtgtccgaccctgactatttcgcttagtttatactgtcagactaacggtggcgtccgtggccttagtcctaccgttccggacgtaacgggtcctacgacgtggaactacgtacggaaacgtacgtggtacgctacgaccactatcctgtccttcccg

SEQ ID NO: 48384 - DNA, 743 bp, Homo sapiens
  misc_feature: GYAE6OF01C493R.23.23.C01.1.454.CMB.1.raw
  modified_base (137)..(137): a, c, t, g, unknown or other
  misc_feature (137)..(137): n is a, c, g, or t
  modified_base (184)..(184): a, c, t, g, unknown or other
  misc_feature (184)..(184): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
tcagacgcgagtatcacgaccggtgctcgatttagtacacgtgattagggattggggagtcaacaaccacatctgtcctcgagaggaccaccctgtgaccacagctcctcaccagtgactggacctggacgatcctnttcgttggtgcagcagccagagtcgcccacgtccacgaggtattggngactagtcgtgggcctggaggtagagaacgcggtgggcagtcgagtagaagtcacgtgacaggtctagaganacctactanaacgtaattcgatactacgtaagtggtgaccgtacgaccgtaccgtaaggtaacggcgttacgagtggacgtcggcgtggtcgtagtacgttagtggtacgtagaaccggtacggcttaacgtcgtacgtaacgtaacgtcgaacggtaccgacgtcgtacgtacgtacctagtacccggtaaggtacccttaaccgtaaccgaaggaaccctaacggtaccgtacctaggtttacgaaccggttcgaccgggtccgtaccgaccgttacgtaccgggtaccgaaccggtaccgtccgggttaacccgttagttaccgttagttccggtaggaaccgtacggggtagtccccgggtaaaggtccccggttaaggtttacgggtttaaggacgttttaaacggttaggggtttacccggttaagggttccgggttaaacccgggtccggttaaagggggtccccgtaaaacccgggggg

SEQ ID NO: 48385 - DNA, 812 bp, Homo sapiens
  misc_feature: GYAE6OF01BPUT0.23.23.C01.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggcctccagagaccaccggagattatttcttttgacacagtctccagacatcgtgtctgtgtctcgaggggngagacgccaccctctcctgcgacgggccagtcaaggngttgttcgccgtacgttccgttggcctacgtaaccaaaccaaaaccgtcggaccacgccctccgacggctcgtactactcagtcggacacgctaccgaacgacgggaccacggtcggaccacgtcccgaggactacgggttacaggggtcggaccgtagggtcgggtacgtacgggtacgggaacgtacggttacttaccgtaaccgtttccaacgtaaccgtacttaccgaagtaccgttacgggtaccgttaaccccggtacccgttacgggtaaaccgttttaggttttaccgtaacttttacggtttttaacgtttcgtcgttaaccgtacggtaccgtaacgggtttccggaccccggtacgttaccgggtacccctttacgttacccggttaaccccggttttacgggaacccgggtaaagggttccccgttaccgggaaccggtttacggggaaccgtaaacgggttaaaaccgggaaacgtttaccgggttccgggttaggacccgtttccggaacccttaccttaaccgggtttccctttacggggtttcccctttaacccgg

SEQ ID NO: 48386 - DNA, 651 bp, Homo sapiens
  misc_feature: GYAE6OF01E139S.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccacctctcctgcgagggccagtcagtagtgttcgccgactccgttggcctggtaccaaacaaaaccgtggaccacgcctccaggctcgtcatcatggacacactaccgaacgacgggcctacgtcggctacgtcccgaggccgtacggtcgaggttcggactacggtcgggtccttcgtaggggaaccacggtaccttaccaccgttctaccgtacgactccgagtccgtacggtcgtaccgtacccgtagtacgttactttcggacttagttttaagttaccgttagttaccgagtccgtaaccggtggccgtacgtcgtcctacgttcccgtaccgtccggacgtaacggtcctacggtacgtacggaacgtagtacgaaacggtacgttgggtaccggtacttacggacccgtacgttaagttcttcgttaccgttaccg

SEQ ID NO: 48387 - DNA, 814 bp, Homo sapiens
  misc_feature: GYAE6OF01EBAHT.23.23.C01.1.454.CMB.1.raw
tcagacgcgagtatcacgaccggtgctcgatttagtacacgtgattagggattgggggagtacaacaaccacatcgtgtcctcgagaggacaccctgtgaccacagctcctcaccatggactggacctggacgatcctcttcttggtggcagcgagccagaagtgcccactcccacgagaattggtcgcagtctggcctgaggtgaagaagcctgggcatcagtgaaagtcaccgtgcaaggtcttacagactacaccttacacctaaatttgattatacaacgtggtacgacgaacgacggcccctaggaaaacggtcgtaccggaggtggtagttcgggcgttgggtacgtacggtaccgttaacgggttcgttaggaacgtaacgttaccgggactagtttccgtacgtaaggtaacggttaccgaagggtacccgtaacgggtcctaccgtaccgtacccttacggtaacccgttacgggaaaccctaccgtttacccgaaacgggtaaaccggtaaccaaccggtaccccgtaaaggttttacgggtaaccggttcgggtaccgtacccggtacccgttcgtaaccccgtcgtaaccgtaacccggttaaccgtaacccgggtcccgtttacgtttaacgtttaaccgtttgggtaccggtaccgggaacggggtaaccgggcgggtaaccggggtcccggtacggttttaaggtttttacgggggaaactttaacgggtttaacgttacgggggtttacgttaccgggtaccgggtttcccggtaagggggtacccgtaaaccggggg

SEQ ID NO: 48388 - DNA, 863 bp, Homo sapiens
  misc_feature: GYAE6OF01BN2OZ.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagattacttcttttgaccacagtctcagacatcgtgtctgtgtcctcggagggagagacgcctaccctcgtccgtgcgtacgggcctaggtcgtaagtaggttgttcggacccgtaccgtttccgttcggtaccctacgggttaacccaaaaacccgaaaaacccgttcgggacccgaaaccgtccccgttacccgacgggtacccgttaccgttaccgttacgttccgtaacgtaccggacctaaacctaccgttaaaccccgaaccggtaccgggaccctacggtacgggaccctaaccggtacccgtacggggtaccttaacgggttcgtaacgggtaccggtacggtacgggtcgggtaccgtttacgggaccggggtaaccttaaccggtaccctttaccgacccgtttacgtaccgtaaacgtacgtaccgtaacggttacggccgtttaccggtaaccccgtaccgttacggtaacgtttacgtttacgagtttaacgttttacgtacgttcgtaaccgacgtacgtacggtccgaccgttccgtacgttcccgtaaccgttcccgtacccggttcggaacccgtaaccgggtaccgttaccggtaaggtacggtaacggttaacggaaaccgggtaaacgtcggtccgggttacgacggttcccgtaacctacccgttacgttcctttacgtacccgttaacccg

SEQ ID NO: 48389 - DNA, 616 bp, Homo sapiens
  misc_feature: GYAE6OF01EYM62.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgggagattattcttttgacacagtctccagacatcgtgtctgtgtctcgaagggganagacgccaccctctcctgcgagggccagtcagagtgttcgccgactcctggcctggtaccaaacaaaacctggaccacgccctccgaggctcgtcattcagtcggacacactaccaacgacgggccacgtggacacgtccccgaggctagggttcaggtcggcgaggtcggctcgtgggacagtacttccacgtctacacgatcgagcgtagtcgtaccgacccgttagaccgttattttcgacttagtttactacgtgtacagtcgtaacggtcggaccgtccgtacgggacccttacgtcccgtacccgtttaccgggaccgtaacggggtcctcgggaacgtcgggaagtacgtacggaaaaccgtcgtggtacggcctacggacctaacctagtctcgttccttaccg

SEQ ID NO: 48390 - DNA, 657 bp, Homo sapiens
  misc_feature: GYAE6OF01D4FNP.23.23.C01.1.454.CMB.1.raw
  modified_base (203)..(203): a, c, t, g, unknown or other
  misc_feature (203)..(203): n is a, c, g, or t
  modified_base (641)..(641): a, c, t, g, unknown or other
  misc_feature (641)..(641): n is a, c, g, or t
tcagacgcgagtatcacgaccggtgctcgatttagtacacgtgattagggattgggggaggaactgctcagtttggacccagagggaaccatggaagcccccagctcagcttctcttcctcctgctcctctggctcccagagaccaccggagatattcttttgacacagtctccagacatcgtgtctgtgtctccgagggganagagcccaccctctcctgcagggccagtcagagtgttcgccgtactccgttggcctaggtaacccaaacaaaaaccgtcggaccacgccctcccaggctccgtctaacttccaatcggacactacgtaccaacgacgggccacgtcggcacgtcccgaggctacggttcaggtcggacgtaggtcggcgtcgtagggaacacggtaccttaccgacttactaccgaacgtacttacgacgtacgtacggtacggtaccgtacccgttaggtaacgttacgttttcgacgtttattttacgttacgtgttcctaaggtaccgtaacggtcggacccgtccgttcgaccttagtacccgttacccgttcggaccgtacgggtacctacggacgtaggtaacgtacgtaacggaaagtacgtggtacggctacgacctacngttcctgtcccttacg

SEQ ID NO: 48391 - DNA, 873 bp, Homo sapiens
  misc_feature: GYAE6OF01AEQT7.23.23.C01.1.454.CMB.1.raw
  modified_base (205)..(205): a, c, t, g, unknown or other
  misc_feature (205)..(205): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgactacagtctccagacatcgtgtctgtcgtctaccgagggganagacgcccaccctctcctgcgagggtccagtcagtagtgttcgccgtacttccgttggcccttacgggtaaccaaaacccgtaaaaacccgtcggacccaacgtccctcccgaaggtccttccggttacaactttcaacgtcggtaccaacctactaacccgaaacggaccgggaccctaacgtcgggaacctacccgtaccccggagggtaccttacggggtttaccgagggttacggaccgtaacgggttcgggacccgttacgggtacgggaaccgtaaacggtcccttacctaaacccgtttccgtaaccctaaccgggtaacttaccgaacgggtacctaacgggttaccgggttccccggtaaaccccgtttgggtaaaccgttttacgttttttaccggaaacctttttaaagggtttttaacccttaaaccggttccggttaccgtaacccgggttaacccgttaaccgggttccgggtaccccgttacggttaccccgggtaacccttttaccgtacccccggttaccgtttacccggggaaccggaaaccgggttccgttaaccggacggtacggtaaacgtacggtaaaccggtaaacgtacggtacgtagggtcctaacccggtactacccgttaagttcggttcgtctttacccg

SEQ ID NO: 48392 - DNA, 877 bp, Homo sapiens
  misc_feature: GYAE6OF01EBEDG.23.23.C01.1.454.CMB.1.raw
  modified_base (153)..(153): a, c, t, g, unknown or other
  misc_feature (153)..(153): n is a, c, g, or t
  modified_base (180)..(180): a, c, t, g, unknown or other
  misc_feature (180)..(180): n is a, c, g, or t
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagacgaccaccggagnttattcttttgacacagtctccagacntcgtgtctgtgtctaccgagggganaggtacgccctacccttctccgtgacgacgggccngtacgaggtacgtcgttcgaccgtaccgttcgttacggacctacgtaaccaaacctaaaaccgtcggaccacgtccgtccgtacgcgtcgtcactactacgtcgaccactactacgaacgcggactacgtggacctacgtaccgacgtccaagggttttcaacggttggccgagtcggcgttcctaggggacctacggaacctttcgaaccttccgtacgtaacccggaagttccgaacggtcccgtaacggttacgttaccgggtaaaccccccgttaggttaaacccgggtaacgtttttttcggaaccgtttacgggtttttaaacgttttaaacccgttcgggttacccgttaacgggtaccgtaaaaccgggtttccgggaaccggttacccccgttaacgggggtcccctttaaacggttacccgaacccccggtttttaaccgggggacccccgtaaaacggggggtaaccccgtttacgggtaaacccgtttaccggggtaaacgggtaaacggtttaaccgggtaaaaacccgggtaaaccggttaacggggttccgggtaacccgttaccgggtacccttaaaccccgtaagtttacccgtttacgggttaccccttttaaacccgg

SEQ ID NO: 48393 - DNA, 716 bp, Homo sapiens
  misc_feature: GYAE6OF01DSXPV.23.23.C01.1.454.CMB.1.raw
  modified_base (206)..(206): a, c, t, g, unknown or other
  misc_feature (206)..(206): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagacgaccaccggagattattcttttgacacagtcctaccagacatcgtgtctgtgtctccgagggganagacgcccaccctctcctgcgacgggccagtcgagagtgttcgccgacttcgtgcctaggtaacccaaacgaaaaccgtcggaccacgccctaccgaggtcctcgtacacttcgagtcggaccaactacgtacccgaacggaccgggaccacgtcggaccaactacccggacggacgtacggttcgaggtgggactagggtcgtccgtacgggtacgggaacaggtaccttccgtactcctacgaccgtatcgacgtactacgggtccgtaccgaccgttagactttacggttttcgacgtttagtttaagttaccgtacgtacgtacgtacggtaaccggtcgggccgtccgtcggtaaccttacgtcccgttaaccggttccggaacccgggtacggtacgtaccggtaaggtagggtaaacgtacggtaaaccgggtaaaaccggcggtttcggaccgggtcttaccgaccgtaaccgttacctttacggtaccgtttccttacccg

SEQ ID NO: 48394 - DNA, 599 bp, Homo sapiens
  misc_feature: GYAE6OF01A36S5.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttcgccgactccttggcctacggtaaccaaacaaaaacctggccaacgcctcccgaggctcgtcattcatggcacataccaacacgggccacgtcggacactccccgaggcgtaggtcaggtgggcaggtcggctcgtagggacagtactcgactctacacgatcagtacgtcgtacgaccctgacgttagtttcgacttaagtttacttacgtcgtacgagtaccgtaacggtggcctacgtcggacccttataccgtaccttccgggtaaccgaacggcctacgaccgtagggtaaccgaagtaacggaaaacgtacttggcggtctaccgactaaccacgttactcgttcttgtaacccg

SEQ ID NO: 48395 - DNA, 831 bp, Homo sapiens
  misc_feature: GYAE6OF01BE5I7.23.23.C01.1.454.CMB.1.raw
tcagacgcgagtatcacgaccggtgctcgatttagtacacgtgattagggattgggggagtcaacaaccacatctgtcctcgagaggacaccctgtgaccacagcctcctcaccatggactggacctggacgatcctcttcttggtggcagcagccagaagtgcccactcccacgaggaattggtgcagtcgtgggcctggaggtagaagaacggccgtggggacagtcaaggtagaaaacgtccaccgtgacgtaacggtccttacgaaggtacttaacctacccgttaccaaaccttaaagtttagaacttaactaccgtaacggttcggggtacggaccggaaccgtaacccggggtacccccggttaaagggggaaaaccgggtccggtaccgggtaaggggttacggggtacgggtacggggtcggttagggggttacgtacggtttacccggttagggttcggttaagggaacggttaaacggtacccggggtattaacgttccgtaacggtaaggttaaaccggtttacgaaacggtacccgacggtacctccgaacgtcccgtacggtacccgtaacgaacctaccgttaacgaaggtaaaccgaaccgtacctacccgttaagtttaccgggaacttcgggacccggtcccggtacctacggtaccctcgtacgaaccggtaccgacggtccgttagttacttagttcggacgtacggagggtacgggaccggtacgggtccgttaggtttaggtttagggaactttagttacggttacggtacgtacgggtaccggttgggtaccggggacgtaaccgggg

SEQ ID NO: 48396 - DNA, 698 bp, Homo sapiens
  misc_feature: GYAE6OF01D5TR7.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatatttcttttgacacagtctccagacatcgtgtctgtgtctccgaggggagagacgccaccctctcctgcgagggccagtcagtagtgttcgccgtacttccgttggccgtacggtaacccaaaacaaaaacccgtcggaccacgccctcccgaggcctcgtctattcagtcggacactactacccgaaacgacgggaccacgtcggacactcccgaggtcctacggttcaggtcggactaggtcggtcgtcgtacgggaacagtacttaccactctcaacgtatacgacgctacggtcgtccgacccgtgtaacgttattttcgacctttaagttttactttacgtcgtaccgacgtaccgtaacgggtcgggaccctccggttacggtcccttaacgttacccgtacccgtttacgggaacccggtaacgggtacctaccggtaacgtagggtaaacgtaacggttaaccggaaaacgtacggtttcgggaccggtacgttaccgaccgtaacccttacgtttccgttaacgtttcccttaccg

SEQ ID NO: 48397 - DNA, 615 bp, Homo sapiens
  misc_feature: GYAE6OF01BHVDQ.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttcgccgactccgttggcctggtaccaacaaaacctggccagcctccaggctcgtcattcatggcacactaccaacgagggcccacgtggaccacgtccccgaggtcgtacggttcaggtcggcaggtggctcgtgggacaggtacttcactctacgacgatcgagctaggtcgtccgaccgtgacgttatttcgacgttagtttacttacgtgtacctaggtacctaacgggtcggccgtccgttcgggtacccttacgtcccgtaccgtttccgggaccgtaacgggtacctccggacgttagggaacgtacgaacgggtaaaccgtacggtggtacgtccgtacggtaccctaactattccgtgttcccttacccg

SEQ ID NO: 48398 - DNA, 576 bp, Homo sapiens
  misc_feature: GYAE6OF01AZ9HF.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttcgccgactccttggcctggtaccaaacaaaaacctggaccacgcctacccaggctcgtcacttcatcggcacactccaacgagggacccacgtcggcacgtcccgaggcaggttcaggtgcagtggctcgtgggacacggacttcacttctcgacgactcagcagtgtccgaccctgacgtatttgactagtttatactgtacagtcgtaacgtcggcgtccgtaggtcctaacttccacccgttcgaacccgaagggtaccctcgtacgtagggaagtacgtaacggaaacgtacggtggtacggacttggaccaccgtattcgtgttccgttaccg

SEQ ID NO: 48399 - DNA, 801 bp, Homo sapiens
  misc_feature: GYAE6OF01C5Q8R.23.23.C01.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtcctccagacatcgtgtctgtgtctccgaggggngagagcccaccctctccgtgcgacgggccagtcagngttgttcgaccgtctccgttggcctaggtaaccaaaccgtaaaaaccgtcggccctacggccctcccgacggtccttccggtactacgttccagtcggaccaacacctaccgaacggtacgggccctaagtcgggactacgtacccgacgggtacgtacgggttcagggtacggtaccgaggttcggaccgtttaccgggtaacggggaactaaccgggttaaccctttacccgtacccgttaccttaccggaaccgtacttaccggaacggtcccgtaacgggtttaccgggtaccccgtaaccgtagggtaccgttttacgtttttacgggccgttttaaggtttttaacttcgtttaccgacggtaaccgtaccggtaacgggtcggtccccggtacgttaccggtccgtttaaaccgtccccgttacccggttacccgggaccgtaaccggggtaccgtttaccggacgggtacggtacggaacgttacgggaaaacgtttacggtgggttaccgacccgttacggaccctaaccgtagttccgttgttccttaacccg

SEQ ID NO: 48400 - DNA, 731 bp, Homo sapiens
  misc_feature: GYAE6OF01AGRBV.23.23.C01.1.454.CMB.1.raw
tcagacgcgagtatcacgaccggtgctcgatttagtacacgtgattagggattggggggaggaactgctcagtttggacccagagggaaccatggaagccccagctcagcttctcttcctcctgcctcctctggctcccagagaccaccggagatattcttttgacacagtctacagacatcgtgtctgtgtctccgaggggagagacgccaccctctccgtgcgacgggccagtcagtagtgttcgacccgacttccgttggaccgttacggtaacccaaaaccaaaaccgtcggacccaacggccctcccgaacggtcctccgtactacgttaccagtcggacaccgtactacccaacggccggaccacgtcggcctaccgcccgaggccgtaggttccgaggtccggcgtagggtcggtccgtcggtacgggaactacggtaccttaccgacttcccgtaccgaacgtaccgtacgacgtacgtacgggttccgtacccggtaccccgttaagggttaccttaagttttacggtacgtttaagtttttaccttacggtacgtacggtacgtaaccgtaacggtcggtacccgttcggtaccgtaccttaccgtacccgtaaccgttccggaacccggtaaggtccctaggtcggtacggaaggtacgtaacggaacgttaacgtcgggtacgtacggactacctacgacgttcttcgtcccttaccgg

SEQ ID NO: 48401 - DNA, 658 bp, Homo sapiens
  misc_feature: GYAE6OF01ENK90.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagacgcccaccctctccgtgcgagggccagtcaggagtgttcgccgactcttggcctggtaaccaaacaaaaccgtcggaccacgccctcccgaggcctcgtcatcagtgcacactccaacgacgggccacgtcggacactcccgaggtcgtaggttcaggtcggcaggtcggctcggtaggactagcctttacacttcaccgacgtatcgacgtacgtacggtcgtacccgacccgttgaaccgttagttttcgactttacggttttacttacgttgtaccgtaggtaccgtaacggtccggtacgtcccgtacggtacccttagttacccgtaaccggtttcccgggacgtaacggggtacctacggtaacggttacggaagttaggtaaccggaaaccggttacgtcgggtacggtcgtaacgccgtaacgtgttaccttcgtccgtttacccg

SEQ ID NO: 48402 - DNA, 777 bp, Homo sapiens
  misc_feature: GYAE6OF01BHIWE.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgcccaccctctcctgcagggccagtcagagttgttcgccgtacttccgttggccttacggtaacccaaaaccgaaaaacccgttcggacccaacgcccttaccccgaaggccttaccggtacctacttaccgagttcgggacctaaccaacgttaccccgaaaaccggacggggtacccctaaccggttacgggaccctaaccgttacccccggaagggtacccgttaacggggttttaccgaacggggtttacgggaccggtaacgggttccggggtacccgttacggggttacgggggaaacctaacgggttaaccctttacccgtaccgtttacccgtaccgtaaccggtacttaccgacgtaccgtaggttccggtacccgtacccgttaggtacgtttacgttttcgactttagtttttacttacgtgttaccgagtaccgtaacggtcggccgtccgtcggtaccctacgtccctaccggttccgaccgtacggtacctcggagttacggatacggtacgaaacgtcgtcggagacctacgacctacgtattcttcgtcttaccg

SEQ ID NO: 48403 - DNA, 731 bp, Homo sapiens
  misc_feature: GYAE6OF01A9KZP.23.23.C01.1.454.CMB.1.raw
  modified_base (197)..(197): a, c, t, g, unknown or other
  misc_feature (197)..(197): n is a, c, g, or t
  modified_base (317)..(317): a, c, t, g, unknown or other
  misc_feature (317)..(317): n is a, c, g, or t
tcagacgcgagtatcacgaccggtgctcgatttagtacacgtgattagggattgggggaggaactgctcagtttggacccagagggaaccatggaagcccagctcagcttctcttcctcctgctcctctggcctccagagaccacggagatattctttgacacagtctcagacatcgtgtctgtcgtctcgaggganagcgccacctcgtctgcgaggccagtcagagtcgtcgccgtactcgtacgcgtaggtaaccaaacaaacgtcggaccacgtaccctccgacggcctcgtactacttacagtcggacaccnctaccgaaagtcggtacctacggtacggaccttaaccgtccgaacggtcgtaacgggttcgacggttaggacgacgggtcgtacgttcggtaaggaccgtacgtaccgttactaccgttcaacgtacgtaagtcgaccggtacgtacggtcgtaacccggtaccgtttggtaacgttagttacggtacttaagtttacgtcgtacgtacgtacgtacggtaacgggtcgtaaccggtccttacggtcccgttaacgtccggtttaacccgccggggtaaaccgtaccgggtaccgttacggtaccggtacggtaaaacggtcggtaaaccggtaacggttacccggtacggttacccggtaacggtacccacggttaaacccccgtagttttcccggtacctttacggtacccc

SEQ ID NO: 48404 - DNA, 773 bp, Homo sapiens
  misc_feature: GYAE6OF01C74FT.23.23.C01.1.454.CMB.1.raw
  modified_base (208)..(208): a, c, t, g, unknown or other
  misc_feature (208)..(208): n is a, c, g, or t
tcagacgcgagtatcacgaccggtgctcgatttagtacacgtgattagggattgggggaggaactgctcagtttggacccagagggaccatggaagccccagctcagcttctcttcctcctgcctcctctcggctcccagacgacccacggagattattcttttgacacagtcctccaagactatcgtgtctgtgtctccgagggganagacgcccacccgtctccgtgcgacgggccagtacaggtacgtgttcgacccgtacttccgtcggtccgtaggtaaacccaaacgaaaaccgtcggacccacgtccctcccgacggtcctacgtactactacgagtcggacacgtactaccgaacgtacgggcctaacgtcggacctaccgtacccgaggtaccgtacggtcgaggtcggactagggtcggtactcggtaacggacgtacggtaccttcgaacgtcctacgtacgtacgtcgaacgtacgtacggttccgtaaccgtacccgttaggtacgtttacgtttacgaccgtttttaagtttactttaacggtcgtaaccgttaacggtaccgtaaccgggttcgggtacccgttcccgggttaacgttaccccttacggtaccccgttaacccgggtttcccgggaaaccggtaccggggttaacctaccgggtaacggtagggtaaccgtaaggtaaaccggtaaaccgttaggttacgggttcgaacctcggtaacccacgtaccgttcgtcggttaccttacccg

SEQ ID NO: 48405 - DNA, 668 bp, Homo sapiens
  misc_feature: GYAE6OF01BSD6Y.23.23.C01.1.454.CMB.1.raw
  modified_base (151)..(151): a, c, t, g, unknown or other
  misc_feature (151)..(151): n is a, c, g, or t
  modified_base (435)..(435): a, c, t, g, unknown or other
  misc_feature (435)..(435): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgganattattcttttgacacagtctccagacatcgtgtctgtgtctcgaggggagagacgccaccctctcctgcgacgggccagtacgagtagttgttcgccgtacttccgttggcctacggtaaccaaacaaaaaccgtcggacccacgtcccgtaccgacggccttcgtactacttcgacgtcggcaacgactaccgaacgacggccacgcgacactccgagtacgtacggtcaggtcgacgacggtcgcgtcggtaggactacgtactcgactcgacgacgtacnacgcgtacgtcgtaccgtaccgtgtacgttacgtttacgactttaacgtttacttacgttcgtacgtacgtacgtaacggtcggtccgtaccgtcggtacccgtacgttacccgtacccggttaccggaccggttaaccgggacgttccggtaacggtaggaacgtaaggtaacgaaacggttcgtccgggtacggtcctacggtacctactacggttcttcggttcctaccg

SEQ ID NO: 48406 - DNA, 797 bp, Homo sapiens
  misc_feature: GYAE6OF01CT5C8.23.23.C01.1.454.CMB.1.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (316)..(316): a, c, t, g, unknown or other
  misc_feature (316)..(316): n is a, c, g, or t
tcagacgcgagtatcacgaccggtgctcgatttagtacacgtgattagggattgggggaggaactgctcagtttggacccagagggaaccatggaacgccccagctcagcttctcttcctcctgctcctctggctccagagacccacggagatattctttgacacagtctaccagacatcgtntctgtgtctcgaggganagacnccacctctccgtgcgacgggcctagtcagtgtgttcgcctactcgtgcctaggtaacaacgaaacgtcgactacgtcctccgacggtctacgtctacgttcacgtgaccanactaccgaacgtacgggacccacgtcggacctaccgtaccgcggacgtaacgggttcacggtcggaccgtacggttcggacccttgggtacggtacgtaacgttaaccgttaccggtaaccttcccggtaacgaaccggtaccgttaacggaaccgttaaccgtcgggttaccgtaacccggtaacccggtacggtttaacgtttacgttttaaccggaccgttttaagttttaacccgtttaacggtttaccggaacgtaacggttaacccggtaaacgggtcccgggtaacccgttacccggttacggtaaccccgtttacgttacccgttaacccgggtaccgggtaacccggtacggtaccgaaccggttaacgtagggtaactaacgggttaacggtaaaaccgtacggtttgggaccgttaacccgacgttacccgtaaacttcccggtttactcccggtttctttaaacccccg

SEQ ID NO: 48407 - DNA, 666 bp, Homo sapiens
  misc_feature: GYAE6OF01BA4FL.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttcgccgactcgtggcctggtaaccaacaaaacctggccagcctccaggctcgtcattcatggcacgatccaacgacgggaccacgtggaccactaccccgaggactacgggttccaggtcggactaggtcggactccgtggggaacctagtacctttcaaccgttcctacgaacgtactacgacgtacgtacggtcgtacccggtaaccccgttaggaaccgtttaacgttttacggacgtttaacgtttttacttaaccgttcggtaacgtacgtaacgtaaccggtcgggacccgtccgtacggtccttaacgtccctaaccgttccgggaaccgtaacgggtacctacggaacgttacggaacggtacgtaacggtaaaccgacgttcggtacggctacgaccacctagtctacggttcttaaccg

SEQ ID NO: 48408 - DNA, 718 bp, Homo sapiens
  misc_feature: GYAE6OF01DPFCJ.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgcctcctctggctcccagagaccaccggagatattcttttgacacagtctccagacatcgtgtctgtgtctcgagggganagacgcccaccctctcctagccacgggccagtcagtagtgttcgccgtactccgttggcctaggtaaccaaacaaaaccgtcggaccacgccctcccgaggtcctcgtctattcagtcggaccacactaccaacggacgggcccacgtcggacctacctcccggacggccgtaggttcaggtcggacgtaggtcggcgttcgtacggacacgtacctctactctacgacgtactcacgtacgtacgttcggtaccgtacccgtaggtaaccgtttagtttcgtactttaacgttttaacttacgttcgtaccgtacggtaccgaacggttcggtacccgtccgttaccggtccttacgtacccgtttacccggttccgggaacccggtaacggggttacccgtaccggtaacggtaacgggtacgtaaacgttaacgggtaaacccggttacggttcgggtaccggtaccgtcgtaaccccgtacgtttacttaccggttcgttaccctttacccg

SEQ ID NO: 48409 - DNA, 928 bp, Homo sapiens
  misc_feature: GYAE6OF01DFWX9.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatatttctttgactacagtctccagacatcgtgtctgtgtctccgaggggagagacgcccacctctccgtgcgacgggccagtcagtgtgtcgcccgtactccgtggaccgtacggtaacccaaaaccaaaaccgtcggaccacgccctacccgacggtcctacgtctacttcgagtcggacacactaccgaacgacggcctacggtcggactaccgtacccgaacgggtcgtacggttacgaacgggtcggtacgaacggggtttcggccgttaccggggtacggggtaaccgtaacggttaccctttacccggtaaccctttaccgtacccgtaaaccgggtaccttaaccggtaacggtcccggttaacggttaccccgggtaacccccgggtaaaccctttaacggggtttaaaccgtttttacggttttaaccggttaaaccggttttaacggttttttaaccgtttaacccggttccgggtttaaccggtaacggttaacccggtaacggggttttcccgggaacccggtttacccccgttaacgggtttacccccgttaacgggttaccccccggtttaaacccggggtttacccgggaacccgggttaaacccggggtaaccttttaccccggggaaacggtaacgggttaaacggaaaccggtttaaaaacggggaaaaaccccgttcgggttacggggtacgtcccgtaaccggtaaccccgttaacgtaaccgttttccgtttaaaccggtcccttttaaaccccgg

SEQ ID NO: 48410 - DNA, 579 bp, Homo sapiens
  misc_feature: GYAE6OF01ACSSM.23.23.C01.1.454.CMB.1.raw
  modified_base (203)..(203): a, c, t, g, unknown or other
  misc_feature (203)..(203): n is a, c, g, or t
  modified_base (373)..(373): a, c, t, g, unknown or other
  misc_feature (373)..(373): n is a, c, g, or t
  modified_base (420)..(420): a, c, t, g, unknown or other
  misc_feature (420)..(420): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatatttcttttgacacagtctccagacatcgtgtctgtgtctccgagggganagacgccaccctctcctgcgagggccaggtcagagtgttcgccgactccgttggcctaggtaaccaaacaaaacctggccagcctccaggctcgtcattcatcggcacactccaacgacgggccacgtcggcactcccgaggctaggttcaggtcggcaggtcggctcgngggacagtactcactctcacgatcagcagtcgtccgacctgacgttntttcgatagttttactacgtgtacacgtctaacggtgccgtcgtcggacctagtccgtaccgttcggaccgtaacgggcctacggacgtcgggaacgtacgtaacggtaaaccgtacgttggtacggacgtcgtacctaactattcgtcgttcttaccg

SEQ ID NO: 48411 - DNA, 596 bp, Homo sapiens
  misc_feature: GYAE6OF01B5N5V.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcgacgggccagtcagagtgttcgccgtactccgtggcctggtaaccaaacaaaaccgtggccagccctccaggctcgtctatcatgacacactccaacgacggccacgtcggcactcccgaggcaggttcaggtgcgagtcgctcgtggacagtctcactctacacgatcgagctaggtcgccgtaaccgtgtaaccgtatttgacttagtttacttacgtgtagacgactaacggtcggccgtccgtggtaccctacgtccctaccggttcggacccgtaacgggccgttcgaacgttgggaacgtaacggtaacgaaaccgtacggttggtccgggactacggtccaacgttacttcgttaccgtttctaaccg

SEQ ID NO: 48412 - DNA, 642 bp, Homo sapiens
  misc_feature: GYAE6OF01C3W2T.23.23.C01.1.454.CMB.1.raw
  modified_base (200)..(200): a, c, t, g, unknown or other
  misc_feature (200)..(200): n is a, c, g, or t
  modified_base (438)..(438): a, c, t, g, unknown or other
  misc_feature (438)..(438): n is a, c, g, or t
tcagacgcgagtatcacgaccggtgctcgatttagtacacgtgattagggattgggggaggaactgctcagtttggaccagagggaaccatggaagccccagctcagcttctcttcctcctgctcctctggctcccagagaccaccggagatattcttttgacacagtctccagacatcgtgtctgtgtctcgagggganagacgccacctctcctgcacggggccagtcgagtacgtgttcgccgtacgtccgttggcctacggtaaccaaacaaaaccgtcgggaccacgccctaccgacggctacgtctattcgtactcggaccaacactaccaacgtacgggccaacgtcggacacgtacccgacggacgtacggtcgtaggtcggcgaggtcggtctcggttcgggaacagtacgtctacgtcctacaacgtntacgacgtacgtaaggtctacccggtacccgtaggtacgttacttttcggactttagttttaactcgtacgtcgacgtacgaacggtggactcacgtcgtcctatccggttaccgtacggacgtaacggtaccgtcgtaacgtcgggaagtaacggtagaaacggtacgtggtacgtactccgactacgtactcgtacgttacc

SEQ ID NO: 48413 - DNA, 634 bp, Homo sapiens
  misc_feature: GYAE6OF01BC4QZ.23.23.C01.1.454.CMB.1.raw
  modified_base (179)..(179): a, c, t, g, unknown or other
  misc_feature (179)..(179): n is a, c, g, or t
  modified_base (623)..(623): a, c, t, g, unknown or other
  misc_feature (623)..(623): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgaccacagtctccagacntcgtgtctgtgtctccgagggagagacgccaccctctccgtgcgtacggccagtcagagttgttcgccgacttccgttggcccgtaggtaaccaaaccgtaaaaccgtggaccacgccctccgaggtcctcgtcattcagtcgacacactaccgaacgacggccacgtcggacctacgtaccccgaggtccgtacggttcacggttaggccgtaggtcggtacgtcggtacgggacgtacgtaccgttccgtaacgtccctaacgaaccgtacgtacacggccgtaaggtcgtaccgtacccgtagtaccgtttatttcgactttacgttattcgacgtacgagtacgtacggtcgccgtcgtacgaccttcgtacccgtagtccggacgacggtaccgtacggtagtcgaagacgtaggaactgcgtacgcacggtacacgtntcgtctcgtac

SEQ ID NO: 48414 - DNA, 945 bp, Homo sapiens
  misc_feature: GYAE6OF01BR77O.23.23.C01.1.454.CMB.1.raw
  modified_base (226)..(226): a, c, t, g, unknown or other
  misc_feature (226)..(226): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccgagacgaccgaccgggtagtattattttcttttagaacacgtaggtcctaccagactagtcgtggtctggtgtcctacggaggggtanacgacgtccctaccctcgtaccgtgaccggtacggggacctgtaccgaaggttcggtagttccggaccgtacttccggttcggtaccgttaccggtaacccaaaacgtaaaacccgtcggtaacctaccggtaccccgtccggtaacggtccttacggtaccgttataccgtacgtcggtacctaccgtaactacccgaacgaccgggaccttacggtaccgaccgtaacccgtccccggtaggtaccgttacgggttacgacggttcggaccgttaggtcggtaccgttaccgtaacgggaccgtacgtaaccttccggacctacgttaccgacggttaaccgtcgtaacggtacggttaccggtccgtacccggtttaaacccctagggtttaacccgttacggttttacggtaaccttttaacgggttttacttacccgggttagttaaaacccggtacgggttacccggttaaaccgggttccggggttacccctacggggttaccgttaaccccgtttacgggttacccccgtaccggtttaacccggaaccggggttaaccggtcccggttaacgggttaaacccggtacggggttaaacgtaacccggttaacggtaaacccgggtttaggtacccgggttaaacgggtccctaacccggggttaccttaaccccggttaaggtttcccgttacccggtttcgttaccccgg

SEQ ID NO: 48415 - DNA, 828 bp, Homo sapiens
  misc_feature: GYAE6OF01BXX05.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganacgacgcccaccctctcctcgcgacgggcctagtcagtagtgttcgccgtactccgtcggccgtacggtaaacccaaaacgtaaaacccgtcggacccacgtcccctacccgacggtcctaccggtacctacgttaccgagtcggaccacgtacgtaccgaacgacgggaccctacggtcggacctactaccccggaggtccgtaacggttacgaacggtcggacgtaggtcggacgtacggtcgggaacctacggtaccttaccgtaccttccgtaaccgtaacgtactacgtacggacctttaacgggtccgttaccccgaacccgtttagggaaccgttttacgttttacgaaccggttttaactttttacgttaccgtacgggttacctaacgggtaccgtaacggggtttccgggtacccgtcccgggtttacgggtaacccctttacggtacccccggttaaccgttaccgggaccccgggtaaggtaccccgttaggaccgggttaggtaaaccggtaacggtttaaaacccgggaaacgggtacgtttcgggaaccgggttaccgtaacccggttaaccccgtaacccttgtttcccggttacgtttcccgttacccg

SEQ ID NO: 48416 - DNA, 684 bp, Homo sapiens
  misc_feature: GYAE6OF01D2P7T.23.23.C01.1.454.CMB.1.raw
  modified_base (310)..(310): a, c, t, g, unknown or other
  misc_feature (310)..(310): n is a, c, g, or t
  modified_base (506)..(506): a, c, t, g, unknown or other
  misc_feature (506)..(506): n is a, c, g, or t
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttgggtgcagcagcccagaagtcgcccactccccgacggaggaagttggtagcagtcgtgggcctggacggtagaagacgccgtgggacagtcgagtagaaagtccactgacgaaggtctagacggataccaccttacgaactaagttgaatacgtacaacgttgggtcnccggtacgaccggtaccccgtaagggaaacgggtcctacggaggtggaggtcgggcggtagggtacgtacgttaccgtaggttgtaggtaacgtaacggtccggactcgtttacgaacgtaagtaacgttacggaacgtcgaacggctacggactcccggtacgaccgtacggaactacgttacgaagaacgaacncgtaccctagttaccgaacgtcgacggccgtaccgtacgccgtacgacgacgaccgacggtcctagttacgttagttcgacggcgagggtggccgggtggacccgtttgggttagttttaacggagttacggttagtacggttaggtacggtaggttcgggacgggtcggtaaccggg

SEQ ID NO: 48417 - DNA, 889 bp, Homo sapiens
  misc_feature: GYAE6OF01AQHJ8.23.23.C01.1.454.CMB.1.raw
tcagacgcgagtatcacgaccggtgctcgatttagtacacgtgattagggagttgggggaggaactgctcagtttggacccagagggaaccagtggaagccccagctcagcttctcttcctcctgctcctctggctcccagagaccaccggagatattcttttgacacagtctccagacatcgtgtctgtgtctccgaggggagacgagcccacccgtctcctgcaggggccaggtcagacgtgttcgccgtacttccgttggccttaggtaacccaaacgtaaaaacccgttggacccaacggcccttcccgaaggtccttcgtactacgtttccgagttcgggacctacctacgttacccgaaacgacggggacccaacggtcgggtacctaccgtaccccgaagggccctaagggttaccaggttcggacgtacgggtcgggtccgtacggttcgggaacgtacggtaacccgtttaccgaccgttacctaccgaaacggttacgttacccgtaaggccccgttaaaggttacccggtacccggtaaacccccgtttaggtaacccgggttttaaattttttccggggaaccgtttaaaggttttttaccgttaaccggtttacggtaacccgtaacggttaaccgttaacgtttacgggggttacggttcccgttaccccggttagggttaccccctttaaacggttccccgtaaccccggttttaccggggaaccccggttaaacgggggacccttaccggtaaacccgttaagggggaaccgtaaacggtttaacgggaaaacccgggtttaaccgggcgggttacccggtacgttaaacccggtacccgttaaccgttaccggtttacccgttggtttaccc

SEQ ID NO: 48418 - DNA, 621 bp, Homo sapiens
  misc_feature: GYAE6OF01A9DEQ.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgactacagtctccagacatcgtgtctgtgtctccgaggggganagacgccaccctctcctgcagggccagtcaggagtcgttagcccgactccgttgggccctagggtaacccaaacaaaaaccgttggacccacgccctacccaggcctcgtcattcatggcacataccaacgacgggaccacgtcggaccactaccgaggctaggttcaggtcggctaggtcggtctcgtcgggaacagtacgttcacgtctacgacgtactacgagcgtacgtcgtaccgacccgtggtaacgttacgttttcgaccttaggttttacttacgtacgttacaacgcgtaacggtcggcgtccgtacggtcgtactccgtaccgttacggaccgacggtaccgtcgacgtggacgacgtacggaaacgtacggtggtacgactcgacaccgttactcgtgttcctacg

SEQ ID NO: 48419 - DNA, 672 bp, Homo sapiens
  misc_feature: GYAE6OF01BCDC7.23.23.C01.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
tcagacgcgagtatcacgaccggtgctcgatttagtacacgtgattagggattggggaggaactgctcagtttggacccagagggaaccatggaagccccagctcagcttctcttcctcctgctcctctggctcccagagacaaccggagatattcttttgacacagtctccagacatcgtgtctgtgtctccgagggganagagccaccctctcctgcaggccagtcagagtgttgccgatccttggcctgtaccaacaaaactggccagcctccgagctcgtcattcatgcacatccaacnggcactgacactccaggcaggttcagtgcgtagtgggctcgtacgggactagtaccttacgaccttaccgttaccgaacccgtacgttacgaacgtaccgaacgggttcggtacccgtaacccccgtaggtaaacccgttagttttccgtccttaacggtttttacttaacgttacgtacacgtacgtaacggtcggccgtcccgttcggaccctttacgtaccgtaacccgtttaccggacccgtaaacgggtaccgttacgaaccggttggaacggttaaagttaccgggtaaaaaccgtaacgtttgggacgggttacctacgggtaccctaacccgtatttacccgttggttcccgtttaacccg

SEQ ID NO: 48420 - DNA, 723 bp, Homo sapiens
  misc_feature: GYAE6OF01DIRUX.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagattattcttttgacacagtctccagacatcgtgtctgtgtctcgagggagagagcccacctcctccgtgcgacgggcctagtcaaggtcgtggttcgaccggtactccgttcggccctaggtaaacccaaactaaaaaccgtcggacctacggcccctacccgacggtccttaccgtactaacgttcgagtcggaccaactacgtacccgaaacgacgggaccctaacgcggtaccaacgtcccggaggtactacggttcgaaggtcggacgacgttcggcgtcgtaagggaactacgtaccttacaccttcgaacctacgacgtacgtaacgacctaggtacgtaccgtacccgtaggtaacttagtttacgacgttttacgtttactttacgtcgtaacgacggtacgttaacggtcgggtccgacccgtttcgacccgtttacgtacccgttccgtaaccgggaccgtacgggtacctacggttacgcggtaaagtaacgtaaacgtaaaaccgttagtcgggttacggctacggtaacccaacgttcttacgttcgttcgttaaccg

SEQ ID NO: 48421 - DNA, 770 bp, Homo sapiens
  misc_feature: GYAE6OF01BFETI.23.23.C01.1.454.CMB.1.raw
  modified_base (208)..(208): a, c, t, g, unknown or other
  misc_feature (208)..(208): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccacggatattatttctttgacactagtcctccagactatcgtgtctgtcgtcctcggagggganagaccgccctaccctctcgtgcgacgggccagtcaggtagtcggttcgccgtacttccgttcggccgtacggtaaccaaaaccgtaaaccgtcggacccacgtcccgtacccgaggtccttacgtactacttccgagtcgactacctacgtaccgaacggcggtacctacggtcggacctaccgtccgaggtccgtaggttcgacggtacggaccgtaggtcggtaccgtcggtaggtaaccgtaccgttaccgttacctacgttctaccgaacgtacgtacgaacgtcgtaacggttacccgtaccggttaacccgttaggtaaccgttttacgtttaggttaactttaaccgggttttacttaacggttacgtaccggtaacggtacccggttacgtccgggtccccgttcgggtaacccttcggttaacccctacccgtaccggttacgacccgggtaaggtcccgtagtacgtagggaacccgttaggaaccgttaaacggacgttcgggtaccacgttaccgaacccgttacgtacgtttcgtaccgttccgttacc

SEQ ID NO: 48422 - DNA, 812 bp, Homo sapiens
  misc_feature: GYAE6OF01D0SGZ.23.23.C01.1.454.CMB.1.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (501)..(501): a, c, t, g, unknown or other
  misc_feature (501)..(501): n is a, c, g, or t
tcagacgcgagtatcacgaccggtgctcgatttagtacacgtgattagggattgggggaggaactgctcagtttggacccagagggaaccatggaacgccccagctcagcttctcttcctcctgctcctctggcctccagacgaccaccggagtattatttctttgactacgtagtcctaccagactatcgtgtcgtgtgtcctcggagggganacgacgccctaccctctccgngacgacgggcctaggtacaggtacgtcggttcgaccgtaccgtttccgtcggtacctacggtaaacccaaaaccgtaaaaccgtccggaccacgtcccgtacccggagtccgtacgtcctattccgagtcgcaactactaccgaacgtaccggaccacgtacgacctaccgtaccgacggtacgtacggttcgtaaggtcggacgtaggtcggacgttacggacggtaacctaggttaccttacgtacctaccgtacgacggtacnccgtaagtaccgtacgggttaccgtaccccggtaaccgttacggtaaccgttttagtttaccggtacttttaaacggttttcttacccgggttacgtaaccgtacggtaacccggttaacgggtccggtcccgtaacccgggttacgttaccccgttaaccgtaccccgtttacccgggtaccggtaacccggtaagggtacccgtaacgggtcggaaacgggtaactaacggaaaccggtttaaaccggaggttcgggttacgaccgtaccgtacccgtacgttacgttcccgttagtttccgttacccg

SEQ ID NO: 48423 - DNA, 927 bp, Homo sapiens
  misc_feature: GYAE6OF01DL9A0.23.23.C01.1.454.CMB.1.raw
tcagacgcgagtatcacgaccggtgctcgatttagtacacgtgattagggattgggggaggaactgctcagtttggaccagagggaaccatggaagccccagctcagcttctcttcctcctgctcctctggctcccagagacccaccggagatatttcttttgacacagtctccagacatcgtgtctgtgtcctcagggggagagacgcccaccctctccgtgcgagggccaagtcaggagtcgttcgccgtacttccgttggcccgttaggtaacccaaaaccgtaaaaaaacccgttcgggacccaacggtccccttcccgaacgggtccttccggtactaacttttccgaagttcggggacctaacgaaccttaccccgaaaaccggaaccggggacccgtaccggttacggggacccaaccgttcccccggaaacgggtaccggtaacgggtttacgaacggggttcggggacccgtaagggttcgggtcccggttaccggttacgggggaacctaacggttaaccgtttacctaacccgttacgttacccgaaacggtacttacggtaacggtacccgtacgggtttaccgggtaccgtaaaccccgtttacgggaccggttttaagtttttcgaacccggttttaagtttttaaacgtttaccggtttacgtttaaccgtaacggttaccggtaaacgggttttccgggacccggttacccgtttaccgggtacccctttaacgtttaccccgttaacccgggtttacccgggaccggggttaaaccggtaccggttaccgtaaccggttggggtaaacgaacggtttaaacgggaaaaacccggttacgggttacggttacgggtacccgttacggtacccgaacccggttatttaccgttcggtttaccctttaacccg

SEQ ID NO: 48424 - DNA, 670 bp, Homo sapiens
  misc_feature: GYAE6OF01B96CZ.23.23.C01.1.454.CMB.1.raw
  modified_base (349)..(349): a, c, t, g, unknown or other
  misc_feature (349)..(349): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaagcttcaggatacaccttcaccaaatttgatatcaactgggtgcgacaggcccctaggaaaagggctcgaggtggagtgggctgggtgagtcctagtgtgagaagtaccgggntattctacgagtaagttcgaaggccaggctcgacgcctgacctacggaaccacttaccgagaaacgaacgacgaccctagtttacggaactcggccggtccggcctacggtacccttccgtacggaaccgaccggtaccggtcccgttacggttactttacgttcggtaggccgtaagggacggggaccggggtaacgggtcccgggtacgggttacgggtttttttaaggggaaacgttttaaaggtttaggtttacgggttaacggtttaggggtaacccggtttcgggtcggggggtacccggtaaaacccggggggg

SEQ ID NO: 48425 - DNA, 836 bp, Homo sapiens
  misc_feature: GYAE6OF01DNMNO.23.23.C01.1.454.CMB.1.raw
  modified_base (225)..(225): a, c, t, g, unknown or other
  misc_feature (225)..(225): n is a, c, g, or t
  modified_base (385)..(385): a, c, t, g, unknown or other
  misc_feature (385)..(385): n is a, c, g, or t
  modified_base (443)..(443): a, c, t, g, unknown or other
  misc_feature (443)..(443): n is a, c, g, or t
tcagacgcgagtatcacgaccggtgctcgatttagtacacgtgattagggattgggggagtcaacaaccacatctgtcctcgagaggacaccctgtgaccacagctcctcaccatgactggacctggacgactcctcttcgttggtcggcagcagccagacgcgcccactccacggagtacgttggtcgacgtagtcggcggtctggacgggtaggaaacggacnccgggtgggacaacgtcgaaggtacgtaacgtccgactcggacgtaacggtcttaacgaagtacctaaccttaaccttacgtaaccttaaagttcgtaacttacgtacgaacggttggacgacgacgaccgggtaccgaagggaacgttcggaggtaggnggtacggtcgggtggtaggtcgacggtttacgtggtacgaaggtaaccgagtacccgnttacgtaccgtagtaaactacgggcgtaacggacgacggtacctcggaccgtacgtaacgtaaccgtacggtaaaccttaaccgggtacgaaaacggtaaacccggaactaaccccggtaaccgtttaacgggtaccgttaaccggtacgggtcccggtccggtaacccggttccgtaaccggttaccggaccggtacccggaaccggttccggttaactttaagggtactttggtacggacggtaacgggtccggggtaccgggaccgggttacgggtaaccggttaggttttaagggttacggtttaaacttggggtttaacggttcgggtttaaaccggtttccggggaacggttacccgggggtaaggggtccggggttaaacccgggg

SEQ ID NO: 48426 - DNA, 699 bp, Homo sapiens
  misc_feature: GYAE6OF01C7URI.23.23.C01.1.454.CMB.1.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (689)..(689): a, c, t, g, unknown or other
  misc_feature (689)..(689): n is a, c, g, or t
tcagacgcgagtatcacgaccggtgctcgatttagtacacgtgattagggattggggggaggaactgctcagtttggacccagagggaaccatggaagccccagctcagcttctcttcctcctgcctcctctggctcccagagaccacggagatacttcttttgacacagtctccagactatcgtgtcttgtgtctccgagggganagacgccaccttcncctgcacgggccagtcagagttcgttcgaccgactccgttcggccttaggtaaaccaaacgaaaaaccgtcggtaccacgcctccgaagcctcgtcctattcagtcgacaactactacaacgacggccagtcggacacgtccgaggctagggtcaagtcggcctaggtcggtactcgtagggacaacgtacttacaacttctacgaacgtacttacgacggtacgaacgttcggtaaccgaccgtagtaaccgttactttttacggaccgtttaaggttttaactaaccgttcgtactaacggtacggttaaccgtcggggaccgtccggtaacggtacccgtttatacccggtaccgtttacggaacccgttacgggggaacttccgaaacggtcgggtaataacgttaaacggaaaccggttacttagggtcggttaccggtaggaacccacttagttacccggttntaccttaccg

SEQ ID NO: 48427 - DNA, 782 bp, Homo sapiens
  misc_feature: GYAE6OF01B9PLP.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctcgaggggagagacgcccaccctcgtcctgccgacgggccagtcaggagttggttcgccgaccttccgttggacccgtacggtaaccaaaaccaaaaccgtcggacccaacggccctcccaggtcctcggtctattccaagtcggcaacctacgtcccaaacggcgggccacgtcgacctacgtcccgtaggacctacgggttccaaggtcggacgtacggtcggtaccgttcggtacggggtaacacgttaccgttccaccgttaccgtacgaaccgtactccggtaacgtcgtaagggttccgtacccggtaaccccgttaggtaaaccgtttagttttaccgtaccggtttattttttaaccttacggtacgttacgaaccggtaccggttaacgggttccggccggtaccctttacgggtaccctttacgtaccgggtttacccgttacggggaacccgtaacggggtaccttccgggtaacgtcggggtaaacgtaaccggttaacggaaaaaccggttccgtggggtaccgttaaccggccgtaacccgtacgttctaccccgtttggttaacccttacccggg

SEQ ID NO: 48428 - DNA, 638 bp, Homo sapiens
  misc_feature: GYAE6OF01EF00X.23.23.C01.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (598)..(598): a, c, t, g, unknown or other
  misc_feature (598)..(598): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtcctcgaggggngagacgcccaccctctcctgcgagggccagtcagngtgttcgccgacttccgttgccgttacggtaaccaaaccaaaaaccgtcggccacgccctcccgaggcctcgtctattcatcggcacactacccaagacgggccacgtggaccactcccgaggtcgtagtcaggtgcgagtcggcgtcgtcgggaacgtcttaccgtcctacctctacgtactacgtacgacgtacgtcggtacgtacccgtcgtacggttaacgtttcgtttacgtacgtttatttacgtgttcgtacgtacgtacgtacgggtcgccgtcgtacgtccgtactccgtccgtaccggaacgacggtacgtgtaggtaacggtagtaaccgtaacggaacgttaggtcggngtaccgtacgacctcttaccgtttgtcccgttattacccg

SEQ ID NO: 48429 - DNA, 670 bp, Homo sapiens
  misc_feature: GYAE6OF01C1VQU.23.23.C01.1.454.CMB.1.raw
  modified_base (381)..(381): a, c, t, g, unknown or other
  misc_feature (381)..(381): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctggaggtgaagaagccgtgggcatcgagtagaaagtcacctgacgaaggtctacaggataacctacccttacaacctaaattttgaattactacaacgtgggtgaccgacgacggaccccgtaggaaaaggccgtaggagtggagtgggcgtgggtcgtagtccgtagtgtgaagaacgtaccggntagttctacgagtaagttccgaacggccgtaggcctacgacgccgtacgaccgtaggacctaaccgttaccgaagaaaccgaacgtacgtaccctagtttacggaactcggccgtccggccgtacgtacctcgtacgaacccgacgtacccgggtacgttacgttagttacgtttagtcggacggtaggacggggtaccggacggtcccggtagtttacggttttaggaactttagtttaggtggttaacggtacggtacgtttacgggaggggtacccggtaacgggg

SEQ ID NO: 48430 - DNA, 736 bp, Homo sapiens
  misc_feature: GYAE6OF01BF62H.23.23.C01.1.454.CMB.1.raw
  modified_base (203)..(203): a, c, t, g, unknown or other
  misc_feature (203)..(203): n is a, c, g, or t
  modified_base (443)..(443): a, c, t, g, unknown or other
  misc_feature (443)..(443): n is a, c, g, or t
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctcggctccagacgaccacggagattattctttagacactagtctacagatatcgtgtctgtgtctcggaggganacgcgcctacccgtctccgtcgacggacggcctagtcgaaggtcgttggttaccgccgtaccgttccgttcggacccgttaacgtaaaccaaaacgtaaaacccgtccggtaccaccgtccctaccgtaggtcctacgtactacttacgagtccggacaacctaccgtaacccaacggtaccgggtaccaacggttcggacctaccggtaccccggtaacgggaccgttaggttaccggngggtaacggtcggtaggtcggtccttacgggacgggaactacggtaccttacgtaccgtacaccngtaacacggacncgttacgtcgtaccacgttagtaccgtatttacgacttaaggttcttaacgtggtaacaccggtacggtacgtccgggttacaccgttcggtactacccggttctaaccgggtaccgtacgcggtaacgtacggtacgtacgggaaagtccggtaaaagggtacgtcggttggtaccgtgacccttaaccgtcgacttttcaccggttctaccccg

SEQ ID NO: 48431 - DNA, 752 bp, Homo sapiens
  misc_feature: GYAE6OF01BO54S.23.23.C01.1.454.CMB.1.raw
  modified_base (200)..(200): a, c, t, g, unknown or other
  misc_feature (200)..(200): n is a, c, g, or t
tcagacgcgagtatcacgaccggtgctcgatttagtacacgtgattagggattggggggaggaactgctcagtttggacccagagggaaccatggaagcccagctcagcttctcttcctctgctcctctggctccagagaccgaccggagattattctttgacacagtctaccagacatcgtgtctgtgtctcgaggganagacgccacctctcctgcgacgggccagtcagtagtcgtcgaccgtacttccgtggcctaggtaacctaaacaaaaccgtcggaccacgcctaccgacggtcctcgtactacttacgacgtacggccaacgtacgtacccgaacggtacgggaccctacggtcggcctactcccgacggtaccgtaggttacgacggtcggtactacgggtcggtccgtacggtacggaaccgtaacggtaccttaccgtaccgttctaccgtaacgtacgttaccgagtaccgtacggtcggtacccgtaacccgtagggtaacctttaggtttacgtaactttacggtttaacgttacccgtcggtaccgtaagtacggttaacgggtccggtacccgtacgtttccggtacgttaaccggttccgttacccggttaaccggaaccggtacggtacgtccggtaacggtacggtaacggtacgtaaccggaaagtaccggttggactaccggaaaccgttcccaaacgttttaggtccccgttaggttaccccttaccgg

SEQ ID NO: 48432 - DNA, 738 bp, Homo sapiens
  misc_feature: GYAE6OF01CA4JW.23.23.C01.1.454.CMB.1.raw
  modified_base (207)..(207): a, c, t, g, unknown or other
  misc_feature (207)..(207): n is a, c, g, or t
tcagacgcgagtatcacgaccggtgctcgatttagtacacgtgattagggagttgggggaggaactgctcagtttggacccagagggaaccatggaacgccccagctcagcttctcttcctcctgctcctctggcctcccagacgaccacggagattatttcttttgacacagtctaccagacatcgtgtctgtgtctcgagggganagacgccctaccctctccgtgcgacgggccagtcaggtagtgttcgccgtactccgttggacctacggtaaccaaaaccaaaaccgtcggacccacgtaccccgtcccgacggtccttccgtacgtactttacacgtcggacctaaccactaacccgaacggaccggaccctacgtacggacctaaccgtcccggacggtccgtacggttaccgaggtcggccgagggtcggtccgtcggtagggactacgttaccttaccaccgttctacgaaccgtatacgacgtcgtacggtcgtacccgaccgttaggtaacgtttagtttacgtacgtttaattttacgtacgtacgtacgtacgtacgttacggtcggaccgttcgtaggtaccttacgtacccgtaccggttccggaccggaacggtacctcggtaaccggtaggaacggtaagttaaccgggtaaacggtacggttcgggtacgagtacccgtaacctacgtaccgttcgttaaacggtttcctttaacccgg

SEQ ID NO: 48433 - DNA, 780 bp, Homo sapiens
  misc_feature: GYAE6OF01D8XLO.23.23.C01.1.454.CMB.1.raw
  modified_base (757)..(757): a, c, t, g, unknown or other
  misc_feature (757)..(757): n is a, c, g, or t
tcagacgcgagtatcacgaccggtgctcgatttagtacacgtgattagggattgggggaggaactgctcagtttggacccagagggaaccatggaagccccagctcagcttctcttcctcctgctctctggctcccagagacccaccggagatatttcttttgacacagtctccagacatcgtgtctgttgtctccgagggggagagacgccctaccctcctccgtgaccgaggggccctagttccgaaggagtttcgtcggccgaccttccggtttcgggccgtaacggtaaacccaaaaccgaaaaacccgttcgggacccaccgtacccctacccgaggtccttccggtactacgtttccaacggttgggaccaacgtaactaccgaaaccggaccgggtacccacggtcgtaccaccgttcccgaaggcgtagggttccgaggttcggacgtaggcgtcctaggtacgggaactaccgtaccgttcctaccgttaccgtacgtaacctagttcgacgacgttacgtaccggtccccggtaaaccttggtaacgttacgttttcgacgttttaaggttttactttaccgtagttccgtacgacccgggttaggtccggaccgttacccggtcggttacccttaacccggaccttacccgggttacccgggaacggttaaccgggctaacccgggtcggtaggaacgtaacggttaaacgaacttcgggacgttcggtcccgtacgacgttaccngtttcccgttgttaccttaaccg

SEQ ID NO: 48434 - DNA, 563 bp, Homo sapiens
  misc_feature: GYAE6OF01E09QW.23.23.C01.1.454.CMB.1.raw
  modified_base (203)..(203): a, c, t, g, unknown or other
  misc_feature (203)..(203): n is a, c, g, or t
  modified_base (387)..(387): a, c, t, g, unknown or other
  misc_feature (387)..(387): n is a, c, g, or t
  modified_base (548)..(548): a, c, t, g, unknown or other
  misc_feature (548)..(548): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgggagatattcttttgacacagtctccagacatcgtgtctgtgtctccgagggganagagccaccctctcctgcagggccagtcagagtgttcgccgactccttggccttggtaccaacaaaacctggccacgcctcccaggctcgtcattcatggcacatccaacgacgggcccactggcactccccaggcaggttcagtggcagtggctctgggacaggacttcactctacacgatcngcagtcgtccgtaccctgaacgtatttgacctagtttatacgtgtcagcgaacgtcggcgtccgtcggcctactccgtaccctttcggaccaaggggtacctaccggtacgtacggagtaagtcgtaaaacgtacgtggtacgggtactcggacaacccgnttcctcgtccttacc

SEQ ID NO: 48435 - DNA, 602 bp, Homo sapiens
  misc_feature: GYAE6OF01BSR2C.23.23.C01.1.454.CMB.1.raw
  modified_base (409)..(409): a, c, t, g, unknown or other
  misc_feature (409)..(409): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgcccaccctctcctgcgagggccagtcaggagtgttcgccgactccgttggccgtaggtaccaaacaaaaacctggaccacgccctcccacggctcgtctattcatggcacactaccaacgacgggaccacgtcggcctacgtcccgaggtcaggttcgaggtcggcaggtggcgtcgtcgggacacgtctcactcacacgtntcagcacgtcgtccacctgtacgtatttcgacttagtttattacttgtacgacgtcgtaacggtggccgtccggtcggtaccttacgtcccgtaccgttaccgggaccgtaacgggtccctacggtacgtcggaagacggtaacgtaaacggtacgtcggacgtcgtcgtaccgcgtattcttcgtccttacg

SEQ ID NO: 48436 - DNA, 766 bp, Homo sapiens
  misc_feature: GYAE6OF01CIK5G.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctccagacgaccaccggagattattcttttgacacagtctccagacatcgtgtctgtgtcctcgagggganagcgccacccgtctccgtgcgtacgggcctaggtccaggtagttgtccggccgttacttcccgttggtccgtacggtaaccaaaacgaaaaccgtcggaccacgtccctacccgacgtcctcgtacctacttccaacgtcggacctacctactacccgaaacggccgggtaccctacgtacgggacctacgtaccccggagggccgttacgggttccgacggtcggcgacggttcgggcctacgggtacgggacctacggtaccttccgaactttccgtaaccgactacggtacacggtacgtacggtcggtaacccgtccggtacggttaccgtttcgtttaacgtacgttttacgtttacgtttaccgtcggtaccgtacggtaacgtaacgggttcgggacccgttccggtaccggttccttaaccgtccgttaacccggttcgggaaccgtaacgggtaccgtacggtccggtaagggtaacaacggttacggaaaccgtacgggttcggaccgtcggacgtccctaacgtacgtttccttcggttaccctttaccgg

SEQ ID NO: 48437 - DNA, 882 bp, Homo sapiens
  misc_feature: GYAE6OF01A8T3G.23.23.C01.1.454.CMB.1.raw
  modified_base (200)..(200): a, c, t, g, unknown or other
  misc_feature (200)..(200): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagactattcttttgacacagtctccagacatcgtgtctgtgtctcgaggganagagccacctctccgtgcgagggccagtcgagagtgtcgccgactccttggcctaggtaccaaacaaaaccgtgaccacgcctcccgagcgtacgtcattcagtcggactacactaccaacgacgggaccacgtcggaccacgtaccccgacgacggttaacggttaccgaacggtacgggaccgtaacgggttcgggaccgttaccggtacggggaaaccgtaacgggtaaccctttacccgtaaccgttacccgtaacccgtaaccggtaccgtacgtaaccggtaccgttaacggtaccggttacccggtaaccccgttaaagggttaccgtttaacgttttttaccggcgtttaaaccgttttttaacggtttaaacccgtacggtttaacccgtaacggtttaacccggaaccggtttacccggggacccggttacccgggtttacccgggtaccctttaaccgtttacccgttaaaccccggggtttccgggaaaccccggttaaacgggggtaacccccggttaccgggtaaaccggttaaccggggtaacggtttaaaacggtaaaccgggtaaaaacccggttaaacgggttccgggttaccgggtaacccggttacgtaccccggtaacccttaggtttaccccgtttacggttttacccctttaccccggg

SEQ ID NO: 48438 - DNA, 610 bp, Homo sapiens
  misc_feature: GYAE6OF01CNYP1.23.23.C01.1.454.CMB.1.raw
  modified_base (285)..(285): a, c, t, g, unknown or other
  misc_feature (285)..(285): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (513)..(513): a, c, t, g, unknown or other
  misc_feature (513)..(513): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctggcctgaggtgaagaagcctggggcatcagtagaagtcacctgcaaggcttcgaggactacaccttcaacctaaatttgatatcaacgtgggtancgacacggcccctaggaaaacggctacgaggtggagtgggcgtgggtgaggttcctaggttgtagacgacgtaccgggactnttccanagtaacgttcaacggccaggcctcgagcctgaccgtaggaacctaccgttaccaagaaacgaacacgacctattacggaactggccgcggcctacgtacctacgacggaccgacgtaccggtcgttagttatttagttgngaccgtaggcgggcggtacgggccgtcggttagttttagggaaactttagttagttaggtacgtacgggtacgttcggcggggtaccgtaaccgggg

SEQ ID NO: 48439 - DNA, 675 bp, Homo sapiens
  misc_feature: GYAE6OF01DI2IL.23.23.C01.1.454.CMB.1.raw
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (332)..(332): a, c, t, g, unknown or other
  misc_feature (332)..(332): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (513)..(513): a, c, t, g, unknown or other
  misc_feature (513)..(513): n is a, c, g, or t
  modified_base (598)..(598): a, c, t, g, unknown or other
  misc_feature (598)..(598): n is a, c, g, or t
tcagacgcgagtatcacgaccggtgctcgatttagtacacgtgattagggattgggggaggaactgctcagtttggacccagagggaaccatggaagccccagctcagcttctcttctcctgctcctctggcctccagagacccgaccggagtattattcttttgacacagtctaccagactatcgtgtctgtgtccgtacgaggggagacgacgcccaccctctccgtgacgacggcacgtnaggtagtggtccnccgtactcgttcggaccgtcgaaccaaacgaaactcggccgacgcctccgagcctcgactattcaatcggaccacnctaccgaacgccggactactcgacacgtaccggngacgttggtacgnggtcggatacggtcggacgttcggacgggacctacgtacctccgttaactcgtaaccgtacgaattccgaacgtcgtagttcccggacgttaccgttacggttacttacggtttactaacgttttacggttttntaacgtcgtacgaacgtcgtaccggtggaccctcgggttaacctcctacccgttacgtcccggtaccggtaccgaaccgttcgtntaccgggtagtaaacgaggtaaacgacggttactgggaccgtactaccgacgttacctagtccttcgttcttacccg

SEQ ID NO: 48440 - DNA, 596 bp, Homo sapiens
  misc_feature: GYAE6OF01DHRXV.23.23.C01.1.454.CMB.1.raw
  modified_base (423)..(423): a, c, t, g, unknown or other
  misc_feature (423)..(423): n is a, c, g, or t
  modified_base (524)..(524): a, c, t, g, unknown or other
  misc_feature (524)..(524): n is a, c, g, or t
  modified_base (574)..(574): a, c, t, g, unknown or other
  misc_feature (574)..(574): n is a, c, g, or t
  modified_base (585)..(585): a, c, t, g, unknown or other
  misc_feature (585)..(585): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgcccactcccacgaggattggtgcagtctgggcctgaggtgaaggaacgccgtggggccattcagtagaagtccaccgtgaccgaaggccttacgaggaataacctaccctttacaacccgtaaaattttcgaattatacctaacgtgggtgaccgaccgacggaccccgtagggaaaacggcgtacggaggtggagtgggcgtgggtgacgtctagtgttagagtaacgtcggctatcgtgagtacgtacaggccgagtcncgacgcgtagaccgtaggaccactacgaagaacgacacgacctagttacgactcgcgccgctcgcctcgtacgacgacgacggtcgtagttattagttcgngacgaggcggcgacgcgtaggttacgtttaggaattagttagtggttagnggtacgtcggnggcggaacggg

SEQ ID NO: 48441 - DNA, 723 bp, Homo sapiens
  misc_feature: GYAE6OF01BM6I9.23.23.C01.1.454.CMB.1.raw
  modified_base (169)..(169): a, c, t, g, unknown or other
  misc_feature (169)..(169): n is a, c, g, or t
  modified_base (223)..(223): a, c, t, g, unknown or other
  misc_feature (223)..(223): n is a, c, g, or t
  modified_base (404)..(404): a, c, t, g, unknown or other
  misc_feature (404)..(404): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagattattccttttgacanagtcctccagacattcgtgtctgtgtctcgagggggacaagagtccacccttcncctgcgacgggccagtcaggagttggtcgccgtactccgttcggccgttacggaaccctaaaaccaaaacccgtcggacccagccccgtcccgaggcctcgtcacttcagtcggcacatccaacgcggaccagtcggacctacgcccgaggtctaggtcctagggtcgacgtaggtcgggntcgggtacggaactacggtacctttacgacttcgtacaccgtatcgacgtacgaacggttccgtaccgaacccttggaaccgttttgttcggactttaacgttttacgttaacgttcggtaacgttacggaacgggttaccgtccgggtacgtccggtaaccggtcccttaacttaccggacccgtttaccggaaccgggttaaccggtcgtaaccgggtacgtacggtaacggtaaccgtaaacgggtaaaccgtcggtttacggtaccgtaccggtaagtccgtaaacggttacctagttcccggttaagtttcccg

SEQ ID NO: 48442 - DNA, 570 bp, Homo sapiens
  misc_feature: GYAE6OF01ANMHK.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgttgccgactccgtggcctggtaccaacaaaacctggccagcctccaggctcgtcattcatcggcacactaccaacgcgggccacgtcggaccactcccgaggctaggttccaggtcggctaggtcggctcgtagggacaggtacttcgacctctccgaacgtactacgagctagtcgtccgtaccctgacgttagtttcgacgttagtttactacgtgtacagtacgtacggtcgcgtctcggtcctacgtaccgtaccgttcggaccgtacgggactcgtacgtaggacgtagtacgaagacgtgtacgtcgtcgtaccacgatctgttcctacg

SEQ ID NO: 48443 - DNA, 820 bp, Homo sapiens
  misc_feature: GYAE6OF01C7U6J.23.23.C01.1.454.CMB.1.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgagggganagngcccaccctctcctgcgacgggccagtcagagtgttcgccgtactccttggcctaggtaaccaaacaaaaccgtcggaccacggtccctacccgaggtcctcgtacattcagtcggaccacactaccaacgacgggccagtcggacctactacccgacggacgtacgggttcaacggttcggacgtaggtcgggccttacgggtaggggaaccacggttaaccttccaacgttccgtaccgtaaacgtacttaccggaacgtaccgtaacgggttaccgtaaccccggtaaccccgttagggttaaaccggttttaagttttttaccgggaaccgtttttaacgttttttaaagttacccggtttcggtaacgtaacggtaaccggttaaccgggttcgggacccggttaccgttaccgggtaccctttaacggtccccgttaaccggttacccgggtaaccggtaaccggggtacccgttacgggtaaccggtacgggtaaaacgtaacggttaaccgaaaaaccgggttaacgttcggggtaaccgggttacccgttaaccgcccggttaaaacccttatttaccccgggttgttttcccgtttaaccccgg

SEQ ID NO: 48444 - DNA, 755 bp, Homo sapiens
  misc_feature: GYAE6OF01CADVR.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgcctcctctggcctccagagaccaccggagatattctttgacacagtctccagacatcgtgtctgtgtctcgagggagagcgccacctctccgtgcgacggccagtcgagtacgtgtcgccgtactccgttcggctacggtaaccaaacgaaaaccgtcgaccacgcctaccgagtacctcgtctagttcagtcggctacacgtaccaacggacggtacctacgcggactaccgccgacggacgttaaggttcacggtcggaccgtaagggttcggaccgttcgggttacggaaccgttacggtaccctttacgaacccgtttactaccggtaaccgtaacgtttcccaacggtaccgttaagggttccgttaaccccggtacgttccggttaaaccgtttacggtttttaaccgcgtttaaacgttttaacgttccgtttacgtaaccgtaacgtacccgtaacgggttcgacccgttcgttaccgggaccttacgtccgttaacccggtcgtaaccggaacgttccggtaaccgtacggtaccggtaagtacgtaaaccgggtaaccaagtttccgggacgttacccgtacggacccttaacgtaagtcccgttaacgttccgttaacccg

SEQ ID NO: 48445 - DNA, 973 bp, Homo sapiens
  misc_feature: GYAE6OF01C3KOD.23.23.C01.1.454.CMB.1.raw
tcagacgcgagtatcacgaccggtgctcgatttagtacacgtgattagggattggggagtcaacaaccacatctgtcctcgagaggacacctgtgaccacagctcctcaccatggactggacctggacgatcctcttcttggtggcagcagccagaagtgcccactcccacgaggaagttggtgcagtcgtgggcctggaggtgaagaacgccgtggggacagtcaggtagaaacgtcaaccgtgacgaacggcttacgaggtaactacctaacccttctaaacctaaaattttgaattactaccgtaaacgtgggggtagaccggaccgaaccgggtacccccggtaacggggaaaacgggtccgttacgggacgggtggtaacggttcggggtaccggttggggttacgtacggtttaccggttaaggtcggttaaggtaacgggtaaacgttaccgggggtattaccgtttacgtaacgtaacggttaaacggttaccggtaaacggggaccctacggggtacccgttacgtaaccggtacccgttaccggaacccggttacgggaaacccgttaacccgtttacccgaaaagggttaaaacccgaaaccgtaaccggttaccccgtacggttttaacggggtaaacccttccgggacccgggtaccggtccccggtaacgttaccccgttaccggtaaccgggaacccgaaacccgggttacccggggttaacccggtttaggtttaacggttacccggttttacgggtaccgggaaccgggttaaccgggggacgggggtccccggggtaagggggttaccccgggttaccggggtttttaaagggttttttacgggggtaaaattttaaaccgggtttagggttttaaccgggggttaggttaaccgggggttccccggtttaaacggggggtccccgggggaaaccccgggttaaacccggggggg

SEQ ID NO: 48446 - DNA, 710 bp, Homo sapiens
  misc_feature: GYAE6OF01C7N4O.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggctccagacgacccacggagtattattctttgacacagtcctcagacatcgtgtctgtcgtcgtcgaggggnagacgccctaccctctccgtgacgtacgggcctacggtcaggtacggttcgtccggtaccgtaccttccgttccgggtaccgtaccggtaaaaccctaaaccaaaaccggtcggacccaccgtcccgtaccgacggtcctcgtacctacttacgacgtaccggaccaacctaccgtaaccgaacggacccgggacctacggccgactaccgtacccgagggtacgtacggtcgaggtcggacgtacgggtcggtcgtacggtacggtaacgtacgttacccgtactccgtactaccgactacgtcgacgtacgcgttaccgaccgtaccctaggtacgtttagttcgtacgtttagttactcggtcacgtacgtcgtaccgggtgtccgtcgtacgtacctacgtaccctacgtcgtaacgacggtacgtccgtacgtaccggtagacggtaagtaccgtaacggtcggtaggtccgtctaaccgacacttccggttatcgttacc

SEQ ID NO: 48447 - DNA, 969 bp, Homo sapiens
  misc_feature: GYAE6OF01D2UU4.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccacggagattattcttttgacacagtctccagacattcgtgtctggtgtctccgaggggagagaggccctacccgtctcctgcgagggccagtcagtagtgttcgccgtactccgttggcctacggtaaccaaacgtaaaaaccgtcggaccacgtccctacccgaggtccttccgtactattcgagtcggaccacgtacctaccgaagacgggccctaacgtcggacctacgtacccgacgggtccgtacgggtttacgaacggttcggtaccgtaaggggttcgggtaccgttaccggggtaacgggggtaaccctaacggggtttaaccccttacccgttaaacccgtttacccggttaacccggtaaaccgggtaaacccgtttccggaaaccgggttaccgggtaaaccgggtttaccccggggttaacccccggttaaaccccccggtttagggttttaaaccccgggtttaactttttttaaccggggtaaccctttttaacgggtttttttaaacggtttaaaccccgtttaccggttttaaccgaaccggggttacccgtttaaaccgggttcccgggtacccgggttacccggtttaccgggtaccccctttaaacggtttcccggttaaaccccgggtttcccggggaaacccgttaaccgggggtacccgttaaccgggtaaccgggttacggggtaaacggttaaaccggtaaaacgggttaaaacccgggttaacggttacggggttaaccgggtaccgttaacggtacccctaaaccgtcggtttacccggtttccgttacggtttacccc

SEQ ID NO: 48448 - DNA, 747 bp, Homo sapiens
  misc_feature: GYAE6OF01BRQP9.23.23.C01.1.454.CMB.1.raw
  modified_base (205)..(205): a, c, t, g, unknown or other
  misc_feature (205)..(205): n is a, c, g, or t
  modified_base (736)..(736): a, c, t, g, unknown or other
  misc_feature (736)..(736): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagattattcttttgacacgagtctaccagacatcgtgtctgtgtctcgagggganagacgccaccctctctgcacgggccagtcagagtcgttgccactccgttggccgtaggtacccaaacaaaaccgtcggaccgacgccctcccgaggccttcgtacactttcgatcggacactacgtaccaacgtacggcctaacgcggtacacgtaccccgagggtccgtacgggtttacgaggtacggccgtaagggtcgggtacccttacggtacgggggtaaacctaaccgggttaccttttaacccgaacccgtttcctaccgtaaacggttaactccggtaaggacctttacgggtacgttaccccggaccccgttaaggttaaccgttacttttacgggacctttaaggtttttacctaacggttcgttacggacgtaacccggtacggttccggcccgtaaccggtcgtacccttacgtccgttaccggtccgggaaccgtacgggtacctcggtaaccgtaggaagtaccgtaacggtaaacgtggtccggtacggtccacggacttacccgtagtcccgttntcccttacccg

SEQ ID NO: 48449 - DNA, 923 bp, Homo sapiens
  misc_feature: GYAE6OF01AQSRG.23.23.C01.1.454.CMB.1.raw
  modified_base (764)..(764): a, c, t, g, unknown or other
  misc_feature (764)..(764): n is a, c, g, or t
tcagacgcgagtatcacgaccggtgctcgatttagtacacgtgattagggattgggggaggaacgtgctcagtttggacccagagggaaccatggaagccccagctcagcttctcttcctcctgctcctctggctcccagacgacccaccggagtactatttcttttcgacacagttcctccagacatcgtgtctgtgtcctacggagggacgagacgcccaacccttcttccgtgccggacggaccagttaccgaggacgttcgttacggcccgtaccgttccgtttcggacccgttaggtaacccaaaccgtaaaaaccgttcggacccgtaacgtccccgtacccgtaacgggccttccggtactaccttcgtacgtacggtcaacctacgtacccgaacggaccgggacctaccgttcggacctacgtacccgaaggtcctacggtacacggtacgaccgtaggtcgacggttccgtaggggaactacggtttacctaccgtaccgttaccgtaccgtaaacggtactaccggtacgttaccggtaagggttacccggacccggttaacccgtttacggtaaaccggtttacgtttttaccggttaaccgtttaaccgggtttttaacgttttacccggttacggtttaacccggtaacggttaaacccgggttaacggttccggggttacccgttaaccccgggttaccgtttaccgttaaccccggtttaaccgttaccccggggtttaaacccgggnggtttaaaaccccgggtcccttaaccgggtacgggttaaacgggaaccggtttaaaccgggtaacgttaaaccgggtaacggttcggtttaaccggggaccctttaaaccggtcccgttaaacggttacccgttcgtttaaccggttcccgttaaccgg

SEQ ID NO: 48450 - DNA, 819 bp, Homo sapiens
  misc_feature: GYAE6OF01CI7WY.23.23.C01.1.454.CMB.1.raw
  modified_base (586)..(586): a, c, t, g, unknown or other
  misc_feature (586)..(586): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctccgaggggagagagccacccgtctcctcgcgacgggccagtcgagagttcgtcgccggtaccttccgtcggcccgttacggtaaacccaaaaccgtaaaaacccgtcggacccgacgcccctacccggacggccttaccggtactacttcagtacggccaactaccgtaacccgaaccggaccgggtacccgtaacgttaccggacctacccgttacccggaaggtaccgtacgggttacgtaggtcggacgtagggtcggcgtacggtagggacctacggtaccttccgtacgtcaccgtacgacttacgacgacgtacgttcccggaacccggtccctagggttaacttacgttttacgacgtttacgttttaacggttacttccggtaanaccggtacccggtaacggccgggtaccttcccgggtagtaccccgttacttacccggttacccgtaccccgggtaacggtaacccgtacccggttcgaaccgggttcgggaaacgtaaacgggttaacggaaaaacccggtttccgggttacggggtacccggtacccggttacctaaaccccgttacccggttagttttacccggtttccggtttaaccccctttaccccgg

SEQ ID NO: 48451 - DNA, 663 bp, Homo sapiens
  misc_feature: GYAE6OF01BXE0B.23.23.C01.1.454.CMB.1.raw
  modified_base (294)..(294): a, c, t, g, unknown or other
  misc_feature (294)..(294): n is a, c, g, or t
  modified_base (550)..(550): a, c, t, g, unknown or other
  misc_feature (550)..(550): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgcccactcccacgaggaattggtgcagtctgggcctggaggtgaagaagccgtggggcatcagtgaaagtcacctgacaaggtcttcgaggtactactaccttacaacctaaatttgatatacaacgtgggtnacgacacggccccgtaggaaacgggctacggaggtggagtgggcgtgggtgaggttccgtagtgtaggaagtacgtaccgggactacgttcgtacgaagtaacgttacgaacggtaccgaggtcgtacgacgtcgtcgtaccgtacggaacctacgttaccgaagtaacgaacacgtacctagtttacgacgttgccgtcggcctcgtacctcgtacgaccgacgacccggtcgttacgtagtttacgttgtacgnggacggtacgggccggaacgggcccggtaggtttacgggttttaaggtaacttacggttaagtaggttaacggtacgggtaccggttcgggtacggggacccggtaaacgggg

SEQ ID NO: 48452 - DNA, 689 bp, Homo sapiens
  misc_feature: GYAE6OF01C6MRS.23.23.C01.1.454.CMB.1.raw
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (613)..(613): a, c, t, g, unknown or other
  misc_feature (613)..(613): n is a, c, g, or t
  modified_base (678)..(678): a, c, t, g, unknown or other
  misc_feature (678)..(678): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccgagacgaccaccggagacttattctttgacactagtctccagacatcgtgtctgtcgtctaccgagggganagacnccaccgtctctgcgacgggccagtcagagttgtcgaccacttccgtcggtccgtaggtaaaccaaacctaaaaccgtcggaccacgccctaccgaggtctccgtactacttcgacgtcggacctaactaccgtacctaaaccggacgggcctacggtcggtaccgacctacccggaggtaccgtaacggttcacggtcggtacgtagggtcggtcgtacgtacgggactacgtaccttccgacgttcgtacgtaacgtacgtacgacgtacgtacgtccgtaccgtaccgaggtaccgttgtttacgactttacggttattcgtacgtaccgaacggtacgtaacgggtgcccggtacctacgggtaccctacggtccctacggtcgtaaccgagggtccncggtacgacggtaagacgtaacgtaaccggagtcggtacgtaagtccgaaccgtacgtatccgtnttaccgtaccg

SEQ ID NO: 48453 - DNA, 862 bp, Homo sapiens
  misc_feature: GYAE6OF01A5E19.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatgactggacctggacgatcctcttcttggtggcagcagccagaagtgcccactcccacgaggaattcggtgcagtctgggcctgaggtgaagaagccgtggggcagtcaggtagaaacgtccaaccgtgacgaaggcttcgaggactacctaccttacaacctaaagtttcgaattactacgtaaccgttgggtacgacgaacgacgggtaccccgtaaggggtaaaacgggtccgtacggtaaggtaggtaggtgggtccgttggggtcggtacgttaccgttaggttggttaggaaacggtaacggtaccgggtacttagttaccgtacgtaaacggttaacggttaaccgaacggggaccgtaacgggcctaccggacgtacccggtaacgtacccgtaacggtaaacccgttaccgttaaccgaaacggaaacgaaaccgttaaccggaaccccgtttaaaggttttaacccgggaacgttaccgggtacccggtacccgggtacccgtaacccggtaaccccgttaccggtaaccggggtaacccccggaacggtacccggggtacccgttaacggtttaaggtttacggttaggttaccgggacggtaacggggaccgggtaccggggacgggtaccccgggttaggtttagggttttaacgggtaaagtttacgtttaagggttacggttacggttacggggtaccgggttcgggtacggggggtaccgggtaaacccgggg

SEQ ID NO: 48454 - DNA, 911 bp, Homo sapiens
  misc_feature: GYAE6OF01CJKJM.23.23.C01.1.454.CMB.1.raw
  modified_base (188)..(188): a, c, t, g, unknown or other
  misc_feature (188)..(188): n is a, c, g, or t
tcagacgcgagtatcacgaccggtgctcgatttagtacacgtgattagggagttgggggagtcaacaaccacatctgtcctcgagaggacaccctgtgaccacagactcctcaccatggactcggacctggacgatcctcttctggtggcagcagccagaagtcgcccactcccacgaggtaattggngctaggtcgtcgggcctaggacggtagaacggtacggccggtagggggcactacgaggtagtaaacgtcctaaccgtcgacgtacggtccgttccgaacggtaactacccgttaacccttacctaaaccttaagttttacgaacgttacctaccgtaacgggttcgggtaggacccgtacggtaacccgggtacccgggtaacgggaaacggtccgtacggtaggtacgggtaggtcgggtacggtcggggtacgtacggtaccgtagttggtaagacgggtaaccggtacggtacgtacttcgtacgtaagtacgttacgaaccggtcccaacggttctaccgacggtacccgtacgtaacccgtacggtaaccgttacccgttaacgaacggttaaaccgaccgtttacccggttaaccttaacgggtttaaccgaaccgggttccggtaccccggggtaccgtaccccgtttacccgggttaccctaaccgggttaccggtaaccccgtaccgggtacccgggttaccggtttaaagttttaccgggttacgggttaccggtacggggtaacgggtacgggtaccggggaccgggttcccggttacgggtttacgggtttacgggttttaacgggttagttaacgggttttaggttcgggttaacgggttcccgggtaccgggttacgggggtaccccgggttaacggggtaacccgggg

SEQ ID NO: 48455 - DNA, 700 bp, Homo sapiens
  misc_feature: GYAE6OF01BO3XS.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggattggtgcagtcgtgggcctgaggtgaagaagccgtggggcatcgagtagaaacgtccacctgacgaaggtcttacgaggatacctaccttacaacctaaattcgatactactacgtggtcgaccgacgaccggtaccccgtagggaaaacggtccgtacggtaaggtggaaggttcggggtacgttaggggtcggtagttacccgttaggttcggtaggaagtaacggtaccggggtactacgttccgtagtaacggtaacgtaccgtaacggaccgaggtcctaccgacgtcccgtacgtacccgtacggtaaccctaccgttaccgaaagaacgaaccgtaccgtacccgttagttaccgactcggacccgtccggtccctacgtaccctcgaacgaccgaccgtacccggtgttacgttattcgttagtggaccggtggaccgggtcgaccgggtacggtagttacgtttaggacttagtagtaggtcggtacggacgttcgggtcgggaacgtacgggg

SEQ ID NO: 48456 - DNA, 751 bp, Homo sapiens
  misc_feature: GYAE6OF01C2H4R.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcgacggccagtcagagtgttcgccgactccgtggcctaggtaaccaacaaaaacctcggaccaacgccctcccgaaggtcctacgtctacttccagtcggtaccaacgtactacccgaaaccgacgggccctaaggttcggacctaaccgtccccgacgggccgtaacggttcgaacggttcggacgtaacggttcgggaccttcggtagggaacctaggtaaccttccaccgttcctacgacgtactcgacgtacgacggttcgtaccgtacccgtaggtaaccgttagttttaccgacgtttacgttttaacgttaccgtttacgtacgtacgtacgtaaccgtcgggtcccgtaccgttccgggtacccttacgtacccgtacccggttacccgggtaaccgtaaccggggttacctaaccgggtaaccggtaggtaacgtaacggtaacggtaaaaccggttacggttacgggtaccggtacgttacggtaaccctaccgtatttaccgttccgttccgtttaacccg

SEQ ID NO: 48457 - DNA, 845 bp, Homo sapiens
  misc_feature: GYAE6OF01B3FNM.23.23.C01.1.454.CMB.1.raw
tcagacgcgagtatcacgaccggtgctcgatttagtacacgtgattagggattgggggaggaactgctcagtttggacccagagggaaccatggaacgccccagctcagtcttctcttcctctgcctcctctcggcctccagacgaccaccggagtattactttctttacgactacacgttccaccgagactagttcgtgttcctggttcgtcctacgggaaggggagacgaccgccctaccctcgtccgtggcgacgggacctagtcgaggtagttggtcgcctaccgttccgttcggaccgttacgtaaacccaaaactaaaccgtcggacctaccgccctacccggacgtccgtcgtactacttacgtacgtacgaccactaccgaaccgaacggtacggacccgtacgtacggacctacgtacccggtaggccgttaaggttcgacgggttacgacggtacgggtcggtaccgtcgggtacgggtaacaacccgtttacgttcccgtaaaccgttccgttaaaccggtaccgttaacgtaaccggtacggttaacggtaaccgggttacccgttacccgggttaacccgttaggtttaaaccgtttttagtttaccggttaacgttttaacggtttaaccgtttacgtcgtaacgacccggtaaggtccgggtccgttacccgtccggtacgtacccttagtaccccgtaccgggttacggaaccgtaccggttacgaccgggttacggacggttaacgaaacgttaaccgggtaactacggttccgggtgtaccccgtaggttacccccagtttccgtaccgtttcgtacccgtaccccg

SEQ ID NO: 48458 - DNA, 958 bp, Homo sapiens
  misc_feature: GYAE6OF01CCOAB.23.23.C01.1.454.CMB.1.raw
tcagacgcgagtatcacgaccggtgctcgatttagtacacgtgattagggattgggggagaactgctcagtttggacccagagggaaccatggaagcccagctcagcttctcttcctcctgcctcctctggtctcgtagacggacccacggatattactttctttagacactacgtcctccgagtacctatccggttgtcgtggttcgttacccgtaccgggagggggtacgacggaccgtacccctacccgttcgttccgcggtaccgggaccgggtaacctcggtaccgtaaggtacgggtttcggtttccgacccgttacccgttcccggtttcggggtaacccttacgggttaaaaccccaaaaaccggttaaaacccgtccgggacccgtacccgtaccccgtcccggtacgggttaccctccggttcgtaacgttccgaaggttaccgggacctaacgtacccggtaaccgaaacggcccggtaccgtacgttaccggacctaaccccgtaccgggtaggaaccccggtttaagggtcccgtacgggggtacgtaccgggttacgggggtacccgttaaccgggtcgggtaaccggggtaaaccttaacccggtttccgtaaaccccttaccggtacccttaccggtaacggtaccgtacggtacccgttacggttcccgtttaaccggtccccggtaacgttaacggtttaacgtttcgtttaccgttacttttaacggttccgtttacggttaaccgtaccgtaaccgggtttccggaaccgggttccgtaccggttaacccggttcccgttaccgaaccgttcccgtaacccggttaccggacggttaaccgggctttacgggaacccgtggtaaacctacgggtaacgtacgtacggtttcgggcctaagccgtaaacgtcgtagtttcccgttcggtaccccttcgg

SEQ ID NO: 48459 - DNA, 771 bp, Homo sapiens
  misc_feature: GYAE6OF01DPO6G.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctctctggctccagagaccaccggagatattcttttgacacagtctccagacatcgtgtctgtgtctccgagggggagacgacgccctaccctctaccgtgcgagggcccagtccaggtacgtggttcgccggtacttccgtggccctaggtaaccaaacgaaaaaccgtcggaccaacgtccctaccaggcctcgtctaacttccgaagtcggaccaactaccgtaccgaacggaacgggccccaagttcgggacctaccttacccgacgggtaccgaacgggttttcgaacggttcggacgtacgggtttcgggaccgttaccggttggggaaacctaggtaacccgtttccgtaaaccttccgttaacgaacccggtaacttaccgaacgtaccgtacggtttaccgtacccgggtaacccccttaggtaacccgtttagtttttaccggccgttttaagggtttttaaccttacggttacgttaccgacggtaccggtaagttccggtccgtcgtacgtaccgttaacgtcccgtaaccgttccggaaccggtacggtaccgttcccgtaggacggtaacggtagtaaacgaaaccggtagttcggagcgttacgaccgtacttagtccgttagttccgtaccc

SEQ ID NO: 48460 - DNA, 749 bp, Homo sapiens
  misc_feature: GYAE6OF01BQ6CD.23.23.C01.1.454.CMB.1.raw
tcagacgcgagtatcacgaccggtgctcgatttagtacacgtgattagggagttggggggaggaactgctcagtttggacccagagggaaccatggaagccccagctcagcttctcttcctcctgctcctctggcctcccagacgacccaccgggagattattcttttagacacagtctccagacatcgtgtctgtcgtcctccgaggggagagcgcccaccctctctggcacgggccagtcagtacggtcgttcgccgtactcgtcggtccgtacgtaaccaaacaaaccgtcggaccacgccctaccgagtctcgtactatcagtcgacctacactaccgaacgtcggaccacgttcgaccacgtacccgaggtaccgtacggttacgacggtggaccggtaggcggtacccttgggacggactacggtaccctttacgaccgttcgtaccgtacgtctaccgacgtacctagggttaccgacccgttaacccgttggtaaccgtttgtttaccgaccgtttttaagtttttaaccgtcgttacgttacggttaaccgacgggtttaaccggtcccggttaacggttcccggtacgttaccccgttaggttaacccccgttccggacccggttaccgggacggttacccctacgggacggttacgggaacgttaacgggaaacgttaaaccggtggtaccggtagtcccgaacgttccctacgtatttccgttccgtctttaaccgg

SEQ ID NO: 48461 - DNA, 724 bp, Homo sapiens
  misc_feature: GYAE6OF01E5NWF.23.23.C01.1.454.CMB.1.raw
  modified_base (200)..(200): a, c, t, g, unknown or other
  misc_feature (200)..(200): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctcgagggganagacgcctaccctctccgtgcgacgggccagtcagagttcgttcgcccgtacttccgttcggcccgttacggtaaacccaaaaccgaaaaaacccgtcggacccgacggtccccgtaccccgagggtccctccgtctacgttcacgtacggtaccaaccgtacgtaccccgaaacgaccggggaccctacgtcggtacctaaccgtcccgaacgggtcgtacgggttacgtacggtcggacgacggttcggccgttcgtacggggtacacggtaccgttacctaccgttcctacgaacgtctacgacgtccgtacggttcgtaccggtaaccctggtaacttacgtttcgtacgttagttttaacttccgtgtaccgtacgacgtacggtccgaccgtccgtacggccttacgtcctaccggttcgaaccggtacgggtcctacggacgtacggaaacgtacgtaacggtaacgtacggttcggtcgtacgtacgtaccctacgtcttaccgttgtcccttacg

SEQ ID NO: 48462 - DNA, 679 bp, Homo sapiens
  misc_feature: GYAE6OF01DAEOG.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagatattcttttgacacagtctccagacatcgtgtctgtgtctccgagggggagagagcccaccctctcctgcacgggccagtcagagtgttgccgactccgtggccctggtaacccaaacaaaaacccgtcggaccacgccctcccgaggctccgtacattcagtggaccacactaccaacgacgggcccacgtcgggccacgtaccccgacgggacgtagggttccaaggtcggtcgtagggtcggtccgttcgtaggggaacctacggtacctttccgaacctccgtacaacgactacagccgtacgttcggtacccgtaccctagtacgttagtttcgcttagttttacttacgtgtaccagtacgaacggttggaccgtccgtacggtacccttacgtcccgtaccgttacccggaccggtaacgggtacccttacggtacggtcgggaagtacgttaaacggaaaccgttaaggtcggtacggtccgtacggtaccacgttacttaccgtcgttcgttacccg

SEQ ID NO: 48463 - DNA, 718 bp, Homo sapiens
  misc_feature: GYAE6OF01ETBWF.23.23.C01.1.454.CMB.1.raw
  modified_base (308)..(308): a, c, t, g, unknown or other
  misc_feature (308)..(308): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcgttggtgcagcagccagaagtcgcccactcccagaggtaacttggtagcgtagtctgggcctggaggtgaagacgccgtagggcagtcgaagtagaaacgtccaaccgtgacgtaacggcttacgaggtactaccaccttacaaccgtaaatttgatactacaagtggngctacgcgacccgtaaggaaacggtcacgaggtcgaggtcgggcgtaggtgtacggtacctaggttgtacggtaacggaacggtaccgggtatacgttacgtaccggtaaaagtacggtttaaccgaacggtacccgagggtaccgttacggaaccgttacgtaccggtaacgtaccggtaaaccgtaccgtttaacgaacggtaaaacgaacgtaccgtaacccggtttagttaaccgggtaacctcgggacccgtccgtaccgtacgtacctacgtacgaacgtacggaccggtaccttgttattacggtcgtagcgtaggacgggcgaccggtcgtaagtttaggttacgtaagttagttacggtaggttcgaggttacccggtggtaccgggtaacgtaaccgggg

SEQ ID NO: 48464 - DNA, 651 bp, Homo sapiens
  misc_feature: GYAE6OF01AD2FF.23.23.C01.1.454.CMB.1.raw
  modified_base (262)..(262): a, c, t, g, unknown or other
  misc_feature (262)..(262): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (473)..(473): a, c, t, g, unknown or other
  misc_feature (473)..(473): n is a, c, g, or t
tcagacgcgagtatcacgaccggtgctcgatttagtacacgtgattagggagttggggagtcaacaaccacatctgtcctcgagaggacaccctgtgaccacagctcctcaccatggactggacctggacgatcctcttcttggtggcagcacgccagaagtcgcccactcccacgaggaagttggtgccagtcgtcgggccgttggacggtagaagaacgccgtggggacatccgagtagaagtcaccgtgacgaggcttnaggtactacctacctcaacctaacttgactatcaacgtggtgacacgacggcccgtaaggaaacggctaccggaggtggagttgggacgtgggtgagtaccgtagtcggtagacgacgtacgggtactattcganaaggtatcgacggtacgngtacgtgacgtactcgtacgacggaactcgtacgagtaagactacgcttaggtagacngaccgcgtacgtcgtctcgacgacgaccgtaccggtcggttatacgtttatcggtacgcggtacgggacgtccggggaaggtcccgttacgggtttaaggttttacggtacgtttaagttagggttaccgtagggtaccggttaaccgggttcggtaaccggggcggtaacccggggg

SEQ ID NO: 48465 - DNA, 762 bp, Homo sapiens
  misc_feature: GYAE6OF01BDVDP.23.23.C01.1.454.CMB.1.raw
  modified_base (210)..(210): a, c, t, g, unknown or other
  misc_feature (210)..(210): n is a, c, g, or t
  modified_base (233)..(233): a, c, t, g, unknown or other
  misc_feature (233)..(233): n is a, c, g, or t
  modified_base (731)..(731): a, c, t, g, unknown or other
  misc_feature (731)..(731): n is a, c, g, or t
  modified_base (740)..(740): a, c, t, g, unknown or other
  misc_feature (740)..(740): n is a, c, g, or t
  modified_base (754)..(754): a, c, t, g, unknown or other
  misc_feature (754)..(754): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctaccagacgaccaccggatattatttcgttttgacacagtcctacacgactatcgtgtctgtgttcaccgaggganacgacgccctacccttcttcccncggacgacgggcctagtccgaagtcgttcggttccaccgtccttccggttcggccgttacggtaaaccaaaacccgtaaaaccgtcggacccacgtcccttaccgaggtccttacgtcgtacttccagtcggcaactacctccgaacgcggtaccacggtcgaccgactccggagctacggtactagggcgacgtaggtacgtccgtacggtacggctaaccgtaccgttaccaccgtaccgtaccgtacgaccttaccagggttacaacggtccccgttaccgtaacccggtacgtttacgtttacgtttacggttaccttaaggttttacctttaccgacgtttaccgaacgggtaacccgtttaacgggtcgtacccccgtttaggtaacccgttcccggttaacccttccgttaccccggttaccggacccggttaaacgggtcctacggtacggtacgtacgtaacgtaacgggtaatacgtcggtacgtacnccggtaacnctttaccgcgtttntcccgtac

SEQ ID NO: 48466 - DNA, 672 bp, Homo sapiens
  misc_feature: GYAE6OF01BT13M.23.23.C01.1.454.CMB.1.raw
  modified_base (149)..(149): a, c, t, g, unknown or other
  misc_feature (149)..(149): n is a, c, g, or t
  modified_base (204)..(204): a, c, t, g, unknown or other
  misc_feature (204)..(204): n is a, c, g, or t
  modified_base (657)..(657): a, c, t, g, unknown or other
  misc_feature (657)..(657): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccacgganatattcttttgactacagtctccagacatcgtgtctgtgtctcgagggagagacnccacctctcgcgcacgggccaaggtcaagtagtgttcgccgtactcgttcggaccgttaggtaaacccaaaaccgaaaaccgtggacccaacgtcccgtacccgaaggtcctacgttaccaagttacagtcggaaccacaacgttaaccccaaaggtaccgggacctagtacggacctacgtaccgaggccttagggtcaggcggatacggcgtcgtagtcgggaactacgtacctttacacttacctaccgaagtactacgaagctaacgttcgggtacccacccggttgtaaagttcttttaacggctttaaactttggtaactggttacatacgacgttcgggacgtccgtcggacttacgtaccgtaccgttcggaaccggttaaggccttaacggacgtagaacgaagtaccggtaaagttcgtaggcgttcacggaccctaacttcnctttacgtcttaccg

SEQ ID NO: 48467 - DNA, 715 bp, Homo sapiens
  misc_feature: GYAE6OF01EU0SP.23.23.C01.1.454.CMB.1.raw
  modified_base (209)..(209): a, c, t, g, unknown or other
  misc_feature (209)..(209): n is a, c, g, or t
  modified_base (257)..(257): a, c, t, g, unknown or other
  misc_feature (257)..(257): n is a, c, g, or t
tcagacgcgagtatcacgaccggtgctcgatttagtacacgtgattagggattggggggaggaactgctcagtttggacccagagggaaccatggaacgccccagctcagcttctcttcctcctgctcctctggcctcccagacgacccacggagattatttcttttgacacagtctaccagacatcgtgtctgtgtctccgagggganacgacgcccaccctcctcctggccgacgggccagtacgagagttgtcncccgtacttccgttcggcctacggtaaccaaaacgaaaaccgtcggaccacgaccctcccaggctcgtactattcagtcggacacactacccgaacgacggcctaacgtcggacctaccgtcccgagggtccgtacgggttcgacggttcggacgaggtcggtcgtcggtacgggaacacgtaccgttaccacgtacctacaacgtatacctacggccgtacgtccggtacgtaacccgttgaactttactttggaccttaagttttactacgtgtactacggacgttaccgcggtaccgtccggtcggtacctaccgttcccgtaacccgggttcgaacccggtaaaggtccgtaacgggtaccgtaacgggaagtaacggttaaacggtaaaccggtagttacgggacgtaccgtacgtacccacgtttaacttccggtttacgttccgttaaccg

SEQ ID NO: 48468 - DNA, 712 bp, Homo sapiens
  misc_feature: GYAE6OF01A551E.23.23.C01.1.454.CMB.1.raw
  modified_base (172)..(172): a, c, t, g, unknown or other
  misc_feature (172)..(172): n is a, c, g, or t
  modified_base (296)..(296): a, c, t, g, unknown or other
  misc_feature (296)..(296): n is a, c, g, or t
tcagacgcgagtatcacgaccggtgctcgatttagtacacgtgattagggattgggggagtcaacaaccacatctgtcctcgagaggacaccctgtgaccacagctcctcaccatggactggacctggacgatccctcttcgttggtggcagcagccagaagtcgccctacncccacgaggaattggtgcagtcgtgggcctggagggtgaagtagccgtggggcatcgaggtagaaagtcaaccgtgacgaaggcttacgaaggactaccaccttacaacctaatttagattaanaccgaagtgggtacgacgaacgacggaccccgtaaggggaaaacggtcgtacgaaggtaggacgttgggacgtgggtagtacgtctaaggttgtacggaaagtaacgtacggataagttaccagtaaagtaggttacgaacggtacgaggccttacacgtccgttaacgaccgtacgtaacctaccttacgaaagtaacgaacgacgtacctaagttaacgacgtacgcgtaccgccgtacgaccttacgacgaccggacgtacccggtacgttacgttaagttacgtcggtacggacggtaaggacgggtacgggtacgggtaacccggttcggttaagggttttaggtaaacgtttagttaaagttacggtaacggtacggtacggttacggggttccggacgggtaaaccggg

SEQ ID NO: 48469 - DNA, 646 bp, Homo sapiens
  misc_feature: GYAE6OF01BCKD9.23.23.C01.1.454.CMB.1.raw
  modified_base (482)..(482): a, c, t, g, unknown or other
  misc_feature (482)..(482): n is a, c, g, or t
  modified_base (639)..(639): a, c, t, g, unknown or other
  misc_feature (639)..(639): n is a, c, g, or t
tcagacgcgagtatcacgaccggtgctcgatttagtacacgtgattagggattgggggaggaactgctcagtttggacccagagggaaccatggaagccccagctcagcttctcttcctctgctcctctggcctccagacgaccaccggagattatttcttttagacactagtcctccagactatcgtgtctgtcgtcgtccgaaggggagacgacgcccaccgtctcctgcgacgggtcagtcaggtgtgttcgcgtactccgtggcctaggtaaccaaacgaaaccgtcggaccacgtacctcccgacgtctcgtctattcgacgtcggacacactaccgaacgcggacacgtcggactacgccgaaggctaggtcgaggtcggacgaggtggtcctaggtacggacgtagtaccttcgaccttcgaaccgtacgactacgacgtcgtaacggtcgtacccggtaactcggtaacggttnttacggtacgtttacgtttactacgtaggtcacggtacgtacgggtcgccgtcgaccgttactacttacccgtccgtacggacccgtaaggccgtacgaacgtggagttaacgacgtaacgcgtcgggtgcccttagacccgtattacggtctcgtnttacccg

SEQ ID NO: 48470 - DNA, 671 bp, Homo sapiens
  misc_feature: GYAE6OF01BGXQ4.23.23.C01.1.454.CMB.1.raw
  modified_base (201)..(201): a, c, t, g, unknown or other
  misc_feature (201)..(201): n is a, c, g, or t
  modified_base (644)..(644): a, c, t, g, unknown or other
  misc_feature (644)..(644): n is a, c, g, or t
  modified_base (657)..(657): a, c, t, g, unknown or other
  misc_feature (657)..(657): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgagggganagacgccaccctctcctgcgagggccagtcagagtgttcgccgtactccgttggcctaggtaacccaaacgaaaaaccgtcggaccacgtccctcccgaggtctacgtctattcagtcggaccactactacccgaacgacgggacccacgtcggcacgtccccgaggacgtaggttccaggtcggacgtaggtcggccgtacggtagggaactacgtaccttccgacgttctacgacgtactacgacgtcgtagtcgtacccgacccgttagtaaccgttagttttacgacctttaagtttttaacttaacgttcgtaaccgaacggtaccgtaacggtcgggccctccgttacggtaccctagttccccgtaaccgtttccgggaaccgtaacgggtacctcggacgtcggaaagtacgtacggaaacgtaggtcggtacgntaccgctaccgtntcgttgtccttacg

SEQ ID NO: 48471 - DNA, 780 bp, Homo sapiens
  misc_feature: GYAE6OF01CC4QP.23.23.C01.1.454.CMB.1.raw
  modified_base (101)..(101): a, c, t, g, unknown or other
  misc_feature (101)..(101): n is a, c, g, or t
tcagacgcgagtatcacgaccggtgctcgatttagtacacgtgattagggattggggagtcaacaaccacatctgtcctcgagaggacaccctgtgaccanagctcctcaccatggactggacctggacgatcctcttcgttggtggcagcagccagagtcgcccactcccagaggtattggtgctagtcgtggacctgaggtagaaggacgtccgtggggacagtacgtaggtaaggaaacgtccgtaccgtacgacgtaacggtcgttacgaaggtaactacccgtaacctttaccgtaaaaccttaaagtttacgtaacttaactacgtaacggttcggggtaccgacggtaacccggtaacgggtaccccggtaaggggaaaaccggtcgttacggaagggtagggtacggtggggtcgtggggtcggtacgttaccgttaggttggtaacgaacggtacggtaccgggacttagttactacgtaaacggtacggttacgaacggtccgtacggtactaccgacgtaccgtacggtaaccgtaccggtaaacctaccggttaacaacggtaaacgaaccgtaccggtacgtacgtttaacgggacccgttacggccgggtacccgtcgtaccgtacccgtcgtaacggaccgtaccggtacccggttcgttagtttacgtcgttaggacggtaccgggaggtcgggacgtacggtcccggttagttaggttacgattcgtaaggttgacggtcgtaaggtggacggccggtacggg

SEQ ID NO: 48472 - DNA, 771 bp, Homo sapiens
  misc_feature: GYAE6OF01C7OEQ.23.23.C01.1.454.CMB.1.raw
  modified_base (150)..(150): a, c, t, g, unknown or other
  misc_feature (150)..(150): n is a, c, g, or t
  modified_base (586)..(586): a, c, t, g, unknown or other
  misc_feature (586)..(586): n is a, c, g, or t
tcagacgcgagtatcacgaccggtgctcgatttagtacacgtgattagggattgggggaggaactgctcagtttggacccagagggaccatggaagccccagctcagcttctcttcctcctgctcctctggctcccagcgaccaccgganattattctttgacacacgtctaccagacattcgtgtctgtcgtcctccggaggggagacgacgtcccgaacccttcgtccgtcgaccggtacgggcctaggtacaggttaacgttcggttacggcccgttaaccgttccgttacggcccgttaaggtaaaccccgtaaaaccggtaaaaacccgttccgggaacccgtaaccgtcccccgttacccggaacggtcccgttacgttactacgtttacgacggttacggacctaccgtacctaccgaaaccgacgggcctaacgtcggacctacgtaccccgaggaccgttaggtaccaggtcgtagtacgggtcggtccgtcggtacggaacgtaccgtctacgtactccagtacgatacgacgtcgtacggtctacgaccctaggtactttagttctaacggtttntttaacctgtacgtacgtacgtacgtagtcgtcgaaccggttcctaaccgttacgtaccgtaccggttccgtaacgggtacgttaccgtaaccggtaggtcggtaacgtaaaccggtacgtaaaccgtaggttcggacgtacggtacctccgtaaacgtggtttaactccgttaaccgttacccg

SEQ ID NO: 48473 - DNA, 863 bp, Homo sapiens
  misc_feature: GYAE6OF01CAHOY.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctcgaggggagagacgccaccctctcctgcacgggccagtcagtagtgttcgccgactcctggcctaggtaaccaaacaaaaaccgtcggaccacgccctaccgaggctcgtcattcatggcacactaccaaacgacgggccacgtggactacgtacccgaggacgtacggttacaagggttcggacgtacggtgggccttacgggtacggggaaccgtaacggtaacctttaccgtaaaccgttccgttaaccgaaaccggtaacgttaccgaacggtaccgtaaacgggtttccgggtaaaccccggttaaccccggttaagggtaaacccgggttttaactttttttaacgggaccgtttttaaacgggttttttaactttaacccggttgggtttaaacccgtaaggtaacccggtttaaaaccggggttccgggtacccggtaacccggtttaccgggtaccccttaacggttaccccggtaacccgggttttaaccccggggaacccggtaaaccggggttaccccttaccggggtaaacggttcgggaaaacggtacggttaaaccggtaaaaaccgttaacgggtttacgggtaccggggtaccttaaccggacccgttaaaccgttacggtttacccgtttacgggttccctttaaaccccgg

SEQ ID NO: 48474 - DNA, 892 bp, Homo sapiens
  misc_feature: GYAE6OF01AXDO7.23.23.C01.1.454.CMB.1.raw
  modified_base (191)..(191): a, c, t, g, unknown or other
  misc_feature (191)..(191): n is a, c, g, or t
  modified_base (242)..(242): a, c, t, g, unknown or other
  misc_feature (242)..(242): n is a, c, g, or t
  modified_base (478)..(478): a, c, t, g, unknown or other
  misc_feature (478)..(478): n is a, c, g, or t
  modified_base (511)..(511): a, c, t, g, unknown or other
  misc_feature (511)..(511): n is a, c, g, or t
tcagacgcgagtatcacgaccggtgctcgatttagtacacgtgattagggagttgggggaggaactgctcagtttggacccaggagggaaccatggaacgccccagctcagcttctcttcctcctgcctcctctggcctcccgagacgacccaccggatattactttcttttgaccactagtcctcagacnttcgtgttctgtcgtcgtccggaggggacgcgacgccctacccgtcctcgngcgacgggcctagtcagttggtcgttcgaccgtaccgttccgttcggtacccgtaacggttaacccgaaaaccgtaaaccgtcggacccaccggttcccctacccgtacgggtccctttaccggtaccttaagttcccgaacggtccgggaccaaccgtttaccgaaccgtaaccggaccgggtaccaccgttcggactaacccggccggtagccgtacggttcgtaggacggtcnggttcgcgttcgaacggactagtaccccgttanaccgtacggtacacgggataccccggtagaccgttaacccgggttcgtaaccccgtaacggttacgttacgttaacggtttttaccgtaacggttttaaacgttttcgttaacccggccgtttaaaggacccggttacgtaacggggttccggaccgtttcccgacttaaccggccgtttaaccgttaaccccggggttcgaacccggggaaccggttttaacggacgttaacccgggttacgaaacggtttacccgggttaaacgggaaccgggtttaacggttcccggggaaaccgggttttcccgtaaaaccccgtaacggtttttaacccgttaccccggtttagggtttttaacccggtcccccccttttaaaggg

SEQ ID NO: 48475 - DNA, 737 bp, Homo sapiens
  misc_feature: GYAE6OF01C88EC.23.23.C01.1.454.CMB.1.raw
  modified_base (443)..(443): a, c, t, g, unknown or other
  misc_feature (443)..(443): n is a, c, g, or t
  modified_base (710)..(710): a, c, t, g, unknown or other
  misc_feature (710)..(710): n is a, c, g, or t
tcagacgcgagtatcacgaccggtgctcgatttagtacacgtgattagggagttggggggaggaactgctcagtttggaccagagggaaccatggaagccccagctcagcttctcttcctcctgctcctctggctccagagaccacggagattattcttttgacacagtcctcagactatcgtgtctgtcgtctacggaggggagacggacgcctacccgttctccgtcggacgacggggtccaaggtacgaggtacggttcggttaccgccgtaccgttccgttggcccgttaaggtaaacccaaaaaccgtaaaaaccgtcgggacccaaccggtaccctacccgaacgggtccttaccgtactactttacgacgtcggacaaccgaactaaccgaaccgacgggtaccacgtacggactacgtacccgagtacgacggtnacggtcggacgtaggtcgcttacggacggactacggtacttcgactactacgaactacgtacagaccgtaggtaccgtacccgtacgttagtaccgtttagttaaccggtattacggttttaacttacgtacgtaacgtaacggtacccggttaacggtccgtaccggtccggttaaccggaccgttaaccttacccgaccggtttacggaccgtaacgtccgtaacgacgtacggtaagacgtaagaaaccggttagcgtacgggntacgaccaacctgtacctgttcctacg

SEQ ID NO: 48476 - DNA, 678 bp, Homo sapiens
  misc_feature: GYAE6OF01EKYJZ.23.23.C01.1.454.CMB.1.raw
  modified_base (141)..(141): a, c, t, g, unknown or other
  misc_feature (141)..(141): n is a, c, g, or t
  modified_base (204)..(204): a, c, t, g, unknown or other
  misc_feature (204)..(204): n is a, c, g, or t
tcagacgcgagtatcacgaccggtgctcgattttagtacacgtgattagggattgggggaggaactgctcagtttggacccagagggaaccatggaagccccagctcagcttctcttcctcctgctcctctggctcccagngaccaccggagattattcttttgacacagtctaccagacatcgtgtctgtgtctcgagggganagcgcctacctctcctgcgaggccagtcgagtagttcgttacgccgtacttccgtggccttacggaaccaaaacgaaaacctcggtaccaacgtcctacccgaggtcctcgtcgtacttcgaacgtcgaccacgtaacgtccgaacgacgggcctacggtcggacctaacgtcccggaggtactacgggttaccgtagtcggactagggtcgtctacggtgggaacctcggttaaccttccgaagttcctacgaccgtaatcgacgacgttacgtcgtacccgtaaccgtgtaacgttaagtttcgacttaagtttacttacgcttacgactacgtacgtcgggacctcgtaccggtacttcgtaaccttccggttacgacggacgtcgacgtaacgcggtaacgtacgtaacgtaacgtaagtcggtacgtccgaacggtcctaacgttccgtttacgtcgtttacgtacccg

SEQ ID NO: 48477 - DNA, 733 bp, Homo sapiens
  misc_feature: GYAE6OF01B1Y50.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgcccactcccacgaggaattggtgcagtcgtgggcctgaggtagaaggaagccgtggggcagtacagtagaaacgtccaacgtgacaacggtcttacgaaggtactaacctaccttaccaaaccttaatttgaattactacgtaacgtgggtacgaccgacgaccggaccccgtaggggaaaacggccgtcggaggtggaggtgggcgtagggtgtacgttcgtagtgtaggagtaacgtacggactacttacgtacgtagtaacgttacgaacggaccgacggctacgacgtccgtacgaccgtacggtaaactccgttaacgaaagtaacccgaaacgtaccgtaccgttaagttaccgggaatccgggacgtccggtccgtaccgtacgtacgacgaccgaccgtacggtacgttagtttagttcggttaggtcggtagggacgggtacgggtaccgggaccggtccggttacggtttaagggttttacggtaacggtttagtttacgggttagggttacggtacgggttaaccgggttcggggtcggggtaacccgggtaaccggggg

SEQ ID NO: 48478 - DNA, 1095 bp, Homo sapiens
  misc_feature: GYAE6OF01BJDEC.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctcagacatcgtgtctgtgtctccgaggggagagacgccaccctctcctgaccgacgggtccaggtcaaggagtgttcgccgtacttccgttcggccttacggtaacccaaaactaaaaaccgtcggtacccaacggtccccctacccgaacgggtccttaccggtacctactttccgaagttcgggacctaaccgtaccgtaccccgaaaaccgggacggggtaccccgaaccggttccgggaccctaaaccgtacccccggaacggggtaccgttaacgggggtttaccctaaggggttccgggtaccgtaagggggtcggtcccggttacggttaaccggggtaaccgtaaacggtaccctttaaaccgtccgttacccgttaccccgaaacccgtaccgttacccccgggtacgtaaacccggttaccccgttaaacggggaaccccgttaccccgttaaaagggttaaaacccgggttttaaccggttttttaacccgggggtttaaaccgggtttttttaaacccgttttaacccggttttaacccggggttaaaaccctaaaaacccggttaaaaccccgggtttaaacccccgaacccgggttttcccgggttacccccgtttcccggggttttaaccgggtaccggggttaaccccgggttttaacccggggaaaccgggggttaaacccggggtaaaccgggttaaccggggtaaaccggggttaaaaaaccgtaaaccccgggttaaaaaaaccggggttaaccgtttacggggggttacccgggtttaccccgtaaggggtaaccccctttaaaccccgggttaaatttccccccggtttaaacgggtttttaccccttaaacccggttaaccccttttttcccccccgggttaacccgggttaaacccccccg

SEQ ID NO: 48479 - DNA, 702 bp, Homo sapiens
  misc_feature: GYAE6OF01CNEZ0.23.23.C01.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (664)..(664): a, c, t, g, unknown or other
  misc_feature (664)..(664): n is a, c, g, or t
  modified_base (681)..(681): a, c, t, g, unknown or other
  misc_feature (681)..(681): n is a, c, g, or t
  modified_base (689)..(689): a, c, t, g, unknown or other
  misc_feature (689)..(689): n is a, c, g, or t
tcagacgcgagtatcacgaccggtgctcgatttagtacacgtgattagggattgggggaggaactgctcagtttggacccagagggaaccatggaacgccccagctcagcttctcttcctcctgctcctctggcctccagacgaccaccggagattatttctttagacacagtctccagactatcgtgtctgtcgtctacgaggganagacgccacctctcngacgacggccagtcagtagtcgtacgccgtactcgtgaccgtagaaccaaaccgaaacgtcggaccacgcccgtacccgagccgtcgtactattcgatcggaccaccacgtaaccgaacgacgggacctaacgtacggacctacgaccccgtaggacgtacggttacgaggtcggacgtacggtcgccgttacgggacggtacaggttaccttaccacgttacgtaccgaacgtacgtacgacggtaataacgggtttccgaacccgtaacccgttagtacgttagtttaccgattttacggttatacggtacgtacgactacggaactcgggaccgtcgtacgtaccttaccggttaccgtacccggttaacggaaccgtaacggtacgtaccgagggttaacgacgtaaacgttaaacggaaacggttacgttcgggtancccgtacgaacctaagnttcccgtntttaccgtacccg

SEQ ID NO: 48480 - DNA, 653 bp, Homo sapiens
  misc_feature: GYAE6OF01BZPYX.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctcgaggggagagacgccacctctccgtgcagggccagtcagagtgttacgccgtactccgttggcctacggtaaccaaacgaaaaccgtggacccacgtccctcccgacggtcctcgtctacttccagttcggccaacactaccgaacggacggacccacgtggacctacgtcccgaggctacggttcaggtcggacgtaggtcggcgtcggtcgggacgtacgtacttcacgtacgtcgaacgtactacgagcgtacgtcgaccgtaccgtgaacgtttagtttcgacgtttagtttattacgtcgtacacgtactaacggtcggcgtccgtcgtaccgttactaccgttaccggttaccggacggtaacgggtcctacggtacgtagggtaataacggtaacggtaaaggtcggttcggcggaccgtacgacgtaacctatttccgttcgttccgttaccg

SEQ ID NO: 48481 - DNA, 795 bp, Homo sapiens
  misc_feature: GYAE6OF01CHCU0.23.23.C01.1.454.CMB.1.raw
tcagacgcgagtatcacgaccggtgctcgatttagtacacgtgattagggattggggggaggaactgctcagtttggacccagagggaaccatggaagccccagctcagcttctcttcctcctgctcctctggcctcccagagaccaccggagtattattcttttgacacagtctccagacatcgtgtctgtgtctcgaggggagagacgcccaccctctccgtgcgacgggccagtcaggtacgtggttcgccgtactccgtcggtccgtacggtaaccaaaaccgaaaaaccgtcggacccacgacccgtacccgacggtccttcgactattaccagtacggccacgtactacccgaacgacgggaccacgtgaccaccgtcccgaggtacctacgggttacgaggtcggacgtagggtcggtccgtacgggttagggaaccgtacgtaccttacctaccgttcctacgtaacgactacgacgtctacgggttccggacccgtacccgttaggttacgtttacgttttacgtacgttttaacgttttaacttaaccggttcggtaaccgacggtaaccggttaccgggtccgggtccgttacccggtacggttaccctaaccgtttaccccgtaacccgggtttaacccggggacccggtaaacggggttacccctacggggaaaccgttggggaaaacggttaacgtaacccggggaaacgttaccggggttggttcgggaccttcggtaaaccctacccggtgtttaacccgtttcgtccccgtttacccg

SEQ ID NO: 48482 - DNA, 879 bp, Homo sapiens
  misc_feature: GYAE6OF01DJGPZ.23.23.C01.1.454.CMB.1.raw
  modified_base (238)..(238): a, c, t, g, unknown or other
  misc_feature (238)..(238): n is a, c, g, or t
tcagacgcgagtatcacgaccggtgctcgatttagtacacgtgattagggattgggggaggaactgctcagtttggacccagagggaaccatggaagccccagctcagcttctcttcctcctgctctctgctccagacgaccgaccggagattatttcttttagacacacgtcctaccaagacctagtcgtgtcgtgttgttcctccggaggggagacgacgccctacccctctccgngcgacgggccagtcagagtgtcgccgtacttcggtcgtccgttacggaccagacaacgaaactgtcggaccacggtcctaccccgacggtcctaccccttagtacgtttactacgtcgaacgttcgaccctaaccgtaccgaaaccggtacgggtcccctaacggtacggtacccctaccgttacccccgggaaacgttcccgggtaacggggttttacccgaaggggttccgggtagtaaccggggggttttcgggtacggtaacgggggtactaacggtaccctttacgttacctaacctaccaacccttacgaaccggtacgtacgtaaccggtacccgttaacggtaccgtaaccggttaggttaacgtttacgttttacgggttaactttaagtttttaaccgtttacggtaaccgttcgaacggtacgttaaccgggtaaccggttaccggtaaccgttacggttaccccgggttaccccggttaccggggttttaaccggggacccggggtaaaccgggtaaaacccgggtaagggttaaacggaaaaccgttaacccgggttaaaacggacgttacggggtacgtacccgggttaagaccccggttaactacggtttccgttacgtttacccg

SEQ ID NO: 48483 - DNA, 680 bp, Homo sapiens
  misc_feature: GYAE6OF01A07U2.23.23.C01.1.454.CMB.1.raw
  modified_base (186)..(186): a, c, t, g, unknown or other
  misc_feature (186)..(186): n is a, c, g, or t
  modified_base (277)..(277): a, c, t, g, unknown or other
  misc_feature (277)..(277): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgcccactcccagaggtattggtgcngtctggcctgacggtgaagacgccgtgggcagtcagtagaatcacctgacaacggtcttcgaggtactactacctacaactaattgtatanactaacgtggtacgacggacgaccggtaccgtaaggaacggtcgtacggtaggtaggacggtcgggtacggtacgggtacgtacgttaccgttaggttaggtacgaacggtaacggtaccggtactacgtccgtagtaagtacgtacgacggtcgacgtctacgacgtaccgtacgacgtacgacctactacgaacgtaacaacgacgtactagtacgacgtcgccgtccgctacgtacctaccgacgaccgtacgacggtaccgttagttacttcgtacggacgtacggaggacgggtaccgggtacggtaccggttacggtttagggtttacggtaagttacggttaaggttaggtacggttacgggttaccggttaccggacgggtaacccggtacgggg

SEQ ID NO: 48484 - DNA, 760 bp, Homo sapiens
  misc_feature: GYAE6OF01EE8L7.23.23.C01.1.454.CMB.1.raw
  modified_base (226)..(226): a, c, t, g, unknown or other
  misc_feature (226)..(226): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
tcagacgcgagtatcacgaccggtgctcgatttagtacacgtgattagggattgggggagggaactgctcagtcgacggacccagaggaaccatggaagccccagctcagcttctcttcctcctgctactctgctcccagactaccaccggagaaattgtagttggacacgaggtcctccagccacctgttctttgtcctcgaggggacagacgccaccctctccngcacgggccagtcagatataacactgcncancgtgtcgaccaaaaccaaaaccgtcggaccacgcctacccgagacctccgtatacttctttagacttcggaccctaccgtaaggtccgggtacccttggaccctccgacgccgtaggttcaggtggacgtaggtcgggttacgtgggggaacctaggtaccgttacctaacccgttccgtacccgaaccgtacgttaccggaaccggtccgtaaccggtccgtacgggtaaccgacccggttaacggttaacgggttttacgttttacggggtttacttttaaacgttttaccggttacggtttaaccgtaccggttaacccgtttacggaaccttacggttaccggtttacgttacccggtttcggaacccgggaacggggtaaccaagggtccgtacggtaacggtacgtacgaacggtaccggtacggtaggtacggtccgtacgtactaccgtacttccggttcgttaccgttctaaccgttccctacccggctaccgg

SEQ ID NO: 48485 - DNA, 689 bp, Homo sapiens
  misc_feature: GYAE6OF01ETS2D.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggcctccagagaccaccggagatattcttttgacacagtctccagacatcgtgtctgtgtctccgagggganagagcccacctctcctgcagggccagtcagagtgtcgccgacttccgttggcctggtaaccaaaccgaaaaaccgtcggacccacgccctcccgaggtcctcgtcattcgagtcggcacactaccaacgtacgggccacgtcggacacgtcccgaggtcgacggttacgaggtcggacgtagggtcggcttcggacgggaactagtacctttacaccgttcctacgaacgtactacgacgaccgtacggtacgtaccggtaacccgttaggtaaccggtttagttttacgacgtttaagttttacttacgtgttacacgtacgaacggttcggaccgtccgttacggaccttacgtaccgttaccggttccgggaccgaaacgggtcctaccggtacggtaggggaactaacggtaacggaaaacggtacgttacggtacggtcctaccggtactaacccgtaatttccgttacgttccgttaccg

SEQ ID NO: 48486 - DNA, 861 bp, Homo sapiens
  misc_feature: GYAE6OF01CAU9X.23.23.C01.1.454.CMB.1.raw
  modified_base (99)..(99): a, c, t, g, unknown or other
  misc_feature (99)..(99): n is a, c, g, or t
  modified_base (105)..(105): a, c, t, g, unknown or other
  misc_feature (105)..(105): n is a, c, g, or t
tcagacgcgagtatcacgaccggtgctcgatttagtacacgtgattagggattgggggaggaactgctcagtttggacccaggagggaaccatggaacnccccanctcagcttctcttcctcctgcctcctctggcctccagacgaccgacggagattattcttttgacactagtcctccagacatcgtgtcttgtcgtctcggaggggagagacgcccctacccgttctacctcgacgcgggacctagtacgagtacgtggttcgacctaccttccgtcggccgttacgtaaaccaaaaccaaaaccgtccggaccaacgtcccctaccgtacgcgtaccgtctattcgagtcggacctactacctaccgaaccggacgggtaccctacggtcggaacctacccgtacccggtacggtaccggttacggttaccgtagggtcgggtaccgtggggttaccgggttccgtacgggttaaccggggtaacgtaacccggttaccttaccgttacccttacgttaccccgtaacgtacgtaccggtaacgtccggttaaccggttacccggtaccccgtaaccccgggttagttaaccgttttaaggtttaccttaaccgggttttactttttaacgttaacccgttgttaacccgtacgtaacccggttaacgggtcccgggtacccggttcccggttacgtaacccgtacctttcccggttacccggtacccgggtaacccgggtaacggttaccggtacggttaccggtacggtaaacggttacgtaaaccggtaaacgttcggtagggtaccgtcgttacccgaaccgttaccgtcgtttaccgttccttccgttaccc

SEQ ID NO: 48487 - DNA, 718 bp, Homo sapiens
  misc_feature: GYAE6OF01ALNRA.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtcctccgaggggagagacgcccaccctctccgtgcgacgggcctagcagtagtgttcgccgacttccgtcggccgtacggtaccaaaacaaaaccctcggaccacgccctacccgagtccttcgcgtattcagtcggacacgtacctaccaaacgacgggcccacgtgacaccgtcccgaggccgtacggtacgacggttcggaccgtaggtcggccgtacggtaggactacggtccttaccgtacgtcctacgaccgtaactccgacgtcgtacggtccgtaccgtacccgtaggtacggtttactttcgtactttacggtttactttcgtaccgtagtacgtcgtaaccgggtcgggcccgttccgtacggttacccgtacttacccccggtaccggttcccggtaaccggacgggttacccgtaggtaccggtagggtaagttaaaccggtacggtaaacggtacggttacggccgttacgacccgtaaccgttacgttgtacccgtttagttcccgtttacccgg

SEQ ID NO: 48488 - DNA, 811 bp, Homo sapiens
  misc_feature: GYAE6OF01EL4DE.23.23.C01.1.454.CMB.1.raw
  modified_base (196)..(197): a, c, t, g, unknown or other
  misc_feature (196)..(197): n is a, c, g, or t
tcagacgcgagtatcacgaccggtgctcgatttagtacacgtgattagggattgggggaggaactgctcagtttggaccagagggaaccatggaagcccagctcagcttctcttcctctgctcctctggctcccagagaccaccggagatattcttttgacacagtctcagacatcgtgtctgtgtctcaggggannagcaccctctcctgcagggccagtcgagacgtgttcgccggtacttccttcggcccttacggtaaccgaaaccaaaaaacccttcgggacccaacggtcccccgttacccgaacgggtccttcggttacccagtttacctacgttcgggtcaaccgtacctcccaaaaccgaggggaccctaaccgtcggggaccctacgttacccccgaagggtccctaaggggtttacccgtaagggttacgggccggaaggttcggggacctttacccgtaggggggaaccctaggtaacctttcgtaaccctttccgacgtaaccggtacttaccgaggtaccgtaacgttggttaccgtaaccccgtggtaaccggtaacttttcggtactacggtttttaacttttaaccgcgttttacgacggtacccgtaacgttcgggtaaccgtccgttaacgggtccccttaacgttccggaaaccgtttcccgggtaccggaaccggggttaccgtaacgggtacccgttaaagggtaacccggtaagtaccccggtaaaggaacccttgggttacgggtaccttcggaacgttaccgagttccttccgggttctttacccg

SEQ ID NO: 48489 - DNA, 694 bp, Homo sapiens
  misc_feature: GYAE6OF01CQW6J.23.23.C01.1.454.CMB.1.raw
  modified_base (207)..(207): a, c, t, g, unknown or other
  misc_feature (207)..(207): n is a, c, g, or t
  modified_base (548)..(548): a, c, t, g, unknown or other
  misc_feature (548)..(548): n is a, c, g, or t
  modified_base (678)..(678): a, c, t, g, unknown or other
  misc_feature (678)..(678): n is a, c, g, or t
  modified_base (684)..(684): a, c, t, g, unknown or other
  misc_feature (684)..(684): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagacgaccaccggagattatttcttttgacacagtctccagacatcgtgtctgtgtctacggagggganagcgccctacctctccgtgcgacggccagtacgaggtacgttggttacgcccgtaccgttccgttcggtacccgtaaggttaaacccaaaaaccgtaaaaccgtcggacctacgtccccgtaccgacggtcctcgtactacgttcagtcggacctacacgtaaccgaacggaccgggtcctaacggtcggacctaccgtacccggaggtacgtacggttcgtacggtcggtacgtaggtcggtaccgtggtacggactacgttaccgttcacttctacgacgtactcgacgtcgtagtccgaccgtacgtgttacgttatttacggctttagtttactcgngtacgacgtacgtaggtcgccgttcgaccgttactacgtacccgttaccggtacgaacggtacgggtcctacgggtacgtaggacgttaacgaacgtaagtcgtcgggtacgcctacgtactaaccgttnttccgngttccctacg

SEQ ID NO: 48490 - DNA, 767 bp, Homo sapiens
  misc_feature: GYAE6OF01D8GZN.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggagttggggggaggaactgctcagtttggacccagagggaaccatggaagccccagctcagcttctcttcctcctgctcctctggctcccagagaccaccggagatatttctttgacacagtctacagacatcgtgtctgtgtctcgagggganagacgcccacctctccgtgcgacgggccagtcagagtcgtcgccgtactcctggtcctacggtaaccaaacaaaaccgtcggaccacgccctacccgaggtcctcgtactacttacagtcggaccacactaccaaacggacgggaccacgtcggacaccgtacccgacggtacgtacggtacaggtcggacgtacggtcggtccgttacggtagggaccgtacgtaccttaccgtaaccttccgtaccgaacgtactaccgtacgtacgtaacggttcgtaccccgtaaccgttagtaaccgttacgttttacgactttaacgttttactttacggtgtaccgtacggtaaccgttaacgggtccggtccgttaccggttccggaccctttacgtaccccgttaacccggtttaccgggaacccgttaaccggggtactacccggtacggttacgggaaacgttaacgttaaaccgggaaaacccgttaggttaccgggtacggtacccgttaccgtaacccgtaaccgttaacgtttcccgtttaacgttcccgtttaacccg

SEQ ID NO: 48491 - DNA, 755 bp, Homo sapiens
  misc_feature: GYAE6OF01E47NS.23.23.C01.1.454.CMB.1.raw
  modified_base (187)..(187): a, c, t, g, unknown or other
  misc_feature (187)..(187): n is a, c, g, or t
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (740)..(740): a, c, t, g, unknown or other
  misc_feature (740)..(740): n is a, c, g, or t
tcagacgcgagtatcacgaccggtgctcgatttagtacacgtgattagggattggggggaggaactgctcagtttggacccaggagggaaccatggaagccccagctcagcttctcttcctcctgctcctctcggctcccagagaccaccggagatatttcttttgacacagtctccagacatcgtntctgtgtctcgagggganagcgccacctctccngcgaggccagtcagtagtcgttcgccgaccgttccgttcggcccgttacggtaaacccaaaaccgtaaaaacccgtcggacccacgtcccgtacccgacggtccttcgtactatttaccgagtcggaccactacgtaccgaaacgtacgggaccctacggtcggtaccacgtaccccgggaggtacgtaacgggttccgaagggttcggcgtaggtcgggtctaacggtcggggaacctagtaccttccaacgttccgtacgacgtacgtacgacgtaccgtaggtccgtacccggtaaccccgtaggtaccgtttaacgttttacgtacgttttaacgttttaacgttttctaaccggtacgtaacggtaaccgggtaaccggttccgggaccgtttcccgggtacggttacccgttacctaccggttaaccgtttcccgggaacggaacgggttcctaacggcggttaaggaacgttaaacgacggtaacgtaacggtggacgcttacgctaaccgtnttcgtattccttccg
